US012655188B2

(12) United States Patent
Mali et al.

(10) Patent No.: US 12,655,188 B2
(45) Date of Patent: Jun. 16, 2026

(54) COMPOUNDS CONTAINING ONE OR MORE DIBORONATES AND RELATED INSULIN ANALOGS

(71) Applicant: Protomer Technologies, Inc., Pasadena, CA (US)

(72) Inventors: Sachitanand Mali, Pasadena, CA (US); Diao Chen, Pasadena, CA (US); Ryan Kelly Spencer, Porter Ranch, CA (US); Jack Joseph Steele, La Cañada Flintridge, CA (US); Jingxin Liang, Covington, WA (US); Mirna Ekram Anwar Shaker, Cypress, CA (US); Alborz Mahdavi, Pasadena, CA (US)

(73) Assignee: Protomer Technologies, Inc., Indianapolis, IN (US)

( * ) Notice: Subject to any disclaimer, the term of this patent is extended or adjusted under 35 U.S.C. 154(b) by 13 days.

(21) Appl. No.: 18/632,799

(22) Filed: Apr. 11, 2024

(65) Prior Publication Data

US 2024/0400637 A1     Dec. 5, 2024

Related U.S. Application Data

(60) Provisional application No. 63/502,778, filed on May 17, 2023, provisional application No. 63/495,442, filed on Apr. 11, 2023.

(51) Int. Cl.
*C07K 14/62* (2006.01)
*A61K 38/00* (2006.01)

(52) U.S. Cl.
CPC .............. *C07K 14/62* (2013.01); *A61K 38/00* (2013.01)

(58) Field of Classification Search
CPC ........ C07K 14/62; A61K 38/00; A61K 47/54; A61K 47/545; A61P 3/10
See application file for complete search history.

(56) References Cited

U.S. PATENT DOCUMENTS

| | | | |
|---|---|---|---|
| 2019/0247468 A1* | 8/2019 | Mahdavi | ............... C07K 14/62 |
| 2020/0325160 A1* | 10/2020 | Kruse | .................. G01N 24/088 |
| 2023/0134116 A1* | 5/2023 | Mahdavi | ............... A61K 38/28 514/5.9 |
| 2023/0374045 A1* | 11/2023 | Mali | ..................... A61K 47/54 |

FOREIGN PATENT DOCUMENTS

| | | |
|---|---|---|
| WO | 2021/202802 A1 | 10/2021 |
| WO | 2022/109078 A1 | 5/2022 |
| WO | 2022/235691 A1 | 11/2022 |
| WO | 2023/225534 A1 | 11/2023 |

OTHER PUBLICATIONS

International Search Report mailed Oct. 15, 2024, in the International Application No. PCT/US2024/024054.

* cited by examiner

*Primary Examiner* — Sudhakar Katakam
(74) *Attorney, Agent, or Firm* — Thomas P. Weber

(57) ABSTRACT

The disclosure relates to novel compounds that include one or more aromatic boron-containing groups, including diboronates, and methods of making the disclosed compounds. The present disclosure further relates to pharmaceutical compositions comprising the disclosed compounds, and their use in prevention and treatment of diseases and disorders, such as hyperglycemia, type 2 diabetes, impaired glucose tolerance, type 1 diabetes, obesity, metabolic syndrome X, or dyslipidemia, diabetes during pregnancy, prediabetes. Alzheimer's disease, MODY 1, MODY 2 or MODY 3 diabetes, mood disorders, and psychiatric disorders.

29 Claims, 15 Drawing Sheets

Specification includes a Sequence Listing.

single chain insulin

DS-129A
DMSO/DIEA single chain insulin
intermdediate 1) 50 mM acetic acid (pH 4.5)
2) 100 mM NaCl and 30% ACN
3) 1 M Tris, pH 9
4) 500 mM CaCl₂
5) Trypsin + CBP Example 900

1

DSL-34B
DMSO/DIEA

2

1) 50 mM acetic acid (pH 4.5)
2) 100 mM NaCl and 30% ACN
3) 1 M Tris, pH 9
4) 500 mM CaCl₂
5) Trypsin Example 19A

COMPOUNDS CONTAINING ONE OR MORE DIBORONATES AND RELATED INSULIN ANALOGS

FIELD OF THE DISCLOSURE

The present disclosure relates to novel compounds that include one or more aromatic boron-containing groups, including diboronates. The disclosure relates to the use of the novel compounds to bind glucose. The present disclosure further relates to kits and the use of the compounds and/or pharmaceutical compositions comprising the disclosed compounds for the treatment of disorders characterized by elevated glucose levels, such as hyperglycemia, pre-diabetes and diabetes (e.g., type 1 diabetes, type 2 diabetes, diabetes during pregnancy, MODY 1, MODY 2 or MODY 3 diabetes), impaired glucose tolerance, obesity, metabolic syndromes, dyslipidemia, neurological diseases, mood disorders, and psychiatric disorders.

SEQUENCE LISTING

The present application is being filed along with a Sequence Listing in electronic format. The Sequence Listing is provided as a file titled "30583M_WO_SL.xml," created Apr. 10, 2024, and is 30,688,753 bytes in size. The information in the electronic format of the Sequence Listing is incorporated herein by reference in its entirety.

BACKGROUND OF THE DISCLOSURE

Boronic acids are generally considered Lewis acids that have a tendency to bind to hydroxyls, because, as Lewis acids, boronic acids can form complexes with Lewis bases such as, for example, hydroxide anions. Thus, molecules containing boronates including boronic acids have a general tendency to bind hydroxyl groups. This binding tendency can be used for detection of hydroxyl-containing groups by boronated labeling reagents wherein the boronate groups bind to the hydroxyls and, depending on the solvent and buffer conditions, the boronates can form hydrolysable boronate-ester bonds to the hydroxyl groups of hydroxyl containing molecules, such as the hydroxyl groups present in diols (e.g., glucose). Although boron-containing compounds can bind to diol containing molecules, achieving selectivity using boron-containing compounds has been challenging because of their ability to bind various diols, including cis diols, to varying degrees. While improved binding affinity of boron-containing compounds towards a specific vicinal diol of interest may be achieved, this may result in a loss of selectivity.

Glucose is the main fuel for the human body, and blood glucose values are tightly regulated in healthy individuals. For example, between meals, blood glucose is near 5 mmol/L (mM), and when blood glucose concentrations rise after a meal, the value is quickly adjusted back toward 5 mM by the action of insulin. The hormone insulin is secreted from pancreatic beta cells, and when insulin binds to insulin receptors on cells in the body (for example muscle and fat), the cells are stimulated to absorb glucose by translocation of glucose transporters from storage vesicles to the cell surface (GLUT4) (see, e.g., Huang, S. H. et al. *Cell Metabolism,* 5:237-252 (2007)).

People with diabetes may lose their ability to produce insulin due to autoimmunity against beta cells (type 1) or have low sensitivity to insulin in combination with impaired insulin secretion (type 2). For example, those with type 1 diabetes may rely on multiple daily insulin injections, both for basal coverage, typically once a day, and with meals (bolus) to control their glucose levels (see, e.g., Polonsky, K. S. et al. The Journal of Clinical Investigation 81: 442-448 (1988)). Because glucose values can fluctuate unpredictably, perfect insulin dosing day after day is extremely difficult. Indeed, despite many technological advances in diabetes treatment, researchers are currently observing, partly due to lifestyle problems, a worsening of long-term glucose control and/or overall metabolic health.

Glucose sensors and glucose sensing insulin analogs are known in the art. See, e.g., WO 2016/179568 A1 and WO 2021/202802 A1. However, there is a need in the art to develop glucose sensors and glucose sensing insulins that have improved properties, such as binding to the insulin receptor and being proportionately responsive to different glucose concentrations and providing a graded and reversible response to changes in glucose levels under physiological conditions.

Thus, there is an unmet medical need for novel compounds, such as compounds which bind glucose and may be utilized in glucose-responsive insulin analogues/conjugates, that can control blood glucose levels.

Here, according to certain embodiments, we disclose glucose sensors and glucose sensing insulin analogs that have improved properties, such as prolonged terminal half-life and/or a decrease in clearance, improved affinity for the insulin receptor, and/or improved activation of the insulin receptor.

SUMMARY OF THE DISCLOSURE

In a first aspect, a compound comprises one or more diboronates of the following formula, or a stereoisomer or a mixture of stereoisomers, or pharmaceutically acceptable salt thereof:

$$\left[ Z1c - \left( Z1b \right)_{n'} \right]_{q'} - X1.$$

Each Z1b is independently a linker moiety. Each n' is 0, 1, 2, 3, 4, or 5. At least one n' is 1, 2, 3, 4, or 5. X1 can comprise a drug substance or a polypeptide. Each Z1c is covalently conjugated directly or via one or more Z1b to an amine in X1. At least one Z1c is independently selected from a diboronate, wherein the diboronate is independently selected from Formulae FF12A, FF12B, FF12C, FF12D, FF116A, FF116B, FF116C, FF116D, FF225, and FF227. Each additional Z1c is optionally independently selected from a diboronate, a sugar moiety, a diol containing moiety, and a polyol containing moiety, wherein the diboronate is independently selected from Formulae FF12A, FF12B, FF12C, FF12D, FF116A, FF116B, FF116C, FF116D, FF225, and FF227 Each q' is 1, 2, 3, 4, or 5, wherein when q' is 2 or more, each corresponding Z1c and Z1b is independently selected and may be the same or different. Formulae FF12A, FF12B, FF12C, FF12D, FF116A, FF116B, FF116C, FF116D, FF225, and FF227 are:

FF12A

3

-continued

FF12B

FF12C

FF12D

FF116A

FF116B

FF116C

FF116D

4

-continued

FF225

FF227

X in the foregoing formulae represents a point of covalent attachment to an amine of Z1b or to an amine of X1 when n' is 0. Each i can be 1, 2, 3, 4, 5, 6, or 7. Groups $B_1$ and $B_2$ in the foregoing formulae may be identical or different, each independently represent an aromatic boron-containing group. When each Z1c is selected from Formulae FF225 and FF227, at least one of the $B_1$ and the $B_2$ is Formula F7, wherein Formula F7 is:

(F7)

One $R_1$ of F7 represents (C=O)—*, wherein —* represents the attachment point to the rest of Z1c. Each remaining $R_1$ can independently be selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7. Y8 can be O or NR, wherein R is a $C_1$-$C_6$ alkyl group or H. Each Y10 is independently selected from H, $CH_3$, F, and $CF_3$, wherein for at least one F7 at least one Y10 is not H.

In a second aspect, a compound is selected from the group consisting of a polypeptide comprising an A-chain and a B-chain, wherein the A-chain comprises a sequence selected from 1, 24051, and 24052. The B-chain can comprise a sequence selected from SEQ ID NOs 24063, 25228, 25229, 25232, 25305, 25308, 25312, 25236, 25095, and 25380-25397.

In a third aspect, a pharmaceutical composition comprises at least one compound or a pharmaceutically acceptable salt thereof according to any one of the embodiments according to the first and second aspects In a fourth aspect, the present disclosure includes a compound of the following formula, or a stereoisomer or a mixture of stereoisomers, or pharmaceutically acceptable salt thereof:

Z1c-Linker

The Z1c-Linker can be selected from:

FFL-1

FFL-2

FFL-3

-continued

FFL-4

FFL-5

FFL-6

FFL-7

-continued

FFL-8

FFL-9

FFL-10

FFL-11

-continued

FFL-12

FFL-13

FFL-14

FFL-15

-continued

FFL-16

FFL-17

FFL-18

-continued

FFL-19

FFL-20

FFL-21

FFL-22

-continued

FFL-23

FFL-24

FFL-25

FFL-26

-continued

FFL-27

FFL-28

FFL-29

21
22

FFL-30

FFL-31

FFL-32

-continued

FFL-33

FFL-34

FFL-35

FFL-36

-continued

FFL-37

FFL-38

FFL-39

FFL-40

-continued

FFL-41

FFL-42

FFL-43

FFL-44

-continued

FFL-45

FFL-46

FFL-47

FFL-48

-continued

FFL-49

FFL-50

FFL-51

-continued

FFL-52

FFL-53

FFL-54

-continued

FFL-55

FFL-56

FFL-57

FFL-58

-continued

FFL-59

FFL-60

FFL-61

FFL-62

-continued

FFL-63

FFL-64

FFL-65

-continued

FFL-66

FFL-67

FFL-68

The group X of the foregoing formulae can be selected from a leaving group, $NH_2$, and H. The groups $B_1$ and $B_2$, which may be identical or different, each independently represents an aromatic boron-containing group.

In a fifth aspect, the present disclosure includes a polypeptide comprising an A-chain and a B-chain, wherein the A-chain comprises a sequence selected from 1, 24051, and 24052. The B-chain can comprise a sequence selected from 25000-25397.

In a sixth aspect, the present disclosure includes a compound having agonist potency for an insulin receptor comprising at least one aromatic boron-containing group having agonist potency for an insulin receptor, or a pharmaceutically acceptable salt thereof. The compound can have a first EC50 potency for activating the insulin receptor at a first glucose concentration and a second EC50 potency for activating the insulin receptor at a second glucose concentration. When the first glucose concentration is 5.6 mM and the second glucose concentration is 16.7 mM, the compound has an insulin receptor agonist potency ratio of the first EC50 to the second EC50 of about 1.2 to about 20, such as about 1.5 to about 15, about 2 to about 14, about 2.5 to about 13, about 2.5 to about 12, about 2.5 to about 11, about 2.5 to about 10, about 2.5 to about 9, about 2.5 to about 8, about 2.5 to about 7, about 2.5 to about 6, about 2.5 to about 5, or about 2.5 to about 4.5.

In a seventh aspect, the present disclosure includes a compound having agonist potency for glucose comprising at least one aromatic boron-containing group having binding affinity for glucose, or a pharmaceutically acceptable salt thereof. When administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL, the compound provides a relative glucose infusion rate difference (mg/kg/min·min) of about 1 to about 2500, about 1 to about 2000, about 1 to about 1500, about 100 to about 1500, and about 1000 to about 1500, and a relative glucose infusion rate ratio of about 0.1 to about 5, about 0.2 to about 4.5, about 0.5 to about 4, about 0.5 to about 3.5, about 1 to about 3.5, about 1.5 to about 3.5, or about 2 to about 3.

In an eighth aspect, the present disclosure includes compound according to any one of the embodiments within the previous aspects or a pharmaceutically acceptable salt thereof, for use as a medicament.

In a ninth aspect, the present disclosure incudes a method of treatment or prevention of diabetes, impaired glucose tolerance, hyperglycemia or metabolic syndrome. The method comprises administering to a subject in need thereof a compound of any one embodiment of the foregoing first, second or fifth through eighth aspect, or a pharmaceutical composition according to the third aspect.

In a tenth aspect, the present disclosure incudes a compound, a use of the compound, a method of administering the compound, or a device or formulation comprising the compound according to any one embodiment of the foregoing first, second or fifth through eighth aspect, or a pharmaceutical composition according to the third aspect. The disclosure includes the use or the method in the treatment or prevention of diabetes, impaired glucose tolerance, hyperglycemia or metabolic syndrome. The disclosure includes the manufacture of a medicament comprising such compound. The disclosure includes the use of such compound as a therapeutic agent for the treatment of diabetes or obesity, for control of blood sugar levels, or for control of release of a drug. The disclosure includes the method comprises administering to the subject the compound as a therapeutic or prophylactic agent. The disclosure includes the use of a compound according to any one of the embodiments of the fourth aspect as an intermediate in the synthesis of a drug substance or a therapeutic of a prophylactic compound.

In an eleventh aspect, the present disclosure incudes a compound comprising at least one diboronate, wherein the diboronate comprises at least two aromatic boron-containing groups, wherein at least one aromatic boron-containing group is covalently attached to the compound and selected from F3-F11, and the other aromatic boron-containing group is covalently attached to the compound and optionally selected from F1-F11 or a boronic acid, (F1)

-continued (F2)

(F3)

(F4)

(F5)

(F6)

(F7)

(F8)

-continued (F9)

(F10)

and (F11)

At least one R1 in each of F1-F11 is covalently attached to the compound. Each remaining $R_1$ and $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7. For Formulae F3-F4, R, is O or S. For Formula F6, when Y8 is O, i is 1, 2, 3, 4, or 5; or i is 2, 3, 4, or 5; and none, one, or two R1 represents F, CI, $CF_2$, $CF_3$, $SF_5$, $OCF_3$, $SO_2CH_3$ and/or $SO_2CF_3$; or when Y8 is NR, R is an alkyl group or H, and i is 1, 2, 3, 4, or 5. For Formulae F5 and F7-F10, when Y8 is O, i is 1, 2, 3, 4, or 5; or when Y8 is NR, R is an alkyl group or H, and i is 1, 2, 3, 4, or 5; Y9 is $CH_3$, F, $CF_3$, $CHF_2$, or $OCH_3$; and each Y10 is independently selected from H, $CH_3$, $CH_2CH_3$, $CH_2CH_2OH$, F, $CF_3$, $CHF_2$, and $OCH_3$, with the proviso that at least one Y10 is not H.

In a twelfth aspect, the present disclosure incudes a tautomer, stereoisomer or a mixture of stereoisomers, or a pharmaceutically acceptable salt, or hydrate, or isotopic derivative thereof of the compound according to the eleventh aspect.

In a thirteenth aspect, the present disclosure incudes a compound comprising X1 and one or more Z1c, or a tautomer, stereoisomer or a mixture of stereoisomers, or a pharmaceutically acceptable salt, or hydrate, or isotopic derivative thereof. X1 comprises:

(i) $NH_2$ or OH;

(ii) a drug substance comprising an amine;

(iii) a drug substance that is covalently conjugated to an amine containing linker; or (iv) an amine configured to be covalently conjugated to a drug substance.

Each Z1c is covalently conjugated, directly or indirectly, to an amine in X1 or to OH when X1 is OH. Each Z1c is independently selected from:

a) Formulae FF1-FF48, wherein Formulae FF1-FF48 are:

(FF1)

(FF2)

(FF3)

(FF4)

(FF5)

(FF6)

(FF7)

47

-continued

48

-continued (FF8)

(FF9)

(FF10)

(FF11)

(FF12)

(FF13)

(FF14)

(FF15)

(FF16)

(FF17)

(FF18)

(FF19)

(FF20)

(FF21)

49

-continued (FF22)

(FF23)

(FF24)

(FF25)

(FF26)

(FF27)

(FF28)

50

-continued (FF29)

(FF30)

(FF31)

(FF32)

(FF33)

(FF34)

(FF35)

(FF36)

5

10

15

20

25

30

35

40

45

50

55

60

65

-continued (FF37)

(FF38)

(FF39)

(FF40)

(FF41)

(FF42)

(FF43)

(FF44)

-continued (FF45)

(FF46)

(FF47)

and (FF48)

;

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7; and

B$_1$ and B$_2$, which may be identical or different, each independently represents an aromatic boron-containing group;

b) Formulae FF49-FF88, wherein Formulae FF49-FF88 are:

(FF49)

(FF50)

(FF51)

53

-continued (FF52)

5

(FF53)

10

(FF54)  15

(FF55)

20

25

(FF56)

30

(FF57)  35

40

(FF58)

45

(FF59)  50

55

(FF60)

60

65

54

-continued (FF61)

(FF62)

(FF63)

(FF64)

(FF65)

(FF66)

(FF67)

55

-continued (FF68)

(FF69)

(FF70)

(FF71)

(FF72)

(FF73)

56

-continued (FF74)

(FF75)

(FF76)

(FF77)

(FF78)

(FF79)

-continued

-continued (FF80)

(FF86)

(FF81)

(FF87)

and (FF82)

(FF88)

(FF83)

wherein X represents a point of covalent attachment either directly to an amine in X1 or to an amine that is covalently conjugated directly or indirectly to X11, or to OH when X1 is OH;

i is 1, 2, 3, 4, 5, 6, or 7;

j is 1, 2, 3, 4, 5, 6, or 7;

R1a is selected from COOH, CH$_3$, H, and OH;

(FF84)

R2, R3, R4 and R5 are each independently selected from CH$_3$, H, OH, and COOH, and at least one of R2, R3, R4 and R5 is CH$_3$ or OH; and B$_1$ and B$_2$, which may be identical or different, are each independently an aromatic boron-containing group;

c) Formulae FF89-FF112, wherein Formulae FF89-FF112 are:

(FF85)

(FF89)

-continued

-continued (FF90)

(FF95)

(FF91)

(FF96)

(FF92)

(FF97)

(FF93)

(FF98)

(FF94)

(FF99)

61
-continued (FF100)

(FF101)

(FF102)

(FF103)

(FF104)

62
-continued (FF105)

(FF106)

(FF107)

(FF108)

(FF109)

5

10

15

20

25

30

35

40

45

50

55

60

65

63
-continued

64
-continued (FF110)

(FF114)

(FF111)

and (FF115)

(FF112)

(FF116)

(FF117)

wherein X represents a point of covalent attachment either directly to an amine in X1 or to an amine that is covalently conjugated directly or indirectly to X1, or to OH when X1 is OH;

i is 1, 2, 3, 4, 5, 6, or 7; and $B_1$, $B_2$ and $B_3$, which may be identical or different, are each independently an aromatic boron-containing group, a carboxylic acid derivative, or a H, wherein in each FF89-FF112 structure containing $B_1$, $B_2$ and $B_3$ groups, at least two of the $B_1$, $B_2$ and $B_3$ groups are independently an aromatic boron-containing group;

d) Formulae FF113-FF136, wherein Formulae FF113-FF136 are:

(FF118)

(FF119)

(FF113)

(FF120)

65
-continued

66
-continued (FF121)

5

10

(FF128)

(FF122)

15

(FF129)

(FF123) 20

25

(FF130)

(FF124)

30

35

(FF131)

(FF125)

40

45

(FF132)

(FF126)

50

(FF127) 55

60

(FF133)

65

67

(FF134)

5

10

(FF135)

and

15

(FF136)

20

25 wherein X represents a point of covalent attachment either
directly to an amine in X1 or to an amine that is
covalently conjugated directly or indirectly to X1, or to
OH when X1 is OH;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group,
an acyl group, a cycloalkyl group, a haloalkyl group, an
aryl group, and a heteroaryl group, each R1 optionally
comprises one or more alkyl-halide, halide, sulfhydryl,
aldehyde, amine, acid, hydroxyl, alkyl, or aryl groups;
and $B_1$ and $B_2$, which may be identical or different, each
independently represents an aromatic boron-containing
group;

e) Formulae FF137-FF160, wherein Formulae FF137-
FF160 are:

(FF137)

50

55

(FF138)

60

65

68

(FF139)

(FF140)

(FF141)

(FF142)

(FF143)

(FF144)

(FF145)

69

-continued (FF146)

(FF147)

(FF148)

(FF149)

(FF150)

(FF151)

(FF152)

70

-continued (FF153)

(FF154)

(FF155)

(FF156)

(FF157)

(FF158)

71

-continued (FF159)

and (FF160)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl, or aryl groups; and $B_1$ and $B_2$, which may be identical or different, each independently represents an aromatic boron-containing group;

f) Formulae FF61-FF164, wherein Formulae FF161-FF164 are:

(FF161)

(FF162)

(FF163)

72

-continued (FF164)

wherein X represents a point of covalent attachment either directly to an amine in X1 or to an amine that is covalently conjugated directly or indirectly to X1, or to OH when X1 is OH;

i is 1, 2, 3, 4, or 5;

j is 1, 2, 3, 4, or 5;

each R6, R7, R8, and R9 for different values of j is independently selected from H, $CF_3$, $CH_3$, $CHF_2$, and $(CH_2)_m CH_3$, wherein m is 1, 2, 3, 4, or 5;

Y3, Y4, Y5, Y6 and Y7 are each independently selected from H, $CH_2$—X4, and Formulae IV-1 to IV-135;

wherein X4 is selected from —COOH, —$(CH_2)_m$COOH, an alkyl group, an acyl group, a cycloalkyl group, a haloalkyl group, an aryl group, and a heteroaryl group, each X4 optionally comprises one or more alkyl-halide, halide, sulfhydryl, aldehyde, amine, acid, hydroxyl, alkyl or aryl groups; wherein m is 1, 2, 3, 4, or 5;

wherein at least one of Y5, Y6 and Y7 in Formulae FF162 and FF163 is not H and at least one of Y7, R8 and R9 in FF164 is not H; and wherein Formulae IV-1 to IV-135 are:

(IV-1)

(IV-2)

(IV-3)

(IV-4)

73
-continued (IV-5)

(IV-6)

(IV-7)

(IV-8)

(IV-9)

(IV-10)

(IV-11)

(IV-12)

(IV-13)

(IV-14)

74
-continued (IV-15)

(IV-16)

(IV-17)

(IV-18)

(IV-19)

(IV-20)

(IV-21)

(IV-22)

(IV-23)

(IV-24)

(IV-25)

75

-continued

76

-continued (IV-26)

(IV-27)

(IV-28)

(IV-29)

(IV-30)

(IV-31)

(IV-32)

(IV-33)

(IV-34)

(IV-35)

(IV-36)

(IV-37)

(IV-38)

(IV-39)

(IV-40)

(IV-41)

(IV-42)

(IV-43)

(IV-44)

(IV-45)

(IV-46)

(IV-47)

(IV-48)

5

10

15

20

25

30

35

40

45

50

55

60

65

77
-continued

78
-continued (IV-49)

(IV-50)

(IV-51)

(IV-52)

(IV-53)

(IV-54)

(IV-55)

(IV-56)

(IV-57)

(IV-58)

(IV-59)

(IV-60)

(IV-61)

(IV-62)

(IV-63)

5

10

15

20

25

30

35

40

45

50

55

60

65

79
-continued (IV-64)

(IV-65)

(IV-66)

(IV-67)

(IV-68)

(IV-69)

80
-continued (IV-70)

(IV-71)

(IV-72)

(IV-73)

(IV-74)

(IV-75)

(IV-76)

5

10

15

20

25

30

35

40

45

50

55

60

65

81
-continued

82
-continued (IV-77)

(IV-78)

(IV-79)

(IV-80)

(IV-81)

(IV-82)

(IV-83)

(IV-84)

(IV-85)

(IV-86)

(IV-87)

(IV-88)

(IV-89)

(IV-90)

(IV-91)

(IV-92)

(IV-93)

(IV-94)

83

-continued

84

-continued (IV-95)

(IV-96)

(IV-97)

(IV-98)

(IV-99)

(IV-100)

(IV-101)

(IV-102)

(IV-103)

(IV-104)

(IV-105)

(IV-106)

(IV-107)

(IV-108)

(IV-109)

5

10

15

20

25

30

35

40

45

50

55

60

65

85

-continued

86

-continued (IV-110)

(IV-120)

5

(IV-121)

10

(IV-111)

(IV-112)  15

(IV-122)

20

(IV-113)

25

(IV-123)

30

(IV-114)

35

(IV-115)

(IV-124)

40

(IV-116)

45

(IV-125)

(IV-117)

50

(IV-126)

55  (IV-118)

60

(IV-119)

(IV-127)

65

-continued (IV-128)

(IV-129)

(IV-130)

(IV-131)

(IV-132)

(IV-133)

(IV-134)

and (IV-135)

wherein Xa represents CH=O, CHF$_2$, CF$_3$, CH$_2$SH, COOH, CH$_2$OH, CH$_2$NO$_2$, CH$_2$NH$_2$, CH$_3$, C(CH$_3$)$_3$, CH(CH$_3$)$_2$, CH((CH$_2$)$_3$—CH$_3$)$_2$, or CH(CH$_2$—CH$_3$)$_2$;

Xb represents O, NH, CH$_2$, or S;

Xc represents CH or N;

each R$_{10}$ is independently selected from H, F, Cl, Br, CH$_3$, CF$_3$, CH=O, OH, COOH, and (CH$_2$)$_n$CH$_3$, m is 1, 2, 3, 4, or 5; and n is 1, 2, 3, 4, or 5;

B$_1$ and B$_2$, which may be identical or different, each independently represents an aromatic boron-containing group; and in Formulae IV-1 to IV-135 represents a point of attachment to corresponding Formulae FF161-164;

g) Formulae FF165-FF166, wherein Formulae FF165-FF166 are:

(FF165)

and (FF166)

wherein X represents a point of covalent attachment either directly to an amine in X1 or to an amine that is covalently conjugated directly or indirectly to X1, or to OH when X1 is OH;

m is 1, 2, 3, 4, 5, 6, or 7;

n is 1, 2, 3, 4, 5, 6, or 7;

X5 is S, O, or NH; and each R1 is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$)NH(CH$_2$)$_m$CH$_3$, and OCF$_3$, wherein m is 1, 2, 3, 4, 5, 6, or 7;

h) Formulae FF167-FF192, wherein Formulae FF167-FF192 are:

89

90

-continued (FF167)

(FF176)

5

(FF168) 10

(FF177)

15

(FF169)

20

(FF170) 25

(FF178)

30

(FF171)

35

(FF179)

(FF172) 40

45

(FF173)

(FF180)

50

(FF174)

55

(FF181)

(FF175) 60

65

| 91 | 92 |
|---|---|

(FF182)

5

10

(FF187)

(FF183)

15

20

(FF188)

(FF184)

25

30

35

(FF189)

(FF185)

40

45

50

(FF190)

(FF186)

55

60

65

(FF191)

and

-continued (FF192)

wherein X represents a point of covalent attachment either
directly to an amine in X1 or to an amine that is
covalently conjugated directly or indirectly to X1, or to
OH when X1 is OH;

$B_1$ and $B_2$, which may be identical or different, each
independently represents an aromatic boron-containing
group;

i) Formulae FF193-FF209, wherein Formulae FF193-
  FF209 are:

FF193

FF194

FF195

FF196

FF197

-continued

FF198

FF199

FF200

FF201

FF202

FF203

FF204

FF205

95

FF206

FF207

FF208

FF209 wherein R in FF208 and FF209 is an alkyl, aryl or halide
that is covalently conjugated through at least one CH$_2$
group to the amino group in the side chain of FF208 or
FF209, R1 and R2 are independently selected from H, CH$_3$, alkyl,
and formulae IV-1 to IV-135;

i is 1, 2, 3, 4, or 5;

j is 1, 2, 3, 4, or 5; and wherein X represents a point of covalent attachment either
directly to an amine in X1 or to an amine that is
covalently conjugated directly or indirectly to X1, or to
OH when X1 is OH; and B$_1$ and B$_2$, which may be identical or different, each
independently represents an aromatic boron-containing
group;

j) Formulae FF210-FF224, wherein Formulae FF210-
FF224 are:

FF210

FF211

96

FF212

FF213

FF214

FF215

FF216

FF217

FF218

FF219

FF220

-continued (FF221)

(FF222)

(FF223)

(FF224)

wherein R11 in FF210 to FF212 is selected from Formulae IV-1 to IV-135 and R12 is selected from an amine, a hydroxyl, an alkyl, and a halide group;

wherein each R13 is independently selected from H, $CH_3$, alkyl, aryl and Formulae IV-1 to IV-135; R14 is selected from H, $CH_3$, alkyl, aryl and heteroaryl;

wherein X represents a point of covalent attachment either directly to an amine in X1 or to an amine that is covalently conjugated directly or indirectly to X1, or to OH when X1 is OH;

X" represents a point of covalent attachment to an amine —N in the compound, wherein — represents a single covalent bond to a $CH_2$ or CH group in the compound;

i is 1, 2, 3, 4, or 5;

j is 1, 2, 3, 4, or 5; and $B_1$, $B_2$, $B_3$, $B_4$, $B_5$, and $B_6$ each independently represents an aromatic boron-containing group, wherein in each FF structure containing $B_1$, $B_2$ and $B_3$ groups, at least two of the $B_1$, $B_2$ and $B_3$ groups are independently an aromatic boron-containing group; and k) Formulae FF225-FF231, wherein Formulae FF225-FF231 are:

(FF225)

-continued (FF226)

(FF227)

(FF228)

(FF229)

(FF230)

(FF231)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

$B_1$ and $B_2$, which may be identical or different, each independently represents an aromatic boron-containing group, wherein $B_1$ and $B_2$ in Formulae FF225-FF231 are not a boronic acid or an F2 or F6 aromatic boron-containing group, wherein Formulae F2 and F6 are:

(F2)

and (F6)

$R_1$ at position 4' or position 5' represents (C=O)—*, wherein —* represents the attachment point to the rest of Z1c;

zero, one, or two $R_1$ represents F, CI, $CF_2$, $CF_3$, $SF_5$, $OCF_3$, $SO_2CH_3$, and/or $SO_2CF_3$, and each remaining $R_1$ represents H;

Y8 is O; and i is 1; and wherein at least one primary or secondary amine in FF1-FF223 and FF225-231 is optionally covalently conjugated to $B_6$.

In a fourteenth aspect, the present disclosure incudes a composition or a mixture comprising at least one compound of any one of the embodiments of the eleventh, twelfth, or the thirteenth aspect, for use as a medicament for the treatment of diabetes, for control of blood sugar levels, or to control. the release of a drug based on physiological levels of diol containing small molecules or sugars. The disclosure includes a method of administering such compound to a human subject as a therapeutic or prophylactic agent. The disclosure includes a method of making such a compound, wherein the method comprises at least one alkylation and/or amidation step. The disclosure includes a method of treating a subject by administering a device or formulation comprising such a compound. The disclosure includes a method of treatment or prevention of diabetes, impaired glucose toler-ance, hyperglycemia, or metabolic syndrome, wherein the method comprises administering to a subject in need thereof a therapeutically effective amount of such a compound.

In a fifteenth aspect, the present disclosure incudes a compound selected from Formulae FF1-FF231, wherein Formulae FF1-FF48 are:

(FF1)

(FF2)

(FF3)

(FF4)

(FF5)

(FF6)

(FF7)

101

-continued (FF8)

(FF9)

(FF10)

(FF11)

(FF12)

(FF13)

(FF14)

102

-continued (FF15)

(FF16)

(FF17)

(FF18)

(FF19)

(FF20)

(FF21)

5

10

15

20

25

30

35

40

45

50

55

60

65

103

-continued (FF22)

(FF23)

(FF24)

(FF25)

(FF26)

(FF27)

(FF28)

104

-continued (FF29)

(FF30)

(FF31)

(FF32)

(FF33)

(FF34)

(FF35)

(FF36)

5

10

15

20

25

30

35

40

45

50

55

60

65

105

-continued (FF37)

(FF38)

(FF39)

(FF40)

(FF41)

(FF42)

(FF43)

(FF44)

106

-continued (FF45)

(FF46)

(FF47)

and (FF48)

;

wherein X is selected from an maleimide, amine, OH, and halogen; and i is 1, 2, 3, 4, 5, 6, or 7;

j is 1, 2, 3, 4, 5, 6, or 7; and $B_1$ and $B_2$, which may be identical or different, each independently represents an aromatic boron-containing group;

wherein Formulae FF49-FF88 are:

(FF49)

(FF50)

(FF51)

107
-continued

108
-continued (FF52)

(FF53)

(FF54)

(FF55)

(FF56)

(FF57)

(FF58)

(FF59)

(FF60)

(FF61)

(FF62)

(FF63)

(FF64)

(FF65)

(FF66)

(FF67)

(FF68)

-continued (FF69)

(FF70)

(FF71)

(FF72)

(FF73)

(FF74)

(FF75)

-continued (FF76)

(FF77)

(FF78)

(FF79)

(FF80)

(FF81)

111

-continued (FF82)

(FF83)

(FF84)

(FF85)

(FF86)

(FF87)

and

112

-continued (FF88)

wherein X is selected from maleimide, an amine, OH, and halogen;

i is 1, 2, 3, 4, 5, 6, or 7;

j is 1, 2, 3, 4, 5, 6, or 7;

R1a is selected from COOH, CH$_3$, H, and OH;

R2, R3, R4 and R5 is each independently selected from CH$_3$, H, OH, and COOH, and at least one of R2, R3, R4 and R5 is CH$_3$ or OH; and B$_1$ and B$_2$, which may be identical or different, are each independently an aromatic boron-containing group;

wherein Formulae FF89-FF112 are:

(FF89)

(FF90)

113
-continued

114
-continued (FF91)

(FF97)

(FF92)

(FF98)

(FF93)

(FF99)

(FF94)

(FF100)

(FF95)

(FF96)

(FF101)

115
-continued (FF102)

(FF103)

(FF104)

(FF105)

(FF106)

116
-continued (FF107)

(FF108)

(FF109)

(FF110)

(FF111)

and

117

-continued (FF112)

wherein X is selected from maleimide, an amine, OH, and halogen;

i is 1, 2, 3, 4, 5, 6, or 7; and $B_1$, $B_2$ and $B_3$, which may be identical or different, each independently represents an aromatic boron-containing group, a carboxylic acid derivative, or a H, wherein at least two of B1, B2 and B3 in each FF structure are independently an aromatic boron-containing group;

wherein Formulae FF113-FF136 are:

(FF113)

(FF114)

(FF115)

(FF116)

118

-continued (FF117)

(FF118)

(FF119)

(FF120)

(FF121)

(FF122)

(FF123)

119

-continued (FF124)

(FF125)

(FF126)

(FF127)

(FF128)

(FF129)

(FF130)

120

-continued (FF131)

(FF132)

(FF133)

(FF134)

(FF135)

(FF136)

wherein X is selected from maleimide, an amine, OH, and halogen;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group;

wherein Formulae FF137-FF160 are:

(FF137)

(FF138)

(FF139)

(FF140)

(FF141)

(FF142)

-continued (FF143)

(FF144)

(FF145)

(FF146)

(FF147)

(FF148)

(FF149)

-continued (FF150)

(FF151)

(FF152)

(FF153)

(FF154)

(FF155)

-continued (FF156)

(FF157)

(FF158)

(FF159)

and (FF160)

wherein X is selected from maleimide, an amine, OH, and halogen;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group;

| 125 | 126 | wherein Formulae FF161-FF164 are:

(IV-2)

(FF161)

(FF162)

(FF163)

(FF164)

(IV-3)

(IV-4)

(IV-5)

(IV-6)

wherein X is selected from maleimide, an amine, OH, and halogen;

i is 1, 2, 3, 4, or 5;

j is 1, 2, 3, 4, or 5;

each R6, R7, R8, and R9 for different values of j is independently selected from H, CF$_3$, CH$_3$, CHF$_2$, and (CH$_2$)$_m$CH$_3$, wherein m is 1, 2, 3, 4, or 5;

Y3, Y4, Y5, Y6 and Y7 are each independently selected from H, CH$_2$—X4, and Formulae IV-1 to IV-135;

wherein X4 is selected from —COOH, —(CH$_2$)$_m$COOH, an alkyl group, an acyl group, a cycloalkyl group, a haloalkyl group, an aryl group, and a heteroaryl group, each optionally comprising one or more alkyl-halide, halide, sulfhydryl, aldehyde, amine, acid, hydroxyl, alkyl or aryl groups; wherein m is 1, 2, 3, 4, or 5;

wherein at least one of Y5, Y6, and Y7 in Formulae FF162 and FF163 is not H and at least one of Y7, R8 and R9 in FF164 is not H; and wherein Formulae IV-1 to IV-135 are:

(IV-7)

(IV-8)

(IV-9)

(IV-1)

(IV-10)

(IV-11)

127

-continued

128

-continued (IV-12)

(IV-23)

5

(IV-13)

10

(IV-24)

(IV-14)

15

(IV-25)

20

(IV-26)

(IV-15)

25

(IV-27)

(IV-16)

30

(IV-28)

(IV-17)   35

(IV-29)

(IV-18)   40

(IV-19)   45

(IV-30)

(IV-31)

50

(IV-20)

55

(IV-32)

(IV-33)

60

(IV-21)

(IV-34)

(IV-22)

65

(IV-35)

129

-continued (IV-36)

(IV-37)

(IV-38)

(IV-39)

(IV-40)

(IV-41)

(IV-42)

(IV-43)

(IV-44)

(IV-45)

(IV-46)

130

-continued (IV-47)

(IV-48)

(IV-49)

(IV-50)

(IV-51)

(IV-52)

(IV-53)

(IV-54)

131
-continued

132
-continued (IV-55)

5

10

(IV-56)

15

(IV-57)

20

25

(IV-58)

30

35

(IV-59)

40

45

(IV-60)

50

55

(IV-61)

60

65

(IV-62)

(IV-63)

(IV-64)

(IV-65)

(IV-66)

(IV-67)

(IV-68)

133
-continued

134
-continued (IV-69)

(IV-70)

(IV-71)

(IV-72)

(IV-73)

(IV-74)

(IV-75)

(IV-76)

(IV-77)

(IV-78)

(IV-79)

(IV-80)

(IV-81)

(IV-82)

(IV-83)

(IV-84)

(IV-85)

5

10

15

20

25

30

35

40

45

50

55

60

65

135

-continued (IV-86)

(IV-87)

(IV-88)

(IV-89)

(IV-90)

(IV-91)

(IV-92)

(IV-93)

(IV-94)

136

-continued (IV-95)

(IV-96)

(IV-97)

(IV-98)

(IV-99)

(IV-100)

(IV-101)

(IV-102)

(IV-103)

137
-continued (IV-104)

(IV-105)

(IV-106)

(IV-107)

(IV-108)

(IV-109)

138
-continued (IV-110)

(IV-111)

(IV-112)

(IV-113)

(IV-114)

(IV-115)

(IV-116)

(IV-117)

(IV-118)

(IV-119)

5

10

15

20

25

30

35

40

45

50

55

60

65

139

-continued (IV-120)

(IV-121)

(IV-122)

(IV-123)

(IV-124)

(IV-125)

(IV-126)

(IV-127)

140

-continued (IV-128)

(IV-129)

(IV-130)

(IV-131)

(IV-132)

(IV-133)

(IV-134)

and (IV-135)

5

10

15

20

25

30

35

40

45

50

55

60

65 wherein:

Xa represents CH=O, CHF$_2$, CF$_3$, CH$_2$SH, COOH, CH$_2$OH, CH$_2$NO$_2$, CH$_2$NH$_2$, CH$_3$, C(CH$_3$)$_3$, CH(CH$_3$)$_2$, CH((CH$_2$)$_3$ CH$_3$)$_2$, or CH(CH$_2$ CH$_3$)$_2$;

Xb represents O, NH, CH$_2$, or S;

Xc represents CH or N;

each R$_{10}$ is independently selected from H, F, Cl, Br, CH$_3$, CF$_3$, CH=O, OH, COOH, and (CH$_2$)$_n$CH$_3$, m is 1, 2, 3, 4, or 5; and n is 1, 2, 3, 4, or 5;

B$_1$ and B$_2$, which may be identical or different, each independently represents an aromatic boron-containing group; and

* in Formulae IV-1 to IV-135 represents the point of attachment to corresponding Formulae FF161-164;

wherein Formulae FF165-FF166 are:

(FF165)

and (FF166)

wherein X is selected from maleimide, an amine, OH, and halogen;

m is 1, 2, 3, 4, 5, 6, or 7;

n is 1, 2, 3, 4, 5, 6, or 7;

X5 is S, O, or NH; and each R$_1$ is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH CH$_3$, —(SO$_2$)NH(CH$_2$)$_m$CH$_3$, and OCF$_3$, wherein m is 1, 2, 3, 4, 5, 6, or 7;

wherein Formulae FF167-FF192 are:

(FF167)

(FF168)

(FF169)

(FF170)

(FF171)

(FF172)

(FF173)

(FF174)

(FF175)

143

-continued (FF176)

(FF177)

(FF178)

(FF179)

(FF180)

(FF181)

144

-continued (FF182)

(FF183)

(FF184)

(FF185)

(FF186)

5

10

15

20

25

30

35

40

45

50

55

60

65

145

-continued

146

-continued (FF187)

(FF192)

(FF188)

wherein X is selected from an maleimide, amine, OH, and halogen;

B₁ and B₂, which may be identical or different, each independently represents an aromatic boron-containing group, wherein Formulae FF193-FF209 are:

(FF189)

FF193

FF194

(FF190)

FF195

FF196

(FF191)

and

FF197

FF198

147

-continued

148

-continued

FF199

FF200

FF201

FF202

FF203

FF204

FF205

FF206

FF207

FF208

FF209 wherein R in FF208 and FF209 is an alkyl, aryl or halide that is covalently conjugated through at least one $CH_2$ group to the amino group in the side chain of FF208 or FF209;

R1 and R2 are independently selected from H, $CH_3$, alkyl, and formulae IV-1 to IV-135;

i is 1, 2, 3, 4, or 5;

j is 1, 2, 3, 4, or 5; and wherein X is selected from maleimide, an amine, OH, and halogen; and $B_1$ and $B_2$, which may be identical or different, each independently represents an aromatic boron-containing group;

wherein Formulae FF210-FF224 are:

FF210

FF211

FF212

149

-continued

FF213

FF214

FF215

FF216

FF217

FF218

FF219

FF220

FF221

150

-continued

FF222

FF223

FF224 wherein R11 in FF210 to FF212 is independently selected from Formulae IV-1 to IV-135 and R12 is selected from an amine, a hydroxyl, an alkyl, and a halide group;

wherein each R13 is independently selected from H, CH₃, alkyl, aryl, and formulae IV-1 to IV-135; R14 is selected from H, CH₃, alkyl, aryl, and heteroaryl;

wherein X is independently selected from maleimide, an amine, OH, and halogen;

X" is an amine;

i is 1, 2, 3, 4, or 5;

j is 1, 2, 3, 4, or 5;

and

B₁, B₂, B₃, B₄, B₅ and B₆ each independently represents an aromatic boron-containing group, wherein in each FF structure containing B1, B2 and B3 groups, at least two of the B1, B2 and B3 groups are independently an aromatic boron-containing group; and wherein Formulae FF225-FF231 are:

(FF225)

(FF226)

(FF227)

-continued (FF228)

(FF229)

(FF230)

(FF231)

wherein X is selected from an maleimide, amine, OH, and halogen;

i is 1, 2, 3, 4, 5, 6, or 7;

$B_1$ and $B_2$, which may be identical or different, each independently represents an aromatic boron-containing group, wherein $B_1$ and $B_2$ in Formulae FF225-FF231 are not a boronic acid or an F2 or F6 aromatic boron-containing group, wherein Formulae F2 and F6 are:

(F2)

and

-continued (F6)

$R_1$ at position 5' represents (C=O)—*, wherein —* represents the attachment point to the rest of FF225-FF231;

zero, one, or two $R_1$ represents F, Cl, $CF_2$, $CF_3$, $SF_5$, $OCF_3$, $SO_2CH_3$, and/or $SO_2CF_3$, and each remaining $R_1$ represents H;

Y8 is O; and i is 1; and each remaining $R_1$ is H;

Y8 is O; and i is 1; and wherein at least one primary or secondary amine in FF1-FF223 and FF225-FF231 is optionally covalently conjugated to $B_6$; and when X is an amine in any one of Formulae FF1 to FF223 and FF225-FF231, X is optionally acetylated or alkylated.

In a sixteenth aspect, the present disclosure incudes a human insulin analog, comprising an A-chain and a B-chain, wherein the sequence of the A-chain comprises:

$X_{aa'}X_{bb'}X_{cc'}X_{dd'}X_{ee'}X_{ff'}X_{gg'}$VEQCCX$_{hh'}X_{ii'}$ICSLYQLE-NYCNX$_{jj'}X_{kk'}X_{ll'}X_{mm'}X_{nn'}X_{oo'}X_{pp'}$ (SEQ ID NO:24015); and wherein the sequence of the B-chain comprises:

(i)

(SEQ ID NO: 24016)
$X_{aa}X_{bb'}X_{cc'}X_{dd'}$KX$_{ee'}X_{ff'}X_{gg'}X_{hh'}X_{ii'}X_{jj'}$KX$_{kk'}X_{ll'}X_{mm'}X_{nn'}$QHLCGSHLVEALYLVC $X_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ii}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, (ii)

(SEQ ID NO: 24017)
$X_{aa}X_{bb}X_{cc}X_{dd}$KPX$_{ee}X_{ff}X_{gg}X_{hh}X_{ii}X_{jj}X_{kk}X_{ll}X_{mm}X_{nn}$QHLCGSHLVEALYLVC $X_{oo}X_{pp}X_{qq}$GFFYTX$_{rr}X_{ss}X_{tt}X_{uu}X_{vv}X_{ww}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ii}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, E, F, G, H, I, K, L, N, P, Q, R, S, T, V, Y and W, FIG. 6 includes an insulin comprising an A-chain according to SEQ ID NO: 1 and B-chain according to DEQ ID NO: 24062.

FIG. 7 includes an insulin comprising an A-chain according to SEQ ID NO: 1 and B-chain according to DEQ ID NO: 24063.

FIG. 8 includes an insulin comprising an A-chain according to SEQ ID NO: 1 and B-chain according to DEQ ID NO: 25397.

FIGS. 9A and 9B illustrates a synthesis of a modified insulin according to Example 900.

FIGS. 10A and 10B illustrates a synthesis of a modified insulin according to Example 19A.

FIG. 11 includes a scheme of synthesis of diboronated sensors DS139 and DS139A.

FIG. 12 includes a scheme of synthesis of diboronated sensors DS149 and DS149A.

FIG. 13 includes a scheme of DSL Synthesis Method 1.

FIG. 14 includes a scheme of DSL Synthesis Method 2.

FIG. 15 includes a scheme of DSL Synthesis Method 3.

FIG. 16 includes a scheme of DSL Synthesis Method 4.

Figure 17:
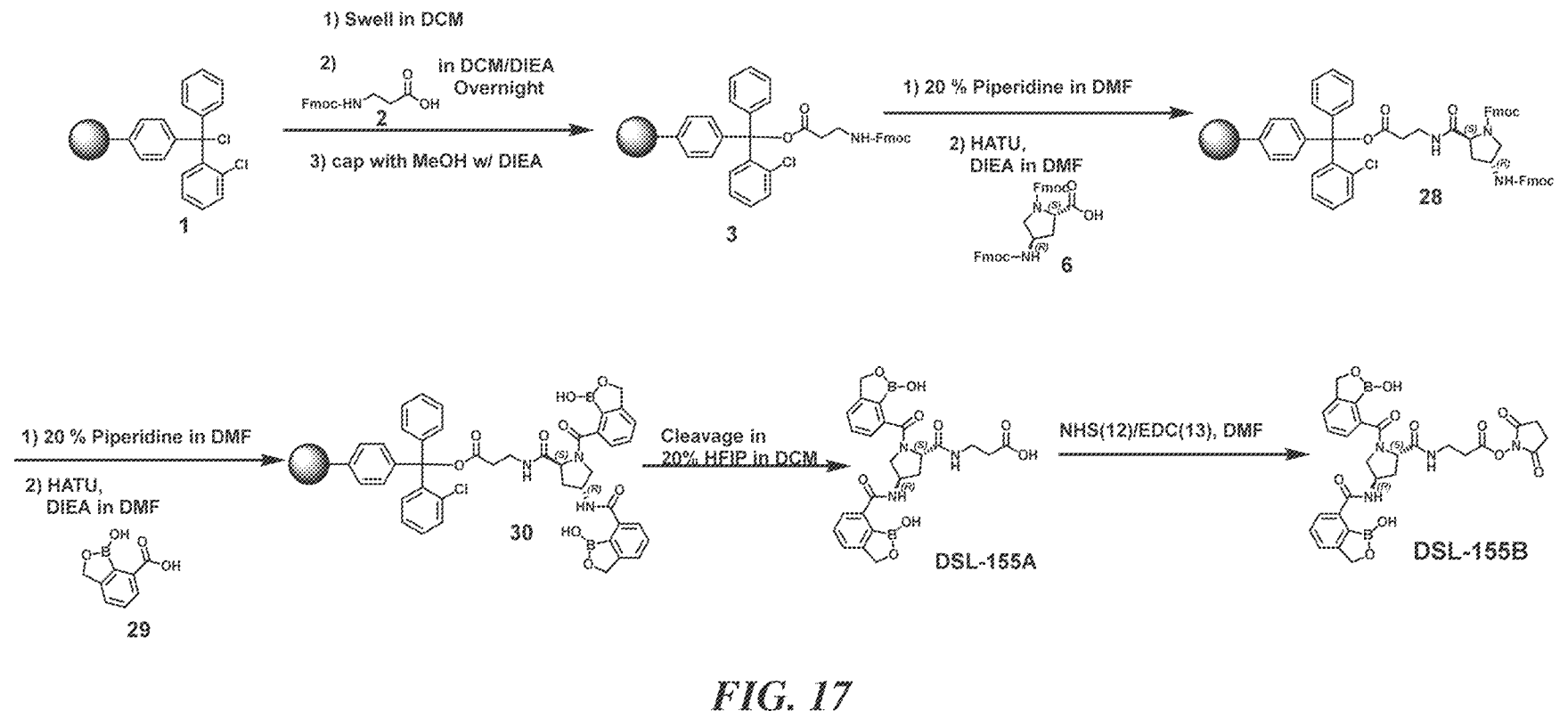

FIG. 17 includes a scheme of DSL Synthesis Method 5.

DETAILED DESCRIPTION OF THE DISCLOSURE

While aromatic boron-containing compounds (e.g., groups) can bind to diol containing molecules, achieving selectivity using aromatic boron-containing compounds (which can act as molecular sensors) is challenging because of their ability to bind various diols, including cis diols, to varying degrees. Improved binding affinity of aromatic boron-containing compounds (which can act as sensors) towards a specific vicinal diol of interest may result in a loss of selectivity.

Scaffolds that position the boron functionality (e.g., sensors) of the aromatic boron-containing compounds in a specific or particular ensemble of geometries can increase selectivity towards a specific vicinal diol while simultaneously maintaining affinity for the diol of interest. According to some embodiments, aromatic boron-containing compounds disclosed herein have different pendant groups on the aromatic boron-based scaffolds along with which specific scaffold geometries that impact binding to hydroxyl containing molecules.

According to some embodiments, the compounds of the present disclosure comprise aromatic boron-containing compounds that orient the boron functionalities in three dimensional space, so that the boron-containing compounds are spatially oriented to engage hexoses containing vicinal diols, such that the boron groups can appropriately engage the hydroxyls in the vicinal diol molecule and provide enhancement of selectivity. In some embodiments, the aromatic boron-containing compounds are modified with specific functional- groups on the aromatic ring that, together with an appropriate or suitable scaffold, may provide higher selectivity and/or affinity for binding towards a vicinal diol of interest and away from other diols in the body.

In some embodiments, the aromatic boron-containing compounds are conjugated to a drug substance (e.g., small-molecule, polypeptide) wherein the aromatic boron-containing compounds provide intramolecular and/or intermolecular interactions with the drug substance and/or with proteins in the body, such as circulating proteins in the blood and/or plasma including albumin and/or globulins. In some embodiments, aromatic boron-containing compounds exhibit reversible binding to glycated proteins in the body, (iii)

(SEQ ID NO: 24018)

$X_{aa'}X_{bb'}X_{cc'}X_{dd'}KX_{ee'}X_{ff'}X_{gg'}X_{hh'}X_{ii'}X_{jj'}KX_{kk'}X_{ll'}X_{mm'}X_{nn'}$QHLCGSHLVEALYLVC $X_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ii}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{cc}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is G, (iv)

(SEQ ID NO: 24019)

$X_{aa'}X_{bb'}X_{cc'}X_{dd'}KX_{ee'}X_{ff'}X_{gg'}X_{hh'}X_{ii'}X_{jj'}KX_{kk'}X_{ll'}X_{mm'}X_{nn'}$QHLCGSHLVEALYLVC $X_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ii}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{cc}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is S, or (v)

(SEQ ID NO: 24020)

$X_{aa'}X_{bb'}X_{cc'}X_{dd'}KX_{ee'}X_{ff'}X_{gg'}X_{hh'}X_{ii'}X_{jj'}KX_{kk'}X_{ll'}X_{mm'}X_{nn'}$QHLCGSHLVEALYLVC $X_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ii}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{cc}$, $X_{ff}$, $X_{gg}$, $X_{hh}$, $X_{ii}$, $X_{jj}$ are present and at least one of $X_{ee}$, $X_{ff}$, $X_{gg}$, $X_{hh}$, $X_{ii}$, $X_{jj}$ is S, and another is G.

BRIEF DESCRIPTION OF THE DRAWINGS

The present disclosure may be better understood, and its numerous features and advantages made apparent to those skilled in the art by referencing the accompanying drawings.

Figure 1:
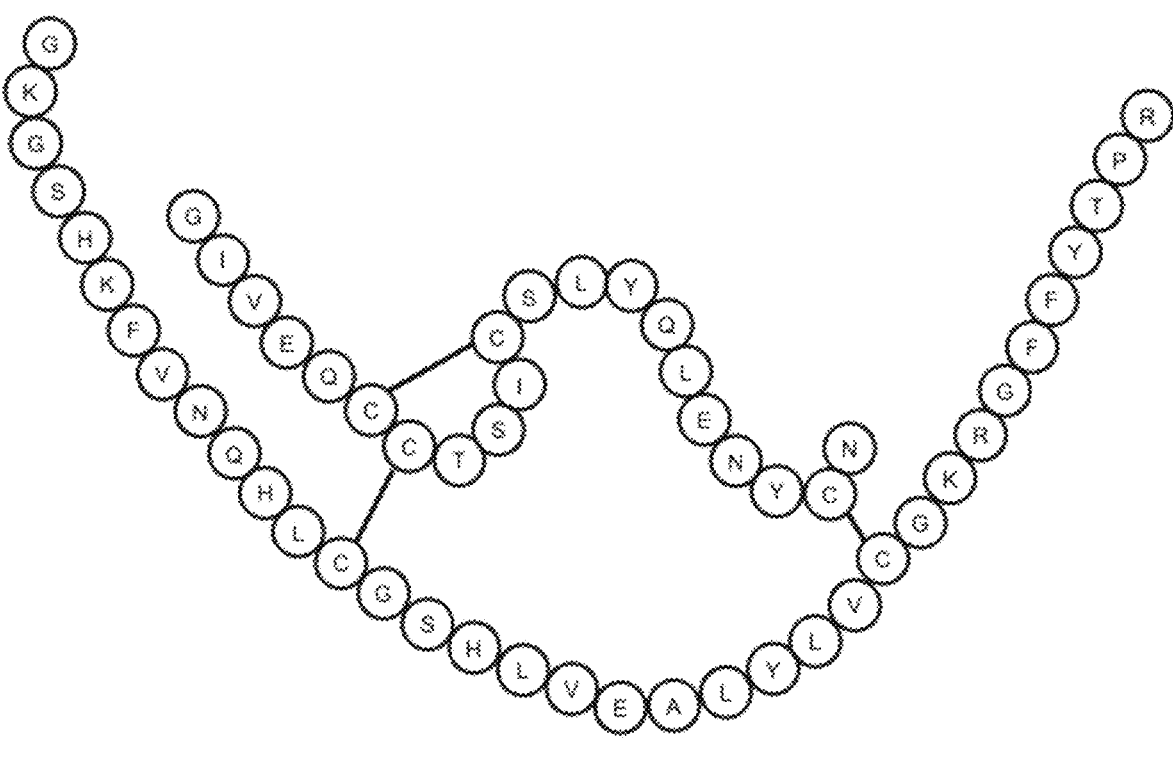
FIG. 1 includes an insulin comprising an A-chain according to SEQ ID NO: 1 and B-chain according to DEQ ID NO: 25228.

such as glycated albumin, and this binding is reversibly influenced by the levels of blood sugar or plasma sugar molecules. In some embodiments, the selective binding of the sensors to specific vicinal diols changes the extent of those intramolecular and/or intermolecular bindings and thereby modulates the pharmacokinetics and overall activity of the drug substance in the body; this effect can be controlled by the level of the vicinal diols present.

In some embodiments, the drug substance is a peptide hormone. In some embodiments, the peptide hormone is a human peptide hormone such as insulin or an insulin analogue, glucagon, or another incretin hormone. In some embodiments the sensors are selective towards the vicinal diols in glucose, and this selectivity is enhanced while maintaining affinity to glucose and simultaneously reducing affinity to other sugars in the blood. In some embodiments, the scaffolds as well as (e.g., in combination with) the pendant groups on the aromatic core of the boron-containing compounds enable controlling the overall activity and/or pharmacokinetics of the conjugated drug substances based on levels of glucose and/or other vicinal diols in the blood.

In some embodiments, the aromatic boron-containing compounds comprise specific scaffold molecules (e.g., FF structures, FFL-1 to FFL-68, DSL-1 to DSL-172) with conjugated boron functionalities (e.g., F1-F11), wherein the scaffolds have been used to orient the boron functionalities in three dimensional geometries so that the boron functionalities are oriented near each other and within a distance that helps engage specific hydroxyl orientations of select hexoses such as glucose. In some embodiments, the boron functionalities are selected from F1-F11. In some embodiments, the boron functionalities are selected from F2, F6, and F7. In some embodiments, the boron functionalities are selected from F2 and F7. In some embodiments, the boron functionality/group is F2. In some embodiments, the boron functionality/group is F7.

Without wishing to be bound by theory, it is believed that the aromatic boron-containing compounds (e.g., molecules) disclosed herein enhance selectivity through at least one or more of the following three mechanisms: (1) the FF scaffold facilitates matching the orientation of the hydroxyl and/or alkoxy groups on boron groups in the aromatic boron-containing compounds and the hydroxyls in the vicinal diol molecule which enhances selectivity; (2) further selectivity gain is obtained by identifying specific functional groups attached to, or near, for example, the aromatic core of the boron-containing compound which impact the electronic structure of the aromatic boron-containing compound and thereby favor reversible binding to the vicinal diols at physiological pH; and (3) functional groups attached to the aromatic boron-containing compound (e.g., the sensor scaffold) help to provide steric hindrance to reduce binding to unwanted hexoses while maintaining binding to the sugar of interest such as glucose. In some embodiments, the FF scaffolds provide glucose binding. In some embodiments, the combination of the FF scaffold and the indirect linker and/or direct linker provides affinity to plasma proteins, such as but not limited to glycated proteins, and the combination of the FF scaffold and the indirect linker and/or direct linker (e.g. Z1b) provides a reversible interaction with plasma proteins that is controlled through the binding of sugar molecules to the FF scaffolds under physiological conditions. These effects as combined together (e.g., compounds of Formulae I, III) in the present disclosure provide desired or suitable selectivity of binding towards a vicinal diol-containing molecule of interest and away from other diols in the body.

In some embodiments, the aromatic boron-containing compounds are conjugated to a drug substance wherein the aromatic boron-containing compounds provide intramolecular and/or intermolecular interactions with proteins in the body. Such proteins may include circulating proteins in the blood and/or human plasma such as albumin, glycosylated proteins and/or immunoglobulins, glycated proteins including glycated plasma proteins such as glycated albumin. In some embodiments the selective binding of the sensors to specific vicinal diols in a molecule of interest changes the extent of intramolecular and intermolecular bindings and thereby modulates the pharmacokinetics and overall activity of the drug substance in the body. In some embodiments, the drug substance is a peptide hormone and in certain embodiments thereof the peptide hormone is an incretin hormone such as insulin and the vicinal diol containing molecule is glucose, but the present disclosure is not limited thereto.

Definitions

Unless otherwise defined, all terms (including technical and scientific terms) used herein have the same meaning as commonly understood by one of ordinary skill in the art to which the present disclosure belongs. It will be further understood that terms, such as those defined in commonly used dictionaries, should be interpreted as having a meaning that is consistent with their meaning in the context of the relevant art and/or the present specification, and should not be interpreted in an idealized or overly formal sense, unless expressly so defined herein.

Unless specifically described herein, functional groups, functional moieties, and reactions referred to herein are understood to have meanings consistent with standard descriptions in and/or general principles of organic chemistry, for example, as described in Organic Chemistry, Thomas Sorrell, University Science Books, Sausalito, 1999; Larock, Comprehensive Organic Transformations, VCH Publishers, Inc., New York, 1989; Carruthers, Some Modern Methods of Organic Synthesis, $3^{rd}$ Edition, Cambridge University Press, Cambridge, 1987; Smith and March, March's Advanced Organic Chemistry, $5^{th}$ Edition, John Wiley & Sons, Inc., New York, 2001. Generic functional groups (such as alkyl, aryl, acetyl, etc.) encompass specific examples or species falling within those functional group categories as generally defined in the field of organic chemistry, and those having ordinary skill in the art are capable of identifying specific example embodiments of functional groups.

Unless specifically described herein, chemical terms, functional groups, and general terms used throughout the specification are identified in accordance with the Periodic Table of the Elements, CAS version, Handbook of Chemistry and Physics, $75^{th}$ Ed., inside cover. In certain embodiments, the terms "a," "an," and "the" and similar referents used herein are to be construed to cover both the singular and the plural unless their usage in context indicates otherwise. The term "CAS #" as used herein is also referred to as CASRN or CAS Number, is a unique numerical identifier assigned by Chemical Abstracts Service (CAS) to every chemical substance described in the open scientific literature.

As used herein, nomenclature for compounds including organic compounds, can be given using common names, IUPAC, IUBMB, or CAS recommendations for nomenclature. One of skill in the art can readily ascertain the structure of a compound if given a name, either by systemic reduction of compound structure using naming conventions, or by commercially available software, such as CHEMDRAW™ (Cambridgesoft Corporation, U.S.A.).

The terminology used herein is for the purpose of describing embodiments and is not intended to be limiting of the present disclosure. It will be further understood that the terms "comprises," "comprising," "includes," and "including," when used in this specification, specify the presence of the stated features, integers, acts, operations, elements, and/or components, but do not preclude the presence or addition of one or more other features, integers, acts, operations, elements, components, and/or groups thereof. As used herein, the term "and/or" includes any and all combinations of one or more of the associated listed items. Expressions such as "at least one of," when preceding a list of elements, modify the entire list of elements and do not modify the individual elements of the list.

As used herein, the terms "substantially," "about," and similar terms are used as terms of approximation and not as terms of degree, and are intended to account for the inherent deviations in measured or calculated values that would be recognized by those of ordinary skill in the art. The term "about" used throughout is used to describe and account for small variations. For instance, "about" may mean the numeric value may be modified by ±5%, ±4%, ±3%, ±2%, ±1% ±0.5%, ±0.4%, ±0.3%, ±0.2%, ±0.1% or ±0.05%. Numeric values modified by the term "about" include the specific identified value. For example, "about 5.0" includes 5.0.

Further, the use of "may" when describing embodiments of the present disclosure refers to "one or more embodiments of the present disclosure." As used herein, the terms "use," "using," and "used" may be considered synonymous with the terms "utilize," "utilizing," and "utilized," respectively. Also, the term "exemplary" is intended to refer to an example or illustration.

Also, any numerical range recited herein is intended to include all sub-ranges of the same numerical precision subsumed within the recited range. For example, a range of "1 to 10" is intended to include all subranges between (and including) the recited minimum value of 1 and the recited maximum value of 10, that is, having a minimum value equal to or greater than 1 and a maximum value equal to or less than 10, such as, for example, 2 to 7. Any maximum numerical limitation recited herein is intended to include all lower numerical limitations subsumed therein, and any minimum numerical limitation recited in this specification is intended to include all higher numerical limitations subsumed therein. Accordingly, Applicant reserves the right to amend this specification, including the claims, to expressly recite any sub-range subsumed within the ranges expressly recited herein.

As used herein, "aromatic boron-containing group" refers to a compound having at least one boron atom covalently bonded to an aromatic group and/or a compound having at least one boron atom covalently incorporated within an aromatic group. The term "aromatic" asused herein may include "heterocycle," "heterocyclyl," or "heterocyclic." As used herein the terms "heterocycle," "heterocyclyl," or "heterocyclic" each refer to an unsaturated 3- to 18-membered ring containing one, two, three, or four heteroatoms independently selected from nitrogen, oxygen, phosphorus, and sulfur. In some embodiments, the term "aromatic" may include an "aryl." The term "aryl" as used herein refers to a mono-, bi-, or other multi carbocyclic, aromatic ring system with 5 to 14 ring atoms. The aryl group can optionally be fused to one or more rings selected from aryls, cycloalkyls, heteroaryls, and heterocyclyls. Exemplary aryl groups also include but are not limited to a monocyclic aromatic ring system, wherein the ring comprises 6 carbon atoms.

The term "heteroaryl" as used herein refers to a mono-, bi-, or multi-cyclic, aromatic ring system containing one or more heteroatoms, for example 1-3 heteroatoms, such as nitrogen, oxygen, and sulfur. Heteroaryls can be substituted with one or more substituents. Heteroaryls can also be fused to non-aromatic rings. Exemplary heteroaryl groups include, but are not limited to, a monocyclic aromatic ring, wherein the ring comprises 2-5 carbon atoms and 1-3 heteroatoms. In some embodiments, the aromatic boron-containing group may include but is not limited to aryl- and heteroaryl boronic acids, aryl and heteroaryl boronate esters, and/or boroxoles. Exemplary aromatic boron-containing groups useful according to certain embodiments, include, e.g., those described herein as FF1-FF231, F1-F11, and FFL-1 to FFL-68, and further include, e.g., those as disclosed in patent application PCT/US2021/025261 (filed Mar. 31, 2021) as compounds F1-F9, F12-F43, F500-F520 and PCT/US2021/059802 (filed Nov. 18, 2021) as compounds FF1-FF224 and F1-F10; the disclosures of which are herein expressly incorporated by reference in their entirety.

The term "small-molecule linker" as used herein refers to a chemical group (e.g., scaffold, moiety) comprising a first attachment point toward X1 and a second attachment point toward Z1b, Z1a, or Z1c. In some embodiments, the first attachment point is toward X1 and the second attachment point is toward Z1c. In some embodiments, the first attachment point is toward X1 and the second attachment point is toward Z1a. In some embodiments, the small molecule linker is a moiety/chemical group selected from Formulae IIa-IIai and Formulae IIIa-IIIai. In some embodiments, the small molecule linker is a moiety/chemical group selected from Formulae FL1-FL19, FL5A, FL5B, FL65A, FL65B, FL69, FL69A, FL69B, FL70, FL70A, and FL70B, and an L- or D-amino acid comprising at least one amine group directly conjugated to Z1c, wherein an acid functional group of the amino acid is conjugated toward X1 in Formula I or Formula IB.

The term "indirect linker" as used herein refers to a chemical group (e.g., scaffold, moiety) comprising a first attachment point toward X1 and a second attachment point toward Z1b, Z1a, or Z1c. In some embodiments, the first attachment point is toward X1 and the second attachment point is toward Z1c. In some embodiments, the first attachment point is toward Z1a and the second attachment point is toward Z1c. In some embodiments, the indirect linker is a moiety/chemical group selected from Formulae FL1-FL19, FL5A, FL5B, FL65A, FL65B, FL69, FL69A, FL69B, FL70, FL70A, and FL70B, and an L- or D-amino acid comprising at least one amine group directly conjugated to Z1c, wherein an acid functional group of the amino acid is conjugated toward Z1a or X1, independently, in Formula I or Formula IB.

The term "moiety" as used herein refers to a chemical group (e.g., Z1c) comprising at least one attachment point to another group, such as a scaffold (e.g., X1, Z1b1, Z1b2). For example, a linker moiety is a chemical group having two points of attachment. As an example, in Formula IE Z1b is a linker moiety having a first point of attachment to an amine in X1 and a second point of attachment to a Z1c. In some embodiments, the first attachment point (i.e., covalent conjugation) is toward X1 and the second attachment point (i.e., covalent conjugation) is toward Z1c. In some embodiments, each Z1b is independently a linker moiety. In some embodiments, Z1b is selected from Formulae FL3, FL5, FL5A, FL5B, FL65A, FL65B, FL69, FL69A, FL69B, FL70, FL70A, and FL70B. In some embodiments, at least one Z1c is covalently conjugated via one or more Z1b to an amine in X1, wherein each Z1b is independently selected from Formulae FL(IA), FL(IB), FL3, FL5, FL5A, FL5B, FL65A, FL65B, FL69, FL69A, FL69B, FL70, FL70A, and FL70B.

As used herein, a "diol containing moiety" is a diol containing group comprising at least two hydroxyl groups. In some embodiments, the diol is not a saccharide. In some embodiments, the diol containing moiety may be 3-26 carbons long. In addition, or in the alternative, the molecular weight of the diol containing moiety may be between 90 and 570. Examples of such non-saccharide diol containing moieties may be provided by organic acids (such as gluconic acid, threonic acid, glyceric acid, galactonic acid, and dihydroxycinnamic acid), thiol-containing compounds (such as 1-thioglycerol, and 1, 2, 3-butanetriol-4-mercapto), and amino compounds (such as (±)-3-amino-1,2-propanediol, (±)-3-amino-1,2-propanediol, and glucosamine).

As used herein, a "polyol containing moiety" is an alcohol with more than one hydroxyl group. In some embodiments, the polyol may be, for example, sorbitol (produced from glucose), xylitol (from xylose), erythritol (from erythrose), lactitol (from lactose), maltitol (from maltose), mannitol (from mannose), polyglycitol (from starch hydrolysate), isomalt, glycerol, propylene glycol, polyethylene glycol (PEG), polypropylene glycol, polyoxyethylated polyols (e.g., POG), polyoxyethylated sorbitol, or polyoxyethylated glucose.

As used herein, "near the C-terminus of the B-chain" includes 10 or less amino acids (e.g., 9 amino acids, 8 amino acids, 7 amino acids, 6 amino acids, 5 amino acids) from the C-terminus of the B chain. In some embodiments, an amine to which a diboronate is covalently conjugated is at or near the C-terminus of the B-chain, preferably to an amine of a B29 lysine or a B21 lysine. The numbering used herein (e.g., B29, B21) refers to the wild-type sequence numbering used in chain-B of human insulin where the B-chain has an amino acid sequence FVNQHLCGSHLVEALYL-VCGERGFFYTPKT (SEQ ID NO: 2). For example, $B_{29}$ is K in the wild type sequence and B21 is E in the wild type sequence.

As used herein, "near the N-terminus" of the A-chain or B chain includes 10 or less amino acids (e.g., 9 amino acids, 8 amino acids, 7 amino acids, 6 amino acids, 5 amino acids) from the N-terminus of the A-chain or B chain.

As used herein, "amino acid" includes proteinogenic (or natural) amino acids (amongst those the 20 standard amino acids), as well as non-proteinogenic (or non-natural) amino acids. Proteinogenic amino acids are those which are naturally incorporated into proteins. The standard amino acids are those encoded by the genetic code. Non-proteinogenic amino acids are either not found in proteins, or not produced by standard cellular machinery (e.g., they may have been subject to post-translational modification). In general, amino acid residues (peptide/protein sequences) may be identified by their full name, their one-letter code, and/or their three-letter code. These three ways are fully equivalent. In what follows, each amino acid of the compounds of the disclosure for which the optical isomer is not stated is to be understood to mean the L-isomer (unless otherwise specified). Amino acids, are molecules containing an amino group and a carboxylic acid group, and, optionally, one or more additional groups, often referred to as a side chain.

As used herein, the term "amino acid residue" is an amino acid from which, formally, a hydroxy group has been removed from a carboxy group and/or from which, formally, a hydrogen atom has been removed from an amino group. As is apparent from the below examples, amino acid residues may be identified by their full name, their one-letter code, and/or their three-letter code. These three ways are fully equivalent and interchangeable.

The term "alkyl" as used herein refers to a saturated straight or branched hydrocarbon, such as a straight or branched group of 1-30 carbon atoms, referred to herein as $C_{1-30}$ alkyl. In some embodiments, the alkyl group is a $C_1$-$C_{22}$ alkyl group. In some embodiments, the alkyl group is a $C_1$-$C_{20}$ alkyl group. In some embodiments, the alkyl group is a $C_1$-$C_{18}$ alkyl group. In some embodiments, the alkyl group is a $C_1$-$C_{16}$ alkyl group. In some embodiments, the alkyl group is a $C_1$-$C_{14}$ alkyl group. In some embodiments, the alkyl group is a $C_1$-$C_{12}$ alkyl group. In some embodiments, the alkyl group is a $C_1$-$C_{10}$ alkyl group. In some embodiments, the alkyl group is a $C_1$-$C_8$ alkyl group. In some embodiments, the alkyl group is a $C_1$-$C_6$ alkyl group. In some embodiments, the alkyl group is a $C_1$-$C_4$ alkyl group. Exemplary alkyl groups include, but are not limited to, methyl, ethyl, propyl, isopropyl, 2-methyl-1-propyl, 2-methyl-2-propyl, 2-methyl-1-butyl, 3-methyl-1-butyl, 2-methyl-3-butyl, 2,2-dimethyl-1-propyl, 2-methyl-1-pentyl, 3-methyl-1-pentyl, 4-methyl-1-pentyl, 2-methyl-2-pentyl, 3-methyl-2-pentyl, 4-methyl-2-pentyl, 2,2-dimethyl-1-butyl, 3,3-dimethyl-1-butyl, 2-ethyl-1-butyl, butyl, isobutyl, t-butyl, pentyl, isopentyl, neopentyl, hexyl, heptyl, and octyl. In some embodiments, "alkyl" is a straight-chain hydrocarbon. In some embodiments, "alkyl" is a branched hydrocarbon.

The term "cycloalkyl" as used herein refers to a saturated or unsaturated cyclic, bicyclic, or bridged bicyclic hydrocarbon group of 3-16 carbons, or 3-8 carbons, referred to herein as "($C_3$-$C_8$)cycloalkyl," derived from a cycloalkane. Exemplary cycloalkyl groups include, but are not limited to, cyclohexanes, cyclohexenes, cyclopentanes, and cyclopentenes. Cycloalkyl groups may be substituted with alkoxy, aryloxy, alkyl, alkenyl, alkynyl, amide, amino, aryl, arylalkyl, carbamate, carboxy, cyano, cycloalkyl, ester, ether, formyl, halogen, haloalkyl, heteroaryl, heterocyclyl, hydroxyl, ketone, nitro, phosphate, sulfide, sulfinyl, sulfonyl, sulfonic acid, sulfonamide and thioketone. Cycloalkyl groups can be fused to other cycloalkyl (saturated or partially unsaturated), aryl, or heterocyclyl groups, to form a bicycle, tetracycle, etc. The term "cycloalkyl" also includes bridged and spiro-fused cyclic structures which may or may not contain heteroatoms. In some embodiments, the cycloalkyl group is a ($C_3$-$C_6$)cycloalkyl.

The term "acyl" as used herein refers to R—C(O)— groups such as, but not limited to, (alkyl)-C(O)—, (alkenyl)-C(O)—, (alkynyl)-C(O)—, (aryl)-C(O)—, (cycloalkyl)-C(O)—, (heteroaryl)-C(O)—, and (heterocyclyl)-C(O)—, wherein the group is attached to the parent molecular structure through the carbonyl functionality. In some embodiments, it is a $C_{1-10}$ acyl radical which refers to the total number of chain or ring atoms of the, for example, alkyl, alkenyl, alkynyl, aryl, cycloalkyl, or heteroaryl, portion plus the carbonyl carbon of acyl. For example, a $C_4$-acyl has three other ring or chain atoms plus carbonyl. In some embodiments, it is a $C_1$-$C_{22}$acyl group. In some embodiments, it is a $C_1$-$C_{20}$acyl group. In some embodiments, it is a $C_1$-$C_{18}$acyl group. In some embodiments, it is a $C_1$-$C_{16}$acyl group. In some embodiments, it is a $C_1$-$C_{14}$acyl group. In some embodiments, it is a $C_1$-$C_{12}$acyl group. In some embodiments, it is a $C_1$-$C_{10}$acyl group. In some embodiments, it is a $C_1$-$C_8$acyl group.

The term "haloalkyl" as used herein refers to an alkyl group substituted with one or more halogens. Examples of haloalkyl groups include, but are not limited to, trifluorom-ethyl, difluoromethyl, pentafluoroethyl, trichloromethyl, etc. In some embodiments, it is a $C_1$-$C_{22}$ haloalkyl group. In some embodiments, it is a $C_1$-$C_{20}$ haloalkyl group. In some embodiments, it is a $C_1$-$C_{18}$ haloalkyl group. In some embodiments, it is a $C_1$-$C_{16}$ haloalkyl group. In some embodiments, it is a $C_1$-$C_{14}$ haloalkyl group. In some embodiments, it is a $C_1$-$C_{12}$ haloalkyl group. In some embodiments, it is a $C_1$-$C_{10}$ haloalkyl group. In some embodiments, it is a $C_1$-$C_8$ haloalkyl group. In some embodiments, it is a $C_1$-$C_6$ haloalkyl group.

The term "aryl" as used herein refers to a mono-, bi-, or other multi-carbocyclic, aromatic ring system with 5 to 14 ring atoms. The aryl group can optionally be fused to one or more rings selected from aryls, cycloalkyls, heteroaryls, and heterocyclyls. The aryl groups of this present disclosure can be substituted with groups selected from alkoxy, aryloxy, alkyl, alkenyl, alkynyl, amide, amino, aryl, arylalkyl, car-bamate, carboxy, cyano, cycloalkyl, ester, ether, formyl, halogen, haloalkyl, heteroaryl, heterocyclyl, hydroxyl, ketone, nitro, phosphate, sulfide, sulfinyl, sulfonyl, sulfonic acid, sulfonamide, and thioketone. Exemplary aryl groups include, but are not limited to, phenyl, tolyl, anthracenyl, fluorenyl, indenyl, azulenyl, and naphthyl, as well as benzo-fused carbocyclic moieties such as 5,6,7,8-tetrahydronaph-thyl. Exemplary aryl groups also include but are not limited to a monocyclic aromatic ring system, wherein the ring comprises 6 carbon atoms.

As used herein, a "leaving group" is an atom (or a group of atoms) that can be displaced as stable species taking with it the bonding electrons. For example, leaving groups can be anions (e.g. Cl⁻) or neutral molecules (e.g. $H_2O$). In some embodiments, a leaving group is a halogen, a N-hydrox-ysuccinimide (NHS) group, a 2,3,5,6-tetrafluorophenol (TFP) group, a pentafluorophenol (Pfp) group, or a sulfonate ester.

"Isomers" means compounds having the same number and kind of atoms, and hence the same molecular weight, but differing with respect to the arrangement or configuration of the atoms in space.

"Stereoisomer" or "optical isomer" means a stable isomer that has at least one chiral atom or restricted rotation giving rise to perpendicular dissymmetric planes (e.g., certain biphenyls, allenes, and spiro compounds) and can rotate plane-polarized light. Because asymmetric centers and other chemical structure exist in the compounds of the disclosure which may give rise to stereoisomerism, the disclosure contemplates stereoisomers and mixtures thereof. The com-pounds of the disclosure and their salts include asymmetric carbon atoms and may therefore exist as single stereoiso-mers, racemates, and as mixtures of enantiomers and diaste-reomers. In some embodiments, such compounds will be prepared as a racemic mixture. In some embodiments, such compounds can be prepared or isolated as pure stereoiso-mers, e.g., as individual enantiomers or diastereomers, or as stereoisomer-enriched mixtures. As discussed in more detail below, individual stereoisomers of compounds may be pre-pared by synthesis from optically active starting materials containing the desired chiral centers or by preparation of mixtures of enantiomeric products followed by separation or resolution, such as conversion to a mixture of diastereomers followed by separation or recrystallization, chromatographic techniques, use of chiral resolving agents, or direct separa-tion of the enantiomers on chiral chromatographic columns. Starting compounds of particular stereochemistry are either commercially available or are made by the methods described below and resolved by techniques well-known in the art.

As used herein, a "fatty acid" is a carboxylic acid with an aliphatic chain. A saturated fatty acid has a saturated ali-phatic chain whereas an unsaturated fatty acid has an unsaturated aliphatic chain. In some embodiments, the fatty acid is a $C_3$-$C_{26}$ fatty acid. In some embodiments, the fatty acid is a $C_4$-$C_{20}$ fatty acid. In some embodiments, the fatty acid is a saturated fatty acid selected from $CH_3CH_2COOH$, $CH_3(CH_2)_2COOH$, $CH_3(CH_2)_3COOH$, $CH_3(CH_2)_4COOH$, $CH_3(CH_2)_5COOH$, $CH_3(CH_2)_6COOH$, $CH_3(CH_2)_7COOH$, $CH_3(CH_2)_8COOH$, $CH_3(CH_2)_9COOH$, $CH_3(CH_2)_{10}COOH$, $CH_3(CH_2)_{11}COOH$, and $CH_3(CH_2)_{12}COOH$, $CH_3(CH_2)_{13}COOH$, $CH_3(CH_2)_{14}COOH$, $CH_3(CH_2)_{15}COOH$, $CH_3(CH_2)_{16}COOH$, $CH_3(CH_2)_{17}COOH$, and $CH_3(CH_2)_{18}COOH$. In some embodiments, the fatty acid is an unsaturated fatty acid selected from α-linoleic acid, steari-donic acid, eicosapentaenoic acid, cervonic acid, linoleic acid, linolelaidic acid, γ-Linolenic acid, oleic acid, elaidic acid, and gondoic acid.

The term "pharmaceutically acceptable salt(s)" refers to salts of acidic or basic groups that may be present in compounds used in the present compositions.

As used herein, "drug substance" refers to small-molecule compounds and/or polypeptide containing compounds. According to some embodiments, a drug substance suitable for use in the compounds and methods described herein is a therapeutically, prophylactically and/or diagnostically active drug substance.

It will be understood that, although terms such as "first," "second," "third," etc., may be used herein to describe various elements (such as molecules, components, groups, and/or moieties, etc.), those elements should not be limited by these terms. These terms are merely used to distinguish one element from another element. Thus, a first element described below could be termed a second element without departing from the spirit and scope of the present disclosure. It will be understood that when an element or group is referred to as being "connected to," "conjugated with," "linked," or "coupled to" another element or group, the two elements may be directly connected, or one or more inter-vening elements may be present. It will be understood that conjugations and linkages described herein have the option of being direct conjugations or direct linkages, unless expressly excluded or precluded by the context.

As used herein, the terms "directly" or "directly cova-lently conjugated" or "covalently conjugated directly" may be interchangeably used to indicate that a first group is "directly" or "directly covalently conjugated" or "covalently conjugated directly" to a second group, which means the first and second groups are covalently bonded together without additional intervening groups.

As used herein, the terms "indirectly" or "indirectly covalently conjugated" or "covalently conjugated indi-rectly" may be interchangeably used to indicate that a first group is "indirectly" or "indirectly covalently conjugated" or "covalently conjugated indirectly" to a second group, which means the first and second groups are covalently bonded together with at least one additional intervening group (e.g., a small-molecule, a linker moiety, a spacer, a linear sequence of amino acids and/or nonlinear sequence of amino acids).

In some embodiments, one or more groups (e.g., X1a, Z1a, Z1b, Z1c) are covalently conjugated directly or indi-rectly (e.g., via one or more linker(s), such as Z1b, Z1b1, Z1b2) to each other. For example, according to certain embodiments Z1c is covalently conjugated, directly or indirectly (e.g., via one or more Z1b linkers) to an amine in X1 or to OH when X1 is OH. As one example, according to certain embodiments one or more drug substances or polypetides (X1) are covalently conjugated to one or more Z1b. As another example, according to certain embodiments one or more drug substances (X1) are covalently conjugated to one or more amine containing linkers. In some embodiments, X represents a point of covalent attachment either directly to an amine in X1 or to an amine that is covalently conjugated directly or via one or more Z1b to X1. In some embodiments, X represents a point of covalent attachment either directly to an amine in X1 or to an amine that is covalently conjugated directly or indirectly to X1, or to OH when X1 is OH. In some embodiment, each Z1c is independently covalently conjugated, directly or indirectly, to an amine of Z1a, to an amine of Z1b, or to X1. In some embodiments, each Z1c is independently covalently conjugated, directly or via one or more Z1b to an amine of X1. In some embodiments, at least one Z1c is covalently conjugated via one or more Z1b to an amine in X1.

The terms "insulin receptor agonist," "compound having agonist potency" in the context of having potency against an insulin receptor, and "agonist potency" in the context of a compound having agonist potency against an insulin receptor-refer to a compound (e.g., a compound of Formula I or Formula IB, a protein, a fusion proteinas described in, e.g., US 2016/0324932) that binds to and/or activates an insulin receptor.

The term "short-acting insulin receptor agonist" and "short-acting insulin" refer to an insulin receptor agonist having an onset of activity equal to or faster than insulin isophane human and insulin human, sold under the tradename Humulin®. For example, a short-acting of insulin may have an onset of action that occurs within 10 minutes of injection. As another example, a short-acting of insulin may have an onset of action that occurs within 20 minutes of injection. In some embodiments, a short-acting insulin may have a maximum effectiveness (peak) within 1-4 hours post injection. In some embodiments, short-acting insulin can be administered before or during and/or shortly after a meal.

The term "long-acting insulin receptor agonist" and "long-acting insulin" refer to an insulin receptor agonist having an onset of action slower than Humulin®. For example, a long-acting insulin may have an onset of action between 1-2 hours, or longer. In certain embodiments, a long-acting insulin may have a maximum effectiveness (peak) within between 6-20 hours and or have prolonged action. In some embodiments, a long-acting insulin can be administered at a frequency of once daily or, for example, once weekly.

When used herein in connection with an insulin receptor agonist, the term "suitable for meal dosing" refers to a short acting insulin receptor agonist suitable for controlling blood glucose levels during and/or shortly after a meal.

When used herein in connection with an insulin receptor agonist, the term "suitable for once-weekly dosing" refers to an insulin receptor agonist with a pharmacokinetic and pharmacodynamic profile that is sufficiently prolonged to control blood glucose levels throughout the day when administered no more frequently than once weekly. Examples of such molecules include fusion proteins as described in US2016/0324932, including BIF. BIF, also known as insulin efsitora alfa, comprises a dimer of an insulin receptor agonist fused to a human IgG Fc region, wherein the insulin receptor agonist comprises an insulin B-chain analogue fused to an insulin A-chain analogue through the use of a first peptide linker and wherein the C-terminal residue of the insulin A-chain analogue is directly fused to the N-terminal residue of a second peptide linker, and the C-terminal residue of the second peptide linker is directly fused to the N-terminal residue of the human IgG Fc region. BIF is identified by CAS registry number 2131038-11-2, which provides the following chemical names: (1) Insulin [16-glutamic acid, 25-histidine, 27-glycine, 28-glycine, 29-glycine, 30-glycine](human B-chain) fusion protein with peptide (synthetic 7-amino acid linker) fusion protein with insulin [47-threonine, 51-aspartic acid, 58-glycine](human A-chain) fusion protein with peptide (synthetic 20-amino acid linker) fusion protein with immunoglobulin G2 (human Fc fragment), dimer; and (2) *Homo sapiens* Insulin B-chain [Y16>Y(16), F25>H(25), TPKT27-30>GGGG(27-30)](1-30) fusion protein with di glycyl seryltetraglycyl (31-37) Insulin A-chain [I10>T(47), Y14>D(51), N21>G(58)](38-58) fusion protein with tris (tetraglycylglutaminyl)pentaglycyl (59-78) *Homo sapiens* Immunoglobulin heavy constant gamma 2 {del-CH1, hinge-(7-12), CH2, CH3[K$^{107}$>del(300)]}(79-299), dimer (80-80': 83-83')-bisdisulfide, expressed in CHO cells, alfa glycosylated.

As used herein, "glucose sensing insulin" refers to an insulin receptor agonist having an onset of activity and/or level of activity that depends on blood sugar level. Examples of such molecules include compounds of Formula I or Formula IB disclosed herein, such as Examples 1A-82A.

The term "incretin-based therapy" includes any treatment which comprises administration of, or promotes, enables, enhances and/or simulates the effects of, a group of metabolic hormones known as incretins, which group includes, but is not limited to, GLP-1, gastric inhibitory peptide (GIP), and glucagon. Incretin-based therapies which are currently available include GLP-1R agonists.

A "DPP-4 inhibitor" is a compound that blocks the DPP-4 enzyme, which is responsible for the degradation of incretins. Currently available DPP-4 inhibitors include sitagliptin (Januvia®) and linagliptin (Tradjenta®).

A "GLP-1R agonist" and "Glucagon receptor agonist" is defined as a compound comprising the amino acid sequence of native human GLP-1 (SEQ ID NO:25) or human glucagon, as well as a compound that maintains full or partial activity at the GLP-1 receptor that is a GLP-1 analogue, GLP-1 derivative or GLP-1 fusion protein. GLP-1R activity may be measured by methods known in the art, including using in vivo experiments and in vitro assays that measure GLP-1 receptor binding activity or receptor activation, e.g., assays employing pancreatic islet cells or insulinoma cells, as described in EP 619,322 and U.S. Pat. No. 5,120,712, respectively. A GLP-1 analogue is a molecule having a modification including one or more amino acid substitutions, deletions, inversions, or additions when compared with the amino acid sequence of native human GLP-1 (SEQ ID NO:25). A GLP-1 derivative is a molecule having the amino acid sequence of native human GLP-1 (SEQ ID NO:25) or of a GLP-1 analogue, but additionally having at least one chemical modification of one or more of its amino acid side groups, α-carbon atoms, terminal amino group, or terminal carboxylic acid group. A GLP-1 fusion protein is a heterologous protein comprising GLP-1, a GLP-1 analogue or a GLP-1 derivative portion and a second polypeptide. Currently available GLP-1R agonists include exenatide (Byetta® and Bydureon®), liraglutide (Victoza®), albiglutide (Tanzeum®) and dulaglutide (Trulicity®), the structures of which are known in the art. See, e.g., U.S. Pat. No. 5,424, 286 (exenatide); U.S. Pat. No. 6,268,343 (liraglutide); US20140447 I 7 (albiglutide); and U.S. Pat. No. 7,452,966 (dulaglutide).

The term "excipient" means any substance added to the composition other than the fusion protein or any other additional active ingredient(s). Examples of such excipients that may be used in the compositions of the present disclosure include buffering agents, surfactants, isotonicity agents and preservatives. A "pharmaceutically acceptable excipient" refers to an excipient that is compatible with the other ingredients in the composition and that is suitable for contact with any tissue, organ, or portion of the body that it may encounter, meaning that it must not carry a risk of toxicity, irritation, allergic response, immunogenicity, or any other complication that excessively outweighs its therapeutic benefits. In some embodiments the excipients may be used to stabilize the agonist while in solution or to increase the onset and maximum effectiveness. Such excipients may include mannitol, sorbitol, m-cresol, EDTA, and citrate.

A "buffering agent" is a substance which resists changes in pH by the action of its acid-base conjugate components. In certain embodiments, the composition of the present disclosure has a pH from about 5.5 to about 9.0, preferably, between about 7.0 and about 8.0, more preferably between about 7.2 and 7.8. Buffering agents suitable for controlling the pH of the compositions of the present disclosure in the desired range include, but are not limited to agents such as phosphate, acetate, citrate, or acids thereof, arginine, TRIS, HEPES, and histidine buffers, as well as combinations thereof. "TRIS" refers to 2-amino-2-hydroxymethyl-1,3,-propanediol, and to any pharmacologically acceptable salt thereof. The free base and the hydrochloride form (i.e., TRIS-HCl) are two common forms of TRIS. TRIS is also known in the art as trimethylol aminomethane, tromethamine, and tris(hydroxymethyl) aminomethane. Preferred buffering agents in the composition of the present disclosure are citrate, or citric acid, phosphate, and TRIS.

The compounds disclosed herein may comprise one or more protein components (e.g., where X1 comprises one or more protein components). In some embodiments, the compounds disclosed herein comprise two or more fused protein components or two or more conjugated protein components. The term "fusion protein" as used herein refers to the combination of two or more distinct proteins that are linked together directly via a peptide bond between the C-terminus of one protein and the N-terminus of another protein or indirectly via a linker (i.e., through chemical linkers such as biofunctionalized PEG linkers) or through a continuous amino acid chain) joining the C-terminus or the N-terminus or a side chain of one protein and the C-terminus or the N-terminus or a side chain of another protein. The term "conjugate protein" as used herein refers to the combination of two or more distinct proteins that are linked together chemically either directly via a chemical bond or indirectly via a chemical linker. In some instances, the two or more proteins may act on the same or similar receptors (i.e., a fusion of two insulin agonist peptides) or may act upon separate and distinct receptors (i.e., one protein is an insulin receptor agonist, and another protein is a glucagon receptor agonist). In some instances, the fusion protein may contain only one agonist protein while the other protein is a human IgG Fc region or a single domain antibody (nanobody) or a variable-heavy chain sequence ($V_HH$).

The phrase "composition comprising a fusion protein" encompasses compositions comprising a monomer, homodimer, heterodimer, or multimer of a fusion protein. In certain embodiments, a pharmaceutical composition of the present disclosure is a composition comprising a fusion protein in a concentration of at least 1 mg/mL, at least 2 mg/mL, at least 5 mg/mL, at least 10 mg/mL, at least 20 mg/mL, at least 25 mg/mL, at least 30 mg/mL, at least 35 mg/mL, at least 50 mg/mL, at least 55 mg/mL, at least 50 mg/mL, at least 65 mg/mL, at least 75 mg/mL, at least 100 mg/mL or greater. In some embodiments, the fusion protein is present in a concentration of 10-100 mg/mL. In some embodiments, the fusion protein is present in a concentration of 15-75 mg/mL, and in some embodiments, the fusion protein is present in a concentration of 20-65 mg/mL.

The pharmaceutical compositions of the present disclosure may also contain a "surfactant," meaning a substance that lowers the surface tension of a liquid. Examples of surfactants used in pharmaceutical compositions and which may be used in certain compositions of the present disclosure include polysorbate 20, polysorbate 80, polyethylene glycols (e.g., PEG 400, PEG 3000, TRITON X-100), polyethylene glycol alkyl ethers (e.g., BRIJ), polypropylene glycols, block copolymers (e.g., poloxamer, PLURONIC F68; poloxamer 407, PLURONIC F127; TETRONICS), sorbitan alkyl esters (e.g., SPAN), polyethoxylated castor oil (e.g., KOLLIPHOR, CREMOPHOR), and trehalose.

The pharmaceutical compositions of the present disclosure may also contain a preservative. The term "preservative" refers to a compound added to a pharmaceutical formulation to act as an anti-microbial agent. Among preservatives known in the art as being effective and acceptable in parenteral formulations are benzalkonium chloride, benzethonium, chlorohexidine, phenol, m-cresol, benzyl alcohol, methyl- or propyl-paraben, chlorobutanol, o-cresol, p-cresol, chlorocresol, phenylmercuric nitrate, thimerosal, benzoic acid, and various mixtures thereof. Phenolic preservative includes the compounds phenol, m-cresol, o-cresol, p-cresol, chlorocresol, methylparaben, benzyl alcohol, and mixtures thereof. If a preservative is necessary, the preservative used in compositions of the present disclosure is preferably a phenolic preservative, preferably either m-cresol, phenol, and/or benzyl alcohol. Certain phenolic preservatives, such as phenol and m-cresol, are known to bind to insulin and insulin hexamers and thereby stabilize a conformational change that increases either physical or chemical stability, or both. In compositions comprising other proteins, however, such preservatives may contribute to the formation of protein aggregates, or high molecular weight polymers (HMWP). See, e.g., Maa Y F and Hsu C C, Int J Pharm 140: 155-168 (1996); Fransson J, et al., Pharm. Res., 14: 606-612 (1997); Lam X M, et al., Pharm. Res., 14: 725-729 (1997); Remmele R L Jr, et al., Pharm Res 15: 200-208. (1998); Thirumangalathu R, et al., J Pharm Sci 95: 1480-1497 (2006). In some instances, protein aggregates in therapeutic formulations can be undesirable due to their tendency to induce an immune response.

As used herein, the term "lipophilic" means the ability to dissolve in lipids and/or the ability to penetrate, interact with and/or traverse biological membranes, and the term, "lipophilic moiety" or "lipophile" means a moiety which is lipophilic and/or which, when attached to another chemical moiety, increases the lipophilicity of such chemical moiety. Examples of lipophilic moieties include, but are not limited to, alkyls, fatty acids, esters of fatty acids, cholesteryl, adamantyl and the like. In some embodiments, the lipophilic moiety has at least 1, 2, 3, 4, 5, or 6 carbon atoms. In some embodiments, the lipophilic moiety has, between a lower limit of 1, 2, 3, 4, 5, 6, 7, 8, 9, 10, 11, 12, 13, 14, 15, 16, 17, 18, 19, or 20 and an upper limit of 4, 5, 6, 7, 8, 9, 10, 11, 12, 13, 14, 15, 16, 17, 18, 19, 20, 21, 22, 23, 24, 25, 26, 27, 28, 29, or 30 carbon atoms. In some embodiments, the lipophilic moiety has between a lower limit of 2, 3, 4, 5, 6, 7, 8, 9, or 10 and an upper limit of 4, 5, 6, 7, 8, 9, 10, 11, 12, 13, 14, 15, 16, 17, 18, 19, 20, 21, or 22 carbon atoms. In some embodiments, the lipophilic moiety has between a lower limit of 3, 4, 5, 6, 7, 8, or 9 and an upper limit of 4, 5, 6, 7, 8, 9, 10, 11, 12, 13, or 14 carbon atoms. In some embodiments, the lipophilic moiety has between a lower limit of 3, 4, 5, 6, or 7 and an upper limit of 6, 7, 8, 9, or 10 carbon atoms. In some embodiments, the lipophilic moiety is selected from the group consisting of saturated or unsaturated, linear or branched alkyl moieties, saturated or unsaturated, linear or branched fatty acid moieties, cholesterol, and adamantane. Exemplary alkyl moieties include, but are not limited to, saturated, linear alkyl moieties such as methyl, ethyl, propyl, butyl, pentyl, hexyl, heptyl, octyl, nonyl, decyl, undecyl, dodecyl, tridecyl, tetradecyl, pentadecyl, hexadecyl, octadecyl, nonadecyl and eicosyl; saturated, branched alkyl moieties such as isopropyl, sec-butyl, tert-butyl, 2-methylbutyl, tert-pentyl, 2-methyl-pentyl, 3-methylpentyl, 2-ethylhexyl, 2-propylpentyl; and unsaturated alkyl moieties derived from the above saturated alkyl moieties including, but not limited to, vinyl, allyl, 1-butenyl, 2-butenyl, ethynyl, 1-propynyl, and 2-propynyl. Exemplary fatty acid moieties include, but are not limited to, unsaturated fatty acid moieties such as lauroleate, myristoleate, palmitoleate, oleate, elaidate, erucate, linoleate, linolenate, arachidonate, eicosapentaentoate, and docosahexaenoate; and saturated fatty acid moieties such as acetate, caproate, caprylate, caprate, laurate, myristate, palmitate, stearate, arachidate, behenate, lignocerate, and cerotate.

As used herein, "combination therapy" or administration "in combination with" one or more further therapeutic agents involves administration of two or more active agents (e.g., two or more pharmacological agents) intended to treat a predetermined indication and/or conditions associated therewith. The administration can be simultaneous (concurrent) or consecutive (sequential) in any order. The two or more agents of the "combination therapy" may be formulated as separate compositions (e.g., formulations) or may be formulated as a single composition (formulation). "Combination therapy" encompasses administration of agents having different mechanisms of action or targeting different indications and/or conditions as well as agents having similar mechanisms of actions or targeting similar indications and/or conditions. For example, because Type 1 diabetes patients produce little or no insulin, effective insulin therapy for Type 1 diabetics can involve the use of two types of exogenously administered insulin: a rapid-acting, mealtime insulin provided by bolus injections, and a long-acting, basal insulin, administered once or twice daily to control blood glucose levels between meals. Treatment of patients With Type 2 diabetes typically begins with prescribed weight loss, exercise, and a diabetic diet; but when these measures fail to control elevated blood sugars, then oral medications and incretin-based therapy, such as administration of glucagon-like peptide-1 (GLP-1) receptor agonists and/or dipeptidyl peptidase 4 (DPP-4) inhibitors that enable increased incretin levels, may be necessary. When these medications are still insufficient, treatment with insulin may be considered. Type 2 diabetes patients whose disease has progressed to the point that insulin therapy is required are may also be started on a single daily injection of a long-acting, basal insulin, although mealtime injections of rapid-acting insulins may be included, as necessary, in some cases. In some embodiments, the present disclosure provides a combination therapy comprising administering a rapid acting insulin and a basal insulin, and/or a fusion protein comprising, for example, one or more diboronate sensors disclosed herein.

The terms "administer," "administering," or "administration" include any method or act of delivery of a pharmacological agent (e.g., a medicament) to an intended subject (e.g., a patient). The pharmacological agent may be any suitable therapeutic agent, such as a biologic agent, such as an antibody or an antigen-binding fragment thereof (e.g., a pharmaceutical composition comprising such an antibody or antigen-binding fragment), a peptide agent (e.g., a hormone or a modified analogue thereof), or a low molecular weight agent (e.g., a structurally-defined small molecule or chemical entity). The administration of a pharmacological agent can be systemic or by local administration. In some embodiments, administration may involve one or more pharmacological agents that can be administered concurrently, simultaneously, or sequentially.

The terms "simultaneous" and "concurrently" are used interchangeably and are used herein to refer to administration of two or more therapeutic agents, where at least part of the administration overlaps in time or where the administration of second therapeutic agent falls within a short period of time, no longer than necessary to start the subsequent administration, after administration of a first therapeutic agent. For example, concurrent administration would include administering a second agent after a first agent without added delay beyond the time necessary to complete the first administration and start the second administration.

The terms "sequentially" and "consecutively" are used interchangeably and are used herein to refer to administration of two or more therapeutic agents where there is a period of delay between administering one therapeutic agent and administering another agent(s). For example, sequential administration would include administration of the two or more therapeutic agents are administered with a time separation of more than about 15 minutes, such as about any of 20, 30, 40, 50, or 60 minutes, 1 day, 2 days, 3 days, 1 week, 2 weeks, 3 weeks, or 1 month, or longer.

As used herein, the terms "basal insulin" and "basal insulins" may refer to several types of basal insulins (e.g., long-acting insulin). For example, insulin glargine, sold under the tradename LANTUS®, comprises a modified insulin structure in which the asparagine at position 21 in the insulin A-chain is replaced with glycine, and two arginines are added to the C-terminus of the B-chain. Another example, insulin glargine-algr, sold under the tradename Rezvoglar™, similarly comprises a modified insulin structure in which the asparagine at position 21 in the insulin A-chain is replaced with glycine, and two arginines are added to the C-terminus of the B-chain. As yet another example, insulin detemir, sold under the tradename LEVEMIR®, comprises a modified insulin structure in which the threonine at position 30 of the B-chain has been deleted and the lysine at position 29 of the B-chain has been derivatized through the covalent linkage of a 14-carbon, myristoyl fatty acid to the E-amine group of lysine at B29. Insulin degludec, available in Europe and Japan under the tradename TRESIBA®, comprises a modified insulin structure in which the threonine at position 30 of the B-chain has been deleted, and the ε-amino group of the lysine at position 29 of the B-chain is covalently derivatized with hexadecandioic acid via a γ-L-glutamic acid linker. All of these insulins are indicated for once-daily administration. In some embodiments, the present disclosure provides the use of one or more compounds (e.g., Formula I or Formula IB, fusion proteins) in the manufacture of a medicament for the treatment of a disease (e.g., diabetes mellitus, obesity, dyslipidemia or metabolic syndrome), wherein the medicament is to be administered simultaneously, separately or sequentially in combination with another active ingredient. The compounds and combinations disclosed herein (e.g., compounds of Formula I or Formula IB, fusion proteins) are effective in treating a disease and/or condition in a subject in need thereof by administering to a patient in need thereof a therapeutically effective amount of a compound and/or composition of the present disclosure.

As used herein, the phrase "therapeutically effective amount" and "prophylactically effective amount" refer to an amount that provides a therapeutic benefit in the treatment, prevention, or management of a disease or an overt symptom of the disease. The therapeutically effective amount may treat a disease or condition, a symptom of disease, or a predisposition toward a disease, with the purpose to cure, heal, alleviate, relieve, alter, remedy, ameliorate, improve, or affect the disease, the symptoms of disease, or the predisposition toward disease. The set or specific amount that is therapeutically effective can be readily determined by an ordinary medical practitioner, and may vary depending on factors known in the art, such as, e.g. the type of disease, the patient's history and age, the stage of disease, and the administration of other therapeutic agents. In some embodiments, the phrase "therapeutically effective amount" refers to that amount of a compound and/or pharmaceutical composition and/or combination of actives disclosed herein that is sufficient to regulate blood glucose in a patient without causing unacceptable side effects. A therapeutically effective amount of the compound and/or pharmaceutical composition and/or combination of actives disclosed herein administered to a subject will depend on the type and severity of the disease and on the characteristics of the subject, such as general health, age, sex, body weight, and tolerance to drugs. The skilled artisan will be able to determine appropriate dosages depending on these and other factors. For example, a therapeutically effective amount of a fusion protein of the present disclosure when administered once weekly ranges from about 0.01 nmol/kg to about 100 nmol/kg. In some embodiments, a therapeutically effective amount of a fusion protein of the present disclosure when administered once weekly ranges from about 1 nmol/kg to about 50 nmol/kg. In some embodiments, a therapeutically effective amount of a fusion protein of the present disclosure when administered once weekly ranges from about 16 nmol/kg to about 25 nmol/kg. In some embodiments, a therapeutically effective amount of a fusion protein of the present disclosure when administered once weekly ranges from about 1 mg to about 200 mg. In some embodiments, a therapeutically effective amount of a fusion protein of the present disclosure when administered once weekly ranges from about 25 mg to about 175 mg. In some embodiments, a therapeutically effective amount of a fusion protein of the disclosure when administered once weekly ranges from about 100 mg to about 160 mg.

The terms "subject" and "patient" are herein used interchangeably and refer to a party receiving a therapy or treatment. In some embodiments, the "subject" and "patient" is a human.

The terms "blood sugar level" and "glycemia" are herein used interchangeably and refer to the concentration of sugar present in the blood. A blood sugar meter or glucometer can be used to measure the amount of sugar in a sample of blood. Blood sugar levels are generally measured as mg of sugar per dL blood (mg/dL). The blood sugar level can refer to the level of any of the sugars disclosed herein. For example, the blood sugar level would include the concentration of glucose in the blood, otherwise known as the blood glucose level/concentration.

As used herein, the term "steady state" refers to a constant/fixed condition with no increases or decreases in a variable of interest or with minimal (i.e., less than 10% or lower) variation. By way of context, in some embodiments, an insulin receptor agonist is infused intravenously (IV) in a fixed dose bolus, and blood glucose levels are maintained at some predetermined "steady state" level (e.g. 100 mg/dL for euglycemic state; 200 mg/dL mg/dL for hyperglycemic) by continuous infusion of glucose at a variable rate (mg/kg/min). The amount of glucose infused to maintain a "steady state" blood sugar level is equal to whole-body glucose uptake and utilization.

The term "hyperglycemia" is used herein to refer to physiologically high blood glucose levels. Hyperglycemic refers to a state of physiologically high blood glucose levels. Blood glucose levels that are considered hyperglycemic will vary based on the species of the subject. For example, in rats, hyperglycemia refers to a blood glucose level $\geq 200$ mg/dL. In humans, hyperglycemia refers to a blood glucose level >180 mg/dL.

The term "euglycemia" is used herein to refer to physiologically normal blood glucose level. Euglycemic refers to a state of normal blood glucose levels. Blood glucose levels that are considered euglycemic will vary based on the species of the subject. For example, in rats, euglycemia refers to a blood glucose level <200 mg/dL. In humans, euglycemia refers to blood glucose levels of between 70-180 mg/dL.

The phrase "glucose infusion rate" is used herein to refer to the rate at which glucose is infused into a subject. The glucose infusion rate (GIR), in units of mg/kg/min, is calculated as follows: (Infusion rate (mL/hr)×Glucose concentration (g/dL)×1000 (mg/g))/Weight (kg)×60 (min/hr)×100 (mL/dL), wherein "infusion rate" refers to the rate at which glucose is infused into the subject, "glucose concentration" refers to the concentration of glucose that is being infused, and "weight" refers to the subject's weight. In some embodiments, the GIR corresponds to the rate of glucose infusion that is required to maintain a specified blood glucose level.

The phrase "relative glucose infusion rate difference" as used herein, refers to the difference in the amount of glucose infused between two different conditions, experiments, or measurements. In some embodiments, it may be measured by taking the difference between (a) the area under the curve (AUC) for one recorded GIR for maintaining a specified blood glucose concentration and (b) the AUC for another recorded GIR for maintaining a different blood glucose concentration. Generally, the AUC for a GIR for maintaining a lower blood glucose concentration is subtracted from the AUC for a GIR for maintaining a higher blood glucose concentration. For example, where the AUC for a first GIR (providing a blood glucose concentration of 100 mg/dL) is 600 mg/kg/min. min and the AUC for a second GIR (providing a blood glucose concentration of 200 mg/dL) is 800 mg/kg/min·min, subtracting the AUC for the first GIR from the AUC for the second GIR provides a relative glucose infusion rate difference of 200 mg/kg/min·min.

As used herein, the phrase "relative glucose infusion rate ratio" refers to a ratio of the amount of glucose infused between two different conditions, experiments, or measurements. In some embodiments, it may be measured by taking the ratio between (a) the area under the curve (AUC) for one recorded GIR for maintaining a blood glucose concentration and (b) the AUC for another recorded GIR for maintaining a different glucose sugar concentration. Generally, the AUC for a GIR for maintaining a higher blood glucose concentration is divided by an AUC for a GIR for maintaining a lower blood glucose concentration. For example, where the AUC for a first GIR (providing a blood glucose concentration of 100 mg/dL) is 600 mg/kg/min·min and the AUC for a second GIR (providing a blood glucose concentration of 200 mg/dL) is 800 mg/kg/min·min, dividing the AUC for the second GIR by the AUC for the first GIR provides a relative glucose infusion rate ratio of 1.33

As used herein, the phrase "area under the curve" refers to the area bounded by a curve, the axis, and two boundary points, whether plotted or mathematically represented. In some embodiments, the curve used to calculate the area under the curve (AUC) is a measure of GIR as a function of time where the X-axis would correspond to time and the Y-axis would correspond the GIR, with the origin is at 0 on the Y-axis (i.e., the X-axis and Y-axis intersect at 0 on the Y-axis). For example, a curve may be a recorded GIR over a period of time, and the boundary points are the GIR at the start and end of the infusion in the experiment. The AUC would then be calculated for the area between the plotted curve and the X-axis, between the starting and ending boundary points. Mathematically, AUC can be calculated according to methods known to those skilled in the art, for example, as in Tai M. M. (1994) Diabetes Care, 17(2):152-154, the contents of which, are hereby incorporated by reference in its entirety. In some embodiments, area under the curve (AUC) is calculated using the trapezoid rule and with baseline correction applied. In some embodiments, the AUC is calculated using GraphPad Prism v9. For the baseline correction, an averaged GIR value from 30 minutes prior to injections (x=−30 min) to the time of injections (x=O) can be subtracted from each GIR value from time 0 (x=0) to time the last timepoint measured (x=300). The trapezoidal calculation is as follows:

$$\int_a^b f(x)dx \approx (b-a)\cdot\frac{1}{2}(f(a)+f(b)).$$

Where a is the first time point (e.g., 0 min) and b is the last time point (e.g., 300 min). The area was calculated as a subdivision of small trapezoids as follows:

$$\int_a^b f(x)dx \approx$$
$$\frac{\Delta x}{2}(f(x_0)+2f(x_1)+2f(x_2)+2f(x_3)+2f(x_4)+\cdots+2f(x_{N-1})+x(f_N)).$$

Such that $\Delta x$ is the difference between each time point (5-minute intervals).

As used herein, the term "EC50" refers to the half maximal effective concentration of a compound in a dose-response assay. The EC50 is a measure of the concentration of a compound that is required to produce half of the maximum possible effect as a result of exposure to the compound. The EC50 can be calculated using known methods in the art. In some embodiments, the EC50 can be calculated using a four-parameter logistic regression curve using the following equation: Y=Bottom+(X^Hillslope)*(Top−Bottom)/(X^HillSlope+EC50^HillSlope), wherein hillslope refers to the slope of the sigmoidal curve between the top and bottom plateaus of the dose-response curve. In some embodiments, the EC50 may be calculated using GraphPad Prism v7, 8, or 9. When a compound has its EC50 measured at two or more concentrations of a sugar (e.g., glucose), (a) the term "a first sugar concentration" refers to the first, lower, concentration of the sugar, for example where the concentration is about 3 mM or about 5.6 mM, and (b) "a second sugar concentration" refers to the second, higher, concentration of the sugar, for example where the concentration is about 10 mM, about 16.7 mM, about 20 mM, or about 30 mM. In some embodiments, for example, the EC50 of dose-response curves were compared to assess fold change in insulin receptor phosphorylation (IR Phosphorylation) activity of the exemplary compounds of Formula I or Formula IB from low (e.g., about 5.6 mM) to high glucose concentration (e.g., about 16.7 mM). This fold activity change was determined by dividing the EC50 of a compound (e.g., a compound of Formula I or Formula IB) at "low" glucose concentration (e.g., about 5.6 mM) by the EC50 of that compound at "high" glucose concentration (e.g., about 16.7 mM), with all other conditions held constant. See Example titled "In Vitro Demonstration of Activity for Compounds of Formula IB."

As used herein, the term "Kd" refers to the dissociation constant, and is reflective of the binding affinity between a ligand (e.g., a diboronate sensor as described herein) and its target (e.g., a sugar, for example, glucose). For example, "glucose Kd" and "average glucose Kd" in the context of diboronate sensors described herein refer to the affinity of the diboronate sensor for glucose where the Kd is measured before the diboronate sensor is conjugated to the insulin molecule to generate the compounds described herein. The binding of a diboronate sensor described herein to glucose may be measured through an Alizarin red S (ARS) displacement assay and is recorded prior to the diboronate sensor being conjugated (e.g., covalently bound) to the insulin molecule (e.g., compounds of Formula I or Formula IB). ARS displacement assays are known in the art, for example, in Springsteen and Wang (2001) Chem. Comm., 1608-1609, the content of which is incorporated by reference herein in its entirety. In the ARS displacement assay, a diboronate sensor as disclosed herein is incubated with ARS and a fluorescence emission is recorded. A composition of the diboronate sensor as described herein and ARS is then titrated against serial dilutions of a sugar (e.g., glucose), and fluorescence emission is then measured after incubation to determine displacement of ARS when the diboronate sensor binds to the sugar. The changes of intensity (fluorescence emission with and without the sugar) can be plotted against concentration of sugar to generate an associate constant for the binding of sugar. When a diboronate sensor has a higher association constant for the sugar, there is an increased Kd. Additionally, diboronate sensors as described herein include those with selective affinity/binding to sugars. For example, a diboronate sensor as described herein can include sensors having increased affinity for (binding to) glucose but not for other sugars, such as lactate and/or fructose. See Example titled "Procedure for determination of the glucose, fructose, and lactate binding (Kd) using ARS displacement assay."

As used herein the terms "clamp," "clamp assay," and "clamped" refer to hyperglycemic/euglycemic clamp (glucose clamp), which has been recognized as the "gold standard" method for detecting insulin activity via glucose utilization in experimental animals and in humans. In a hyperglycemic/euglycemic clamp, the plasma (blood) insulin concentration is acutely raised and, in certain embodiments, maintained by a continuous infusion of insulin while the plasma glucose concentration is held constant at predetermined hyperglycemic or euglycemic levels by a variable glucose infusion rate (GIR). When the steady-state blood glucose level is achieved, the glucose infusion rate equals insulin receptor-stimulated glucose uptake by all the tissues in the body and is therefore a measure of insulin activity at a specific blood glucose level. For example, in some embodiments, glucose is continuously infused to a subject over the course of a study and the glucose infusion rate is adjusted to maintain a constant blood glucose level in response to administration of a compound (e.g., a compound of Formula I or Formula IB). Changes in the sugar infusion rate in response to administration of a compound at a specific dose level or concentration are recorded and used to determine the sugar infusion rate. In some embodiments, the sugar is glucose. See, e.g., Lautt W. W., et al. (1998) Canadian Journal of Physiology and Pharmacology. 76(12): 1080-1086, the content of which is hereby incorporated by reference in its entirety. The clamp technique/assay referred to and used herein is a modified version of the technique known and disclosed in the art. See Example titled "In Vivo Demonstration of Activity for Compounds of Formula IB."

As used herein, terms such as "attachment point toward [group]," "attachment to," and "covalent linkage toward [group]" express that the indicated atom, attachment, or linkage is closer to the indicated group than the other attachment point or covalent linkage variables within the structure formula. In some embodiments, an attachment point or covalent linkage may be directly adjacent to the indicated group, and in some embodiments other atoms or groups may be present therebetween.

As used herein, the term "percentage homology" refers to the percentage of sequence identity between two sequences after optimal alignment. Identical sequences have a percentage homology of 100%. Optimal alignment may be performed by homology alignment algorithms described by the search for similarity method of Pearson and Lipman, *Proc. Natl. Acad. Sci. USA* 85:2444 (1988), by general methods described for search for similarities by Neddleman and Wunsch, *J. Mol. Biol.* 48:443 (1970), including implementation of these algorithms or visual comparison. As used herein, "insulin A-chain" is the chain of insulin that has the highest percentage homology to the A-chain of wild-type human insulin. As used herein, "insulin B-chain" is the chain of insulin that has the highest percentage homology to the B-chain of wild-type human insulin.

In some embodiments, the terms "covalently connected," "covalently conjugated," or "through a covalent conjugation" may be interchangeably used to indicate that two or more atoms, groups, or chemical moieties are bonded or connected via a chemical linkage. In some embodiments, the chemical linkage (which in some embodiments may be referred to as a covalent linkage) may be (e.g., consist of) one or more shared electron pairs (e.g., in a single bond, a double bond, or a triple bond) between two atoms, groups, or chemical moieties." In some embodiments, the chemical (covalent) linkage may further include one or more atoms or functional groups, and may be referred to using the corresponding name of that functional group in the art. For example, a covalent linkage including a —S—S— group may be referred to as a disulfide linkage; a covalent linkage including a —(C=O)— group may be referred to as a carbonyl linkage; a covalent linkage including a —(CF₂)— group may be referred to as a difluoromethylene linkage, etc. The type of linkage or functional group within the covalent bond is not limited unless expressly stated, for example when it is described as including or being selected from certain groups. The types or kinds of suitable covalent linkages will be understood from the description and/or context.

In some embodiments, the insulin receptor agonist may be bound or associated with human serum albumin (HSA) before binding to the insulin receptor. For example, insulin receptor agonists that contain any one of DSL-1 to DSL-172 may associate or bind either through hydrogen bonds, ionic associations, or hydrolysable boron ester bonds to HSA. These interactions may occur along the surface of HSA such as salt bridges to lysine residues, cleavable boron ester bonds formed with serine, threonine, and/or tyrosine hydroxyl groups, and/or to specific locations on HSA such as the Site I or Site II small molecule drug binding sites or one or more of the seven fatty acid binding sites (Yamasaki, K. et. al. (2013) Biochimica et Biophysica Acta 12:5435-5443).

In some embodiments, side chains of amino acids may be covalently connected (e.g., linked or cross-linked) through any number of chemical bonds (e.g., bonding moieties) as generally described in Bioconjugate Techniques (Third edition), edited by Greg T. Hermanson, Academic Press, Boston, 2013. For example, the side chains may be covalently connected through an amide, ester, ether, thioether, isourea, imine, triazole, or any suitable covalent conjugation chemistry available in the art for covalently connecting one peptide, protein, or synthetic polymer to a second peptide, protein, or synthetic polymer. The term polymer includes polypeptide. The term "covalent conjugation chemistry" may refer to one or more functional groups included in the bonding moiety, and/or the chemical reactions used to form the bonding moiety.

The term "vicinal diol" refers to a group of molecules in which two hydroxyl groups occupy vicinal positions, that is, they are attached to adjacent atoms. Such molecules may include, but are not limited to, sugars such as hexoses, glucose, mannose and fructose.

In some embodiments, the term "albumin" means human serum albumin or a protein with at least 60% percentage homology to human serum albumin protein. It is to be understood that in some embodiments the albumin may be further chemically modified for the purposes of conjugation. In some embodiments, modifications may include one or more covalently connected linkers. In some embodiments, the term "albumin" means human serum albumin or a protein with at least 80%, 85%, 90%, 95%, 96%, 97%, 98%, 99%, or 100% percentage homology to human serum albumin protein. In some embodiments, the term "albumin" means human serum albumin or a protein with at least 90% percentage homology to human serum albumin protein. In some embodiments, the term "albumin" means human serum albumin or a protein with at least 95% percentage homology to human serum albumin protein. In some embodiments, the term "albumin" means human serum albumin or a protein with at least 99% percentage homology to human serum albumin protein. In some embodiments, albumin is unmodified human serum albumin.

The term "treatment" is meant to include both the prevention and minimization of the referenced disease, disorder, or condition (i.e., "treatment" refers to both prophylactic and therapeutic administration of a compound of the present disclosure or a composition comprising a compound of the present disclosure unless otherwise indicated or clearly contradicted by context). The route of administration may be any route which effectively transports a compound of this disclosure to the desired or appropriate place in the body, such as parenterally, for example, subcutaneously, intramuscularly, orally, or intravenously. For parenterally adminis-
tration, a compound of the disclosure is formulated analo-
gously with the formulation of known insulins. Furthermore,
for parenteral administration, a compound of this disclosure
is administered analogously with the administration of
known insulins and the physicians are familiar with this
procedure. The amount of a compound of this disclosure to
be administered, the determination of how frequently to
administer a compound of this disclosure, and the election of
which compound or compounds of this disclosure to admin-
ister, optionally together with another antidiabetic com-
pound, is decided in consultation with a practitioner who is
familiar with the treatment of the condition (e.g. diabetes) to
be treated.

In some embodiments, "therapeutic composition" and
"pharmaceutical composition" as used herein means a com-
position that is intended to have a therapeutic effect such as
pharmaceutical compositions, genetic materials, biologics,
and other substances. Pharmaceutical compositions may be
configured to function in the body with therapeutic qualities;
concentration may be altered to reduce the frequency of
replenishment, and the like. In some embodiments, "thera-
peutically effective amount" and "prophylactically effective
amount" refer to an amount that provides a therapeutic
benefit in the treatment, prevention, or management of a
disease or an overt symptom of the disease. The therapeu-
tically effective amount may treat a disease or condition, a
symptom of disease, or a predisposition toward a disease,
with the purpose to cure, heal, alleviate, relieve, alter,
remedy, ameliorate, improve, or affect the disease, the
symptoms of disease, or the predisposition toward disease.
The set or specific amount that is therapeutically effective
can be readily determined by an ordinary medical practitio-
ner, and may vary depending on factors known in the art,
such as, e.g. the type of disease, the patient's history and age,
the stage of disease, and the administration of other thera-
peutic agents. In some embodiments, modified insulins
described herein are delivered to the body by injection or
inhalation, or by other routes, and can reversibly bind to
soluble glucose in a non-depot form. In some embodiments,
modified insulins described herein are released over an
extended period of time from a local depot in the body or
from bound forms to proteins in the serum such as albumin.
In some embodiments, the release of modified insulin is
accelerated at elevated glucose levels, and in some embodi-
ments such release rate may be dependent on blood sugar
levels or levels of other small molecules in the blood
including diol containing molecules. In some embodiments
the release, bioavailability, and/or solubility of modified
insulins described herein is controlled as a function of blood
or serum glucose concentrations or concentrations of other
small molecules in the body.

Additionally, unless otherwise stated, structures described
herein are also meant to include compounds that differ only
in the presence of one or more isotopically enriched atoms.
For example, compounds having the present structures
except for the replacement of hydrogen by deuterium ($^2$H) or
tritium ($^3$H), or the replacement of a carbon by a $^{13}$C- or
$^{14}$C-carbon atom are within the scope of this disclosure.
Such compounds may be useful as, for example, analytical
tools, probes in biological assays, or therapeutic agents.

In some embodiments, functional groups can be cova-
lently conjugated or linked via any suitable covalent con-
jugation chemistry (linker) that can be used to covalently
conjugate one functional group or amino acid side chain to
another functional group, non-limiting examples include an
amide, an ester, an ether, a thioether, an isourea, an imine, and a triazole linker. In some embodiments, functional
groups are covalently conjugated through click chemistry
reactions as defined in the art. These include, for example,
cycloaddition reactions including but not limited to 3+2
cycloadditions, strain-promoted alkyne-nitrone cycloaddi-
tion, reactions of strained alkenes, alkene and tetrazine
inverse-demand Diels-Alder, Copper(I)-Catalyzed Azide-
Alkyne Cycloaddition (CuAAC), thiol-maleimide addition,
Strain-promoted azide-alkyne cycloaddition, Staudinger
ligation, nucleophilic ring-opening reactions, and additions
to carbon-carbon multiple bonds. Some of these reactions
are described for example by H. C. Kolb, M. G. Finn and K.
B. Sharpless (2001); Click Chemistry: Diverse Chemical
Function from a Few Good Reactions, *Angewandte Chemie
International Edition* 40 (11): 2004-2021; Kolb and Sharp-
less, *Drug Discovery Today* 8:1128-1137, 2003; Huisgen, R.
*Angew. Chem. Int. Ed. Engl.* 1963, 2, 565; Agard, N. J.;
Baskin, J. M.; Prescher, J. A.; Lo, A.; Bertozzi, C. R. *ACS
Chem. Biol.* 2006, 1, 644. One skilled in the art will be
capable of selecting suitable buffers, pH and reaction con-
ditions for such click reactions. In some embodiments,
covalent conjugation is the result of a "bioorthogonal reac-
tion" as defined in the art. Such reactions are, for example,
described by Sletten, Ellen M.; Bertozzi, Carolyn R. (2009).
Bioorthogonal Chemistry: Fishing for Selectivity in a Sea of
Functionality, *Angewandte Chemie International Edition* 48
(38): 6974-98.; Prescher, Jennifer A; Bertozzi, Carolyn R
(2005). Chemistry in living systems, *Nature Chemical Biol-
ogy* 1 (1): 13-21.

In some embodiments, functional groups may be linked
using native chemical ligation as described for example by
Dawson, P. E.; Muir, T. W.; Clark-Lewis, I.; Kent, S. B.
(1994) Synthesis of proteins by native chemical ligation,
*Science* 266 (5186): 776-778. As used herein, terms such as
"linkage," "covalent conjugation," etc. may refer to any of
the chemistries described above in some embodiments. The
terms "amine," "amino group," and/or "amine group," when
used to describe part of a covalent bond or connectivity, may
be interchangeably used to indicate an amino group or an
amine group to which the described element is covalently
linked. In some embodiments, the amino group or amine
group may be a primary amine, a secondary amine, or a
fragment such as NH—⊕ to which a conjugation is made
and described.

In some embodiments, the amino group or amine group
may be the $NH_2$ group at the N-terminus of a peptide or
peptide chain, or the $NH_2$ group of a lysine side chain, but
embodiments of the present disclosure are not limited
thereto. In some embodiments, the connectivity of a first
group to a second group is described by reference to an
amine or amino group, originating from the second group,
that is part of a covalent linkage between the first group and
the second group. For example, an amine of a lysine side
chain on X1 may be referred to as an amine, and furthermore
may be described as being conjugated through an amide
bond in order to specify the structure and connectivity of the
functional groups that constitute the covalent bond. If a
covalent linkage is via an amine bond or amine linkage, then
it is referred to as an amine linkage. It is to be understood
that a carbonyl connected to an amine (e.g., a (C=O)—NH
moiety) constitutes an amide bond, and thus by definition, an
amine linkage is not directly connected to a carbonyl group.
Stated another way, the terms "amide bond" and/or "amide
linkage," when used to describe a covalent bond or connec-
tivity, may be interchangeably used to indicate a carbonyl
connected to an amine (e.g., a (C=O)—NH moiety).

In some embodiments, further modifications include attachment of a chemical entity (e.g., moiety or functional group) such as a carbohydrate group, one or more cis-diol containing groups, one or more phosphate groups, one or more catechol groups, a farnesyl group, an isofarnesyl group, a fatty acid group, or a linker for conjugation, functionalization, or other modifications meant to impact the pharmacokinetics, pharmacodynamics, and/or biophysical solution characteristics of insulin.

In some embodiments, a compound includes a human peptide hormone (e.g., as X1). In some embodiments, the peptide hormone is a polypeptide hormone of the human pancreas. In some embodiments, X1 in Formula I is $NH_2$. In some embodiments, a compound, such as a compound of Formula I or Formula IB, includes a human insulin or a human insulin analogue. In some embodiments, two different amine groups in insulin are covalently conjugated to as described by Formula I or Formula IB.

It will be understood that "human peptide hormone," "polypeptide hormone of the human pancreas," "insulin," "human insulin,"-"modified insulin," and "human insulin analogue" may be used interchangeably in some of the described embodiments; that is, for example, in certain embodiments "human insulin analogue" may instead be used in embodiments described as using human insulin. In some embodiments, a compound, such as a compound of Formula I or Formula IB, includes a human insulin or a human insulin analogue. In some embodiments, a compound includes a human insulin or a human insulin analogue as described by Formula I or Formula IB for p'=1 wherein a single amino group in insulin is conjugated to as described by Formula I or Formula IB. In some embodiments, the amino group is the N-terminus of the B-chain of insulin or an amino group of the side chain of a lysine. In some embodiments, two or more different amine groups in insulin are each independently covalently conjugated to as described by Formula I or Formula IB. In some embodiments, at least one amine group is the N-terminus of the B-chain of insulin. In some embodiments, amino groups comprise amino groups of side chains of lysine residues in insulin.

Various suitable modifications of the peptide hormone (e.g., human polypeptide hormone, for example, Insulin), known to those having ordinary skill in the art, are included in the scope of the disclosure. In some embodiments, an optionally extended polypeptide at the N-terminus of B-chain or C-terminus of A-chain of insulin is present and may contain sequences with up to 70%, 80%, 85%, 90%, 95%, 96%, 97%, 98%, 99%, or 100% sequence homology to a human polypeptide sequence. In some embodiments, the polypeptide of Z1a or the optionally extended polypeptide at the N-terminus of B-chain or C-terminus of A-chain of insulin contain sequences with up to 70% sequence homology to a human polypeptide sequence. In some embodiments, the polypeptide of Z1a or the optionally extended polypeptide at the N-terminus of B-chain or C-terminus of A-chain of insulin contain one or more lysine residues that are optionally next to a proline residue, such that the proline is C-terminal to lysine. In some embodiments, the amino group of lysine residues is each independently conjugated as described by Formula I or Formula IB.

In some embodiments, insulin is further modified through conjugation to a sugar, diol containing moiety, and/or polyol containing moiety. In some embodiments, the human polypeptide hormone is a dual or triple hybrid peptide comprising sequences of two or more human peptide hormones and which can act through multiple receptors; for example, a glucose-dependent insulinotropic polypeptide (GIP) and GLP-1 receptor agonist or GLP-1/GIP/glucagon triple agonist. In some embodiments, the human polypeptide hormone is a gut hormone. In some embodiments, the human polypeptide hormone is chosen from c-peptide, adrenocorticotropic hormone (ACTH), amylin, angiotensin, atrial natriuretic peptide (ANP), calcitonin, cholecystokinin (CCK), gastrin, ghrelin, glucagon, growth hormone, follicle-stimulating hormone (FSH), insulin, leptin, melanocyte-stimulating hormone (MSH), oxytocin, parathyroid hormone (PTH), prolactin, renin, somatostatin, thyroid-stimulating hormone (TSH), thyrotropin-releasing hormone (TRH), vasopressin, vasoactive intestinal peptide, a neuropeptide, a peptide hormone that impacts cardiovascular health or appetite, a hybrid of one or more of these peptides, and an analogue of one of these peptides. In some embodiments, compounds comprise a human polypeptide hormone further modified, for example, through the covalent conjugation to polymers, XTEN protein sequences or aliphatic chains. In some embodiments, polymer modified compounds have a longer circulation time in the blood. In some embodiments, polymer modified compounds have a circulation time in the blood such that they are suitable for injection once a day injection, once a week injection, or once a month injection. In some embodiments, polymer modified compounds, such long-acting variants require once a day injection, or one a week injection or once a month injection. In some embodiments, a human polypeptide hormone or the analogue thereof includes one or more L- or D- natural or unnatural amino acids that are each independently one of the twenty canonical amino acids or a non-canonical amino acid.

In some embodiments, the insulin receptor agonist is an insulin analogue comprising an A-chain and a B-chain, wherein optionally the A-chain comprises a sequence selected from SEQ ID NOs 1, 25, 24051, and 24052, and optionally the B-chain comprises a sequence selected from SEQ ID NOs 24060, 24061, 24062, 24063, 24064, and 25000-25397. In some embodiments, an insulin analogue comprises an A-chain comprising a sequence selected from SEQ ID NOs 1, 24051, and 24052, and a B-chain comprising a sequence selected from SEQ ID NOs 24063, 25095, 25228, 25229, 25232, 25236, 25305, 25308, 25312, and 25380-25397. In some embodiments, an insulin analogue comprises a human insulin with an A-chain and a B-chain wherein up to six residues have been mutated, deleted or additionally inserted into each of the A-chain and/or the B-chain. In some embodiments thereof, the insulin analogue includes insulins containing A- and B-chains with a connecting peptide connecting the C-terminus for the B-chain to the N-terminus for the A-chain, and the connecting peptide includes the natural proinsulin C-peptide as well as shorter version of the C-peptide as is known in the art, wherein shorter versions of the C-peptide allow the single chain insulin to retain biological activity and/or potency.

The words analog and analogue are alternative spellings of the same word, are interchangeably used herein and have the same meaning. In the context of a human hormone, an endocrine hormone, insulin, human insulin, glucagon, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, an analogue means any related sequences resulting from the parent sequence that includes up to 8 mutations, deletions or insertions of amino acids and/or additional chemical modifications. In some embodiments, as is known in the art such analogs may enhance biological activity, pharmacokinetics, pharmacodynamics, potency, stability and or chemical, and physical characteristics.

In some embodiments, a human hormone analog includes one or more residues that are 2-aminoisobutyric acid and/or other artificial (i.e., unnatural) amino acids.

In some embodiments, in an insulin analog the C-terminus of the B-chain of insulin is covalently conjugated to the N-terminus of the A-chain. In some embodiments, the C-terminus of the B-chain of insulin is covalently conjugated to the N-terminus of the A-chain and the connecting peptide is a C-peptide. In some embodiments, the C-terminus of the B-chain of insulin is covalently conjugated to the N-terminus of the A-chain and the connecting peptide is a C-peptide and further includes any intermediate compounds that comprise a conjugate of Formula I or Formula IB.

In some embodiments, the insulin analog includes insulin lispro, or a glargine-type of modification, or any suitable modification to human insulin that impacts the pharmacokinetics or half-life of insulin in the body (e.g., blood). In some embodiments, the insulin lispro used to prepare the PEGylated insulin lispro compounds of the present disclosure may be prepared by any of a variety of recognized peptide synthesis techniques including solution-phase methods, solid-phase methods, semi-synthetic methods, and recombinant DNA methods. For example, U.S. Pat. No. 5,700,662 (Chance, et al.) and European Patent No. 214 826 (Brange, et al.), disclose the preparation of various insulin analogs. The A- and B-chains of insulin lispro may also be prepared via a proinsulin-like precursor molecule using recombinant DNA techniques. In some embodiments, a proinsulin-like precursor is used to make the insulin lispro used to make the PEGylated insulin lispro of the present disclosure.

In some embodiments, the insulin portion of the present compounds may be prepared via production of a precursor protein molecule using recombinant DNA techniques. The DNA, including cDNA and synthetic DNA, may be double-stranded or single-stranded. The coding sequences that encode the precursor protein molecule described herein may vary as a result of the redundancy or degeneracy of the genetic code. The DNA may be introduced into a host cell in order to produce the precursor protein of the present disclosure. An appropriate host cell is either transiently or stably transfected or transformed with an expression system for producing the precursor protein. The host cells may be bacterial cells such as K12 or B strains of *Escherichia coli*, fungal cells such as yeast cells, or mammalian cells such as Chinese hamster ovary ("CHO") cells. The expression vectors are typically replicable in the host organisms either as episomes or as an integral part of the host chromosomal DNA. Commonly, expression vectors will contain selection markers, e.g., tetracycline, neomycin, and dihydrofolate reductase, to permit selection of those cells transformed with the desired DNA sequences.

In some embodiments, the polypeptide hormone is glucagon. In some embodiments, glucagon has additional mutations and modifications that are known to impact solubility and solution stability of glucagon. In some embodiments, a compound, such as a compound of Formula I or Formula IB, comprises a conjugation of a diboronate, a diol containing moiety, or a polyol to the N-terminus of the B-chain of insulin through a peptide bond, and at least one additional conjugation described by Formula I or Formula IB to insulin. In some embodiments, a compound comprises a conjugation of a Z1a to the N-terminus of the B-chain of insulin through a peptide bond, and at least one additional conjugation described by Formula I to insulin. In some embodiments, the additional conjugation is to a lysine residue in insulin. In some embodiments, at least one such lysine is a residue between position 15 and the C-terminus of the B-chain of insulin. In some embodiments, the lysine residue is optionally next to a proline, glycine, arginine, threonine or serine. In some embodiments, one or more amino acids in Formula I or Formula IB is a D-amino acid. In some embodiments, any secondary or primary amine in a compound, such as a compound represented by Formula I or Formula IB, is each independently optionally acetylated. In some embodiments, a compound of Formula I or Formula IB has a polypeptide hormone X1 further conjugated to a drug molecule, an imaging agent, a chelator, a contrast agent, a radioactive isotope or a molecule that engages immune cells.

In some embodiments, X1 is a polypeptide hormone comprising a peptide ligand that binds to an extracellular protein receptor. In some embodiments, X1 comprises a polypeptide analogue of a human polypeptide hormone that has at least 50% homology to a natural human polypeptide hormone. In some embodiments, X1 comprises a polypeptide analogue of a human polypeptide hormone that has at least 80%, 85%, 90%, 95%, 96%, 97%, 98%, 99%, or 100% homology to a natural human polypeptide hormone. In some embodiments, X1 comprises a polypeptide analogue of a human polypeptide hormone that has at least 90% homology to a natural human polypeptide hormone. In some embodiments, X1 comprises a polypeptide analogue of a human polypeptide hormone that has at least 95% homology to a natural human polypeptide hormone. In some embodiments, X1 comprises a polypeptide analogue of a human polypeptide hormone that has at least 99% homology to a natural human polypeptide hormone. In some embodiments, X1 is an analogue of human insulin with up to 10 additional residues added to the A-chain or the B-chain of insulin.

In some embodiments, the term "glucose responsiveness" refers to the change in activity in the presence and absence of glucose or in a difference of lower levels and higher levels of glucose (e.g., 5.6 mM glucose vs 16.7 mM glucose, 3 mM glucose vs 20 mM glucose). In some embodiments the activity of a conjugated insulin is assessed by the concentration of insulin (in nanomolar units (nM) of insulin) required to induce the half maximum response (EC50) in a cell-based assay. Lower EC50 concentrations of conjugated insulins have a higher activity than insulins with higher EC50 concentrations (e.g., an insulin with an EC50 of 3 nM is more active than an insulin with an EC50 of 50 nM). A "glucose response" is observed when the insulin changes from a less active EC50 (higher nM) to a more active EC50 (lower nM) in the absence and presence of glucose or in lower and higher levels of glucose, respectively.

In some embodiments, the compound of Formula I or Formula IB comprises one or more L- or D-artificial amino acids which are not one of the twenty naturally occurring amino acids. In some embodiments, the side chains of such artificial amino acids can be covalently conjugated through a number of reactions, including bio-orthogonal reactions such as, for example, described by: Rostovtsev, V. V., Green, L. G., Fokin, V. V. & Sharpless, K. B. A stepwise huisgen cycloaddition process: copper(I)-catalyzed regioselective "ligation" of azides and terminal alkynes. *Angew. Chem. Int. Ed.* 41, 2596-2599 (2002), or by: Liang, Y., Mackey, J. L., Lopez, S. A., Liu, F. & Houk, K. N. Control and design of mutual orthogonality in bioorthogonal cycloadditions. *J. Am. Chem. Soc.* 134, 17904-17907 (2012). In some embodiments, the compound of Formula I or Formula IB may contain one or more L- or D-artificial amino acids that are not one of the twenty naturally occurring amino acids. In some embodiments, Z1a contains one or more L- or D-artificial amino acids that are not one of the twenty naturally occurring amino acids. In some embodiments, the side chains of two amino acids in Formula I or Formula IB may be covalently conjugated together through a triazole bond.

Insulin hormone is an important regulator of blood glucose (sugar) levels. In a normal individual, insulin is present and, when released by the pancreas, it acts to reduce blood sugar levels, for example, by binding to and activating the insulin receptor, triggering glucose absorption by liver, fat, and skeletal muscle cells. Diabetes mellitus (DM), commonly referred to as diabetes, is a group of metabolic diseases characterized by the persistence of high blood sugar levels over a prolonged period.

As used herein, "insulin" encompasses both wild-type and altered forms of insulin capable of binding to and activating the insulin receptor, or capable of causing a measurable reduction in blood glucose when administered in vivo and encompasses both wild-type and altered forms of human insulin capable of binding to and activating the human insulin receptor, or capable of causing a measurable reduction in blood glucose when administered in vivo to a human.

In some embodiments, insulin includes insulin from any species whether in purified, synthetic, or recombinant form and includes human insulin, porcine insulin, bovine insulin, sheep insulin and rabbit insulin. In some embodiments, insulin has two chains: a B- and an A-chain. In some embodiments, the chains are connected together through peptides such as, for example, c-peptide as is known in the art, or a shortened version of the c-peptide, and in other embodiments the insulin may be provided as a proinsulin (insulin precursor) that can be further processed into mature insulin. A variety of altered forms of insulin are known in the art and may be chemically altered such as by addition of a chemical moiety such as a PEG group or a fatty acyl chain. Altered insulins may be mutated including additions, deletions or substitutions of amino acids. In some embodiments the term "desB30" refers to an insulin lacking the B30 amino acid residue.

As used herein, the term "insulin analogue" means a modified human insulin having insulin receptor agonist activity wherein from one to 10 amino acid residues of the insulin have been modified (e.g., substituted, deleted, added (i.e. extended), inserted, and any combination thereof) relative to human insulin. In this context, an insertion or addition of one or more amino acids is considered a single modification. For example, an insulin analogue may have from one to 9 modified amino acid residues. As yet another example, an insulin analogue may have from one to 8 modified amino acid residues. As yet another example, an insulin analogue may have from one to 7 modified amino acid residues. As yet another example, an insulin analogue may have from one to 6 modified amino acid residues. As yet another example, an insulin analogue may have from one to 5 modified amino acid residues. As yet another example, an insulin analogue may have from one to 4 modified amino acid residues. As yet another example, an insulin analogue may have from one to 3 modified amino acid residues. As yet another example, an insulin analogue may have from one to 2 modified amino acid residues. In some embodiments, an insulin analogue may have 2, 3, 4, 5, 6, 7, 8, or 9 modified amino acid residues.

Modifications in the insulin molecule are denoted stating the chain (A or B), the position, and the one or three letter code for the amino acid residue substituting the native amino acid residue. Herein terms like "A1", "A2" and "A3" etc.

indicates the amino acid in position 1, 2 and 3 etc., respectively, in the A chain of insulin (counted from the N-terminal end). Similarly, terms like B1, B2 and B3 etc. indicates the amino acid in position 1, 2 and 3 etc., respectively, in the B chain of insulin (counted from the N-terminal end). Using the one letter codes for amino acids, terms like A21A, A21G and A21Q designates that the amino acid in the A21 position is A, G and Q, respectively. Using the three letter codes for amino acids, the corresponding expressions are A21Ala, A21 Gly, and A21 Gln, respectively.

Thus, for example, an insulin analogue having 4 modifications comprises an A-chain and a B-chain, wherein the A-chain comprises sequence GIVEQCCTSICSLYQLE-NYCN (SEQ ID NO: 1); and wherein the B-chain comprises sequence GKGSHKFVNQHLCGSHLVEALYL-VCGKRGFFYTPR (SEQ ID NO: 25228), where the A chain has the wild-type sequence of chain A of human insulin (e.g. no mutations, deletions, additions) and the B chain has been extended at the N-terminal with GKGSHK (i.e. 6 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e, Thr) in the B chain is deleted (as illustrated in FIG. 1).

Figure 2:
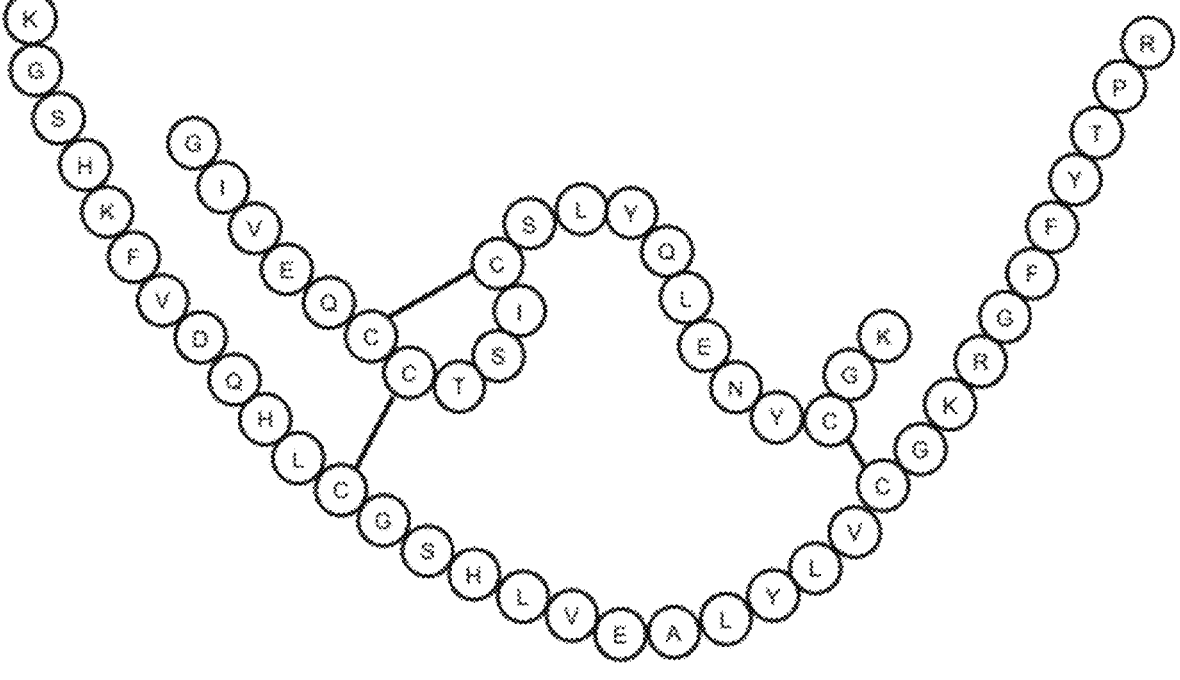
FIG. 2 includes an insulin comprising an A-chain according to SEQ ID NO: 25 and B-chain according to DEQ ID NO: 25393.

As yet another example, an insulin analogue having 7 modifications comprises an A-chain and a B-chain, wherein the A-chain comprises sequence GIVEQCCTSICSLYQLE-NYCGK (SEQ ID NO: 25); and wherein the B-chain comprises sequence KGSHKFVDQHLCGSHLVEALYL-VCGKRGFFYTPR (SEQ ID NO: 25393), where in the A chain the amino acid in position 21 (i.e. N) is substituted with G, and the A chain is extended at the C-terminal with K (i.e. 1 amino acid has been added/appended to the C-terminus), and the B chain has been extended at the N-terminal with KGSHK (i.e. 5 amino acids have been added/appended to the N-terminus), and where the amino acid in position 3 (i.e. N) in the B chain is substituted with D, and where the amino acid in position 21 (i.e. E) in the B chain is substituted with K, and the amino acid in position 29 (i.e. K) in the B chain is substituted with R, and the amino acid in position 30 (i.e. T) in the B chain is deleted (as illustrated in FIG. 2).

Figure 3:
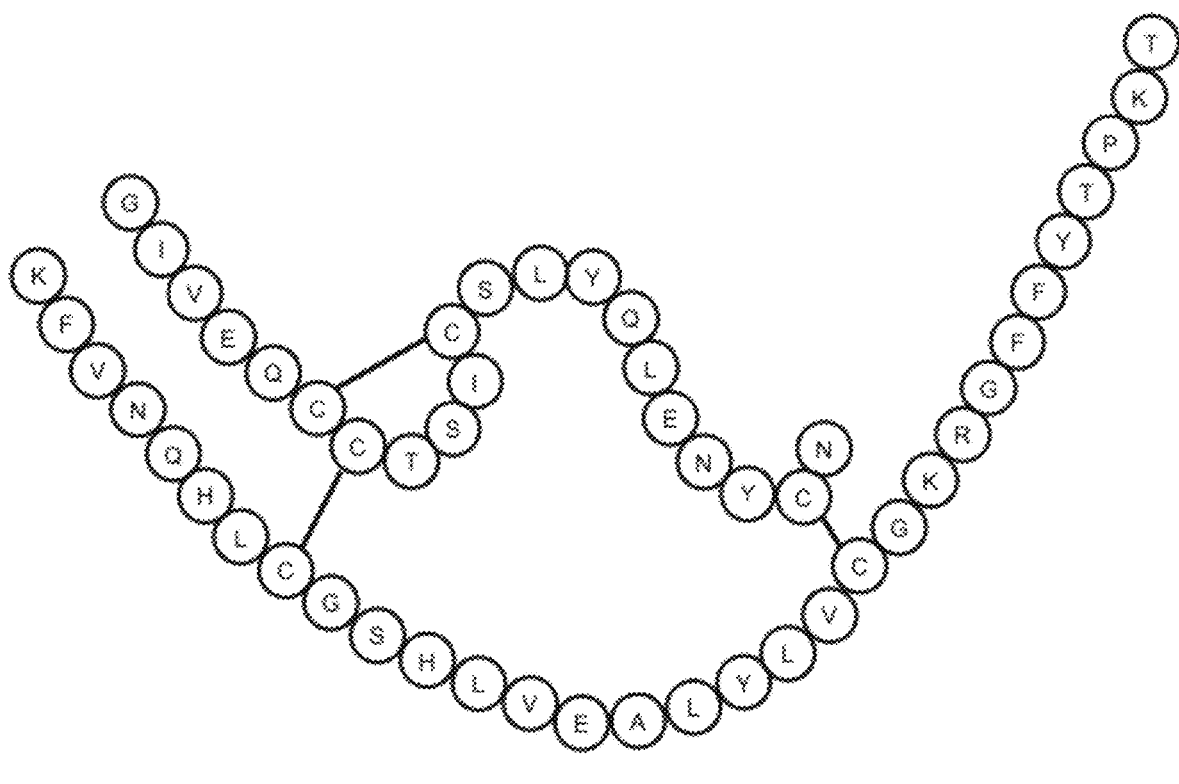
FIG. 3 includes an insulin comprising an A-chain according to SEQ ID NO: 1 and B-chain according to DEQ ID NO: 24060.

As yet another example, an insulin analogue, having 2 modifications comprises an A-chain and a B-chain, wherein the A-chain comprises sequence GIVEQCCTSICSLYQLE-NYCN (SEQ ID NO: 1); and wherein the B-chain comprises sequence KFVNQHLCGSHLVEALYL-VCGKRGFFYTPKT (SEQ ID NO: 24060), where the A chain has the wild-type sequence of chain A of human insulin (e.g. no mutations, deletions, additions) and the B chain has been extended at the N-terminal with K (i.e. 1 amino acid has been added/appended to the N-terminus), and where the amino acid in position 21 (i.e. E) in the B chain is substituted with K (as illustrated in FIG. 3).

Figure 4:
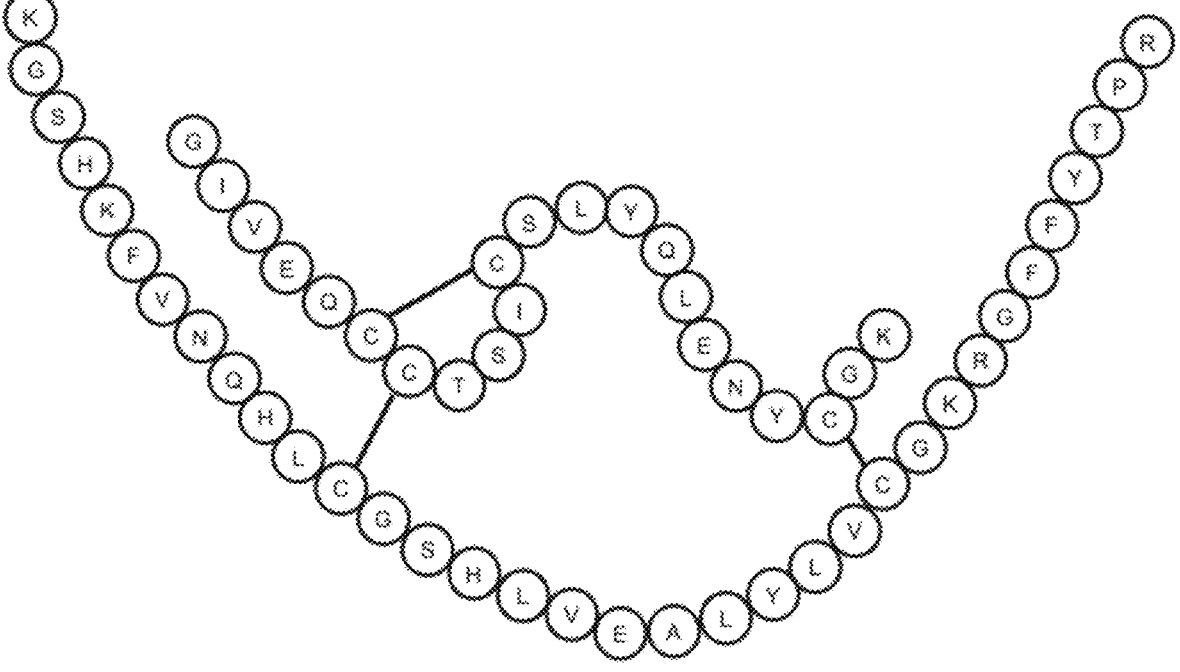
FIG. 4 includes an insulin comprising an A-chain according to SEQ ID NO: 25 and B-chain according to DEQ ID NO: 25313.

As yet another example, an insulin analogue having 6 modifications comprises an A-chain and a B-chain, wherein the A-chain comprises sequence GIVEQCCTSICSLYQLE-NYCGK (SEQ ID NO: 25); and wherein the B-chain comprises sequence KGSHKFVNQHLCGSHLVEALYL-VCGKRGFFYTPR (SEQ ID NO: 25313), where in the A chain the amino acid in position 21 (i.e. N) is substituted with G, and the A chain is extended at the C-terminal with K (i.e. 1 amino acid has been added/appended to the C-terminus), and the B chain has been extended at the N-terminal with KGSHK (i.e. 5 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e. T) in the B chain is deleted (as illustrated in FIG. 4).

Figure 5:
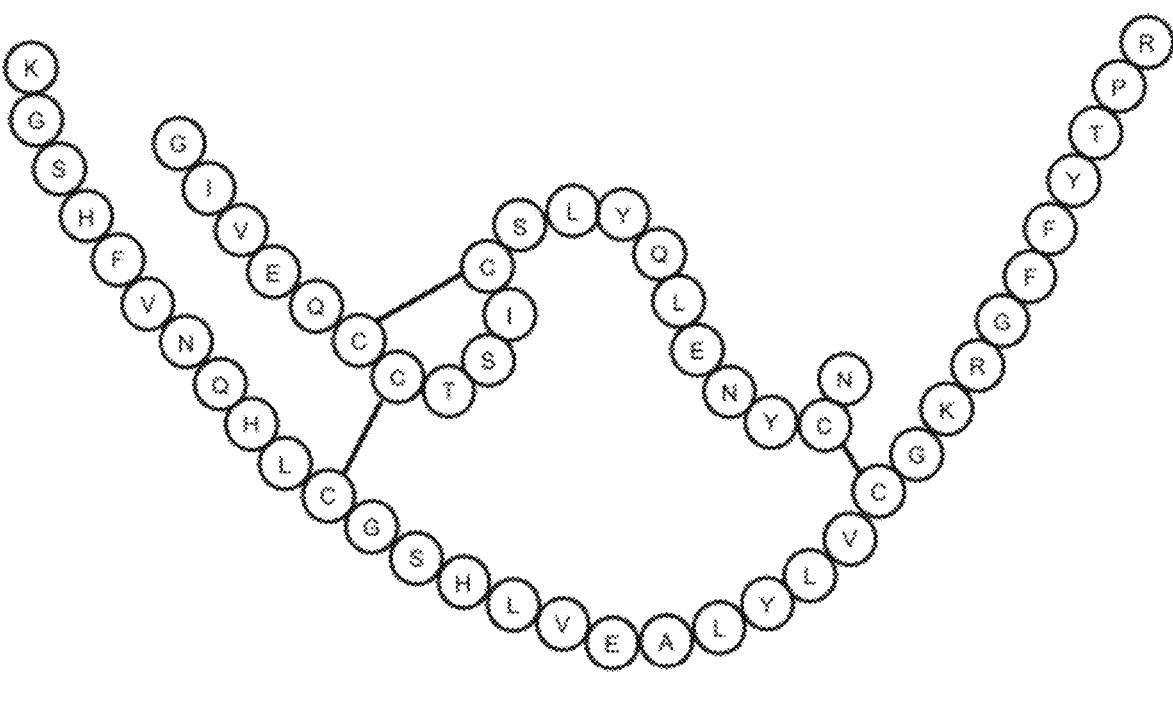
FIG. 5 includes an insulin comprising an A-chain according to SEQ ID NO: 1 and B-chain according to DEQ ID NO: 24061.

As yet another example, an insulin analogue having 4 modifications comprises an A-chain and a B-chain, wherein the A-chain comprises sequence GIVEQCCTSICSLYQLENYCN (SEQ ID NO: 1); and wherein the B-chain comprises sequence KGSHFVNQHLCGSHLVEALYLVCGKRGFFYTPR (SEQ ID NO: 24061); where the A chain has the wild-type sequence of chain A of human insulin (e.g. no mutations, deletions, additions) and the B chain has been extended at the N-terminal with KGSH (i.e. 4 amino acids have been added/appended to the N-terminus), and where the amino acid in position 21 (i.e. E) in the B chain is substituted with K, and the amino acid in position 29 (i.e. K) in the B chain is substituted with R, and the amino acid in position 30 (i.e., Thr) in the B chain is deleted (as illustrated in FIG. 5).

Figure 6:
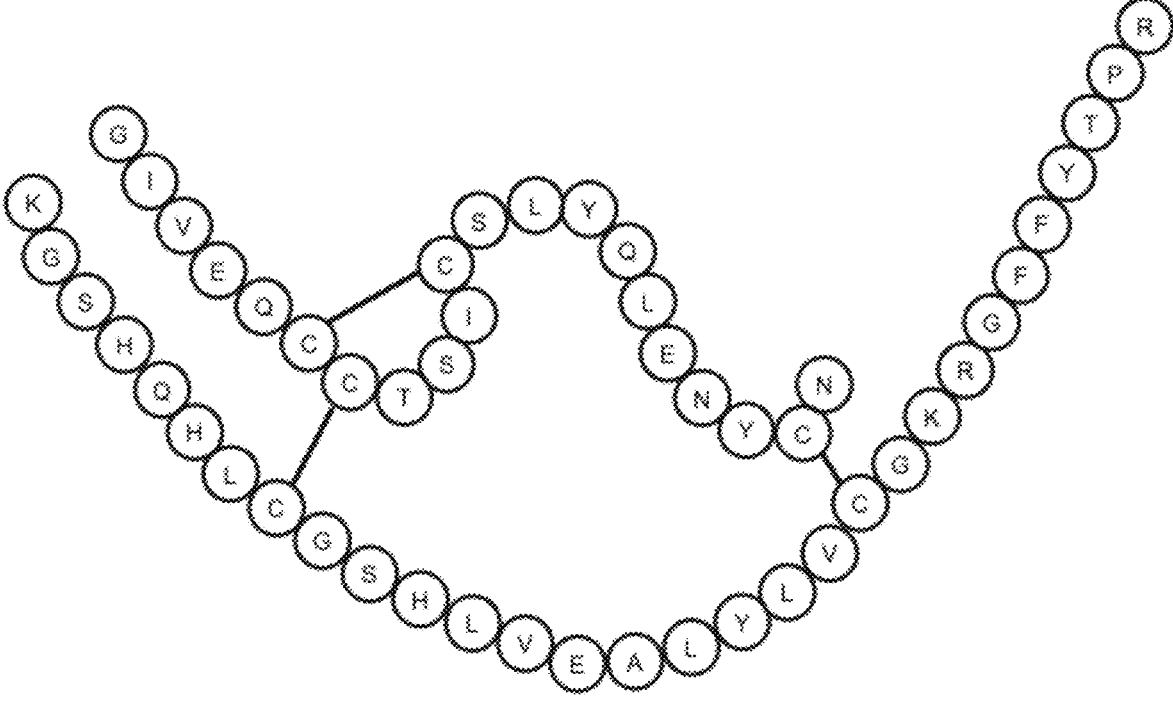

As yet another example, an insulin analogue having 5 modifications comprises an A-chain and a B-chain, wherein the A-chain comprises sequence GIVEQCCTSICSLYQLENYCN (SEQ ID NO:1); and wherein the B-chain comprises sequence KGSHQHLCGSHLVEALYLVCGKRGFFYTPR (SEQ ID NO: 24062); where the A chain has the wild-type sequence of chain A of human insulin (e.g. no mutations, deletions, additions) and the B chain has been extended at the N-terminal with KGSH (i.e. 4 amino acids have been added/appended to the N-terminus), and the first 3 residue (FVN) has been deleted, and where the amino acid in position 21 (i.e. E) in the B chain is substituted with K, and the amino acid in position 29 (i.e. K) in the B chain is substituted with R, and the amino acid in position 30 (i.e., Thr) in the B chain is deleted (as illustrated in FIG. 6).

Figure 7:
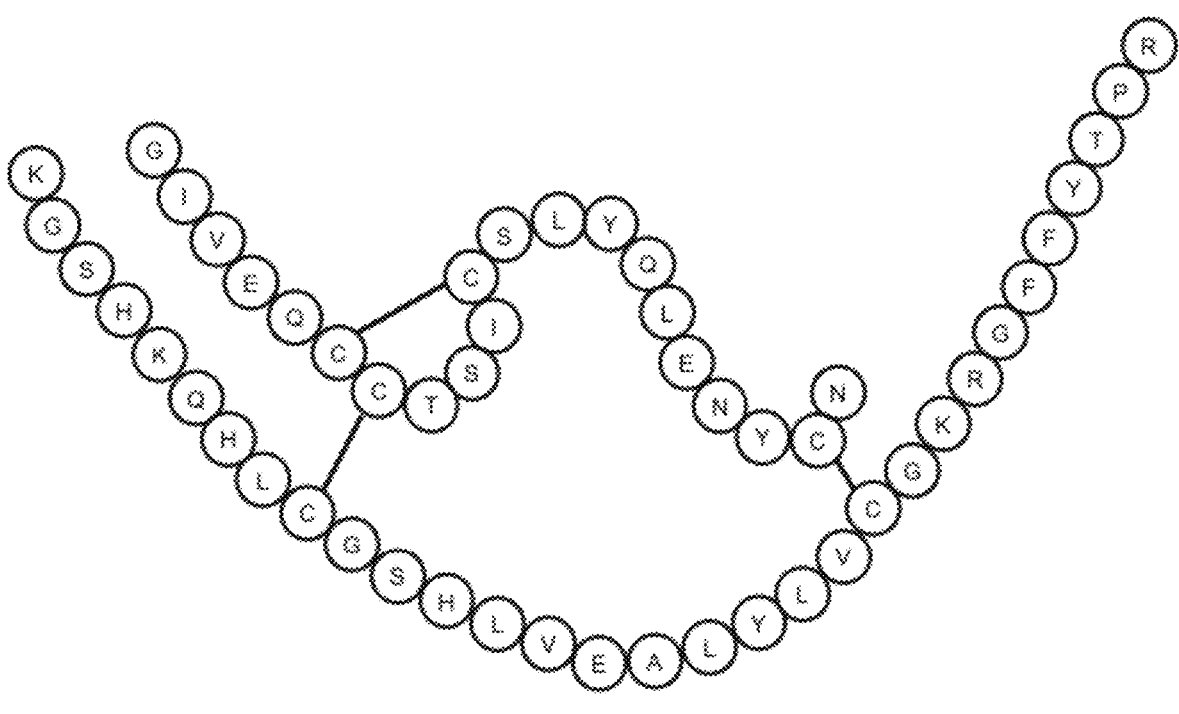

As yet another example, an insulin analogue having 5 modifications comprises an A-chain and a B-chain, wherein the A-chain comprises sequence GIVEQCCTSICSLYQLENYCN (SEQ ID NO:1); and wherein the B-chain comprises sequence KGSHKQHLCGSHLVEALYLVCGKRGFFYTPR (SEQ ID NO: 24063); where the A chain has the wild-type sequence of chain A of human insulin (e.g. no mutations, deletions, additions) and the B chain has been extended at the N-terminal with KGSHK (i.e. 5 amino acids have been added/appended to the N-terminus), and the first 3 residue (FVN) has been deleted, and where the amino acid in position 21 (i.e. E) in the B chain is substituted with K, and the amino acid in position 29 (i.e. K) in the B chain is substituted with R, and the amino acid in position 30 (i.e., Thr) in the B chain is deleted (as illustrated in FIG. 7).

Figure 8:
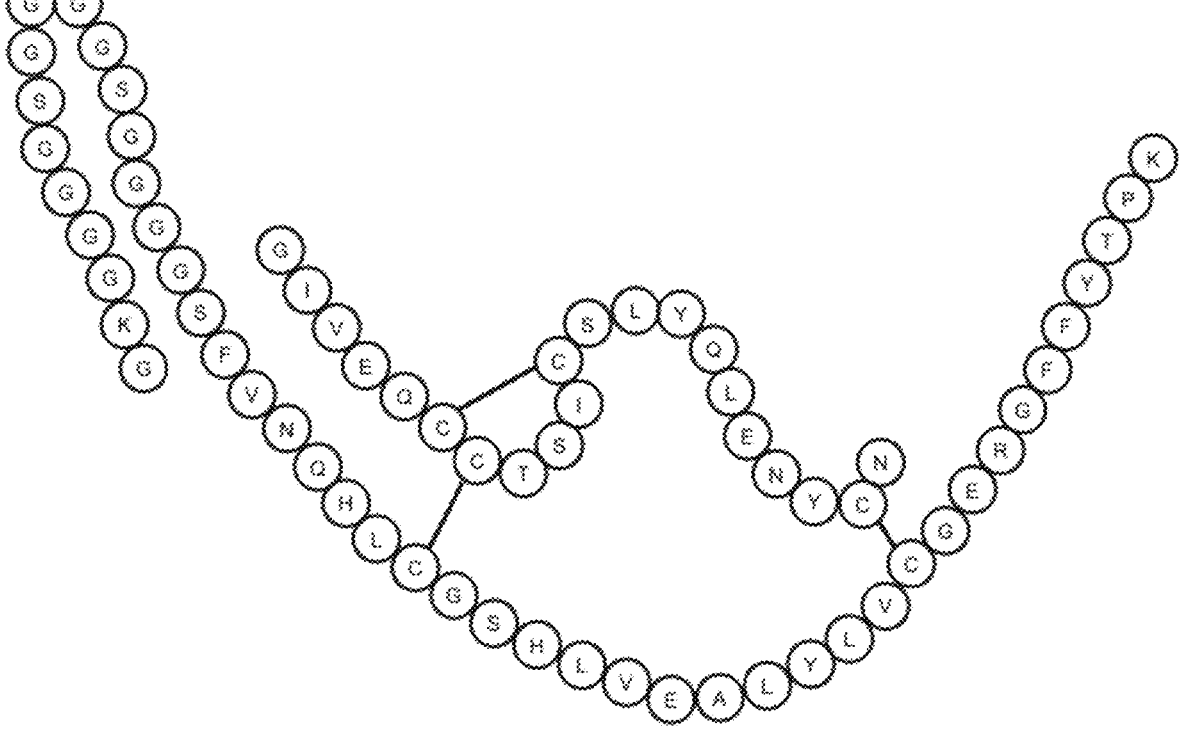

As yet another example, an insulin analogue having 2 modifications comprises an A-chain and a B-chain, wherein the A-chain comprises sequence GIVEQCCTSICSLYQLENYCN (SEQ ID NO: 1); and wherein the B-chain comprises sequence GKGGGGSGGGGSGGGGSFVNQHLCGSHLVEALYLVCGERGFFYTPK (SEQ ID NO: 25397), where the A chain has the wild-type sequence of chain A of human insulin (e.g. no mutations, deletions, additions) and the B chain has been extended at the N-terminal with GKGGGGSGGGGSGGGGS (i.e. 17 amino acids have been added/appended to the N-terminus), and the amino acid in position 30 (i.e. Thr) in the B chain is deleted (as illustrated in FIG. 8).

In some embodiments, insulin analogues include insulin that is chemically altered as compared to wild type human insulin, such as, but not limited to, by addition of a chemical moiety such as a PEG group or a fatty acyl chain. In some embodiments, altered insulins/insulin analogues/analogs, which are used herein interchangeably, may be mutated including additions, deletions or substitutions of amino acids. Different protomers of insulin may result from these changes and be incorporated into some embodiments. In some embodiments, active forms of insulins have fewer than 11 such modifications (e.g., 1-4, 1-3, 1-9, 1-8, 1-7, 1-6, 2-6, 2-5, 2-4, 1-5, 1-2, 2-9, 2-8, 2-7, 2-3, 3-9, 3-8, 3-7, 3-6, 3-5, 3-4, 4-9, 4-8, 4-7, 4-6, 4-5, 5-9, 5-8, 5-7, 5-6, 6-9, 6-8, 6-7, 7-9, 7-8, 8-9, 9, 8, 7, 6, 5, 4, 3, 2 or 1). As used herein, the wild-type sequence of human insulin (A-chain and B-chain), has an A-chain with the amino acid sequence GIVEQCCTSICSLYQLENYCN (SEQ ID NO: 1), and a B-chain having the amino acid sequence FVNQHLCGSHLVEALYLVCGERGFFYTPKT (SEQ ID NO: 2). In some embodiments, an insulin analogue has at least 70% sequence homology to a wild-type human insulin. In some embodiments, an insulin analogue has at least 80% sequence homology to a wild-type human insulin. In some embodiments, an insulin analogue has at least 90% sequence homology to a wild-type human insulin. In some embodiments, an insulin analogue has at least 95%, 96%, 97%, or 95% sequence homology to a wild-type human insulin. In some embodiments, an insulin analogue has at least 99% sequence homology to a wild-type human insulin.

Human insulin differs from rabbit, porcine, bovine, and sheep insulin in amino acids A8, A9, A10, and B30, which are in order the following: Thr, Ser, Ile, Thr for human; Thr, Ser, Ile, Ser for rabbit; Thr, Ser, Ile, Ala for porcine; Ala, Gly, Val, Ala for sheep; and Ala, Ser, Val, Ala for bovine. In some embodiments, a modified insulin may be mutated at position B1, B2, B28 or B29, or at positions B28 and B29 of the B-chain. In some embodiments, a modified insulin may be mutated at A1, A2, A21 or other positions of the A-chain. For example, insulin lispro is a fast-acting modified insulin in which the lysine and proline residues on the C-terminal end of the B-chain have been reversed. Insulin aspart is a fast-acting modified insulin in which proline has been substituted with aspartic acid at position B28. It is contemplated in some embodiments of the present disclosure that insulins mutated at B28 and B29 may further include additional mutations. For example, insulin glulisine is a fast-acting modified insulin in which aspartic acid has been replaced by a lysine residue at position B3, and lysine has been replaced by a glutamic acid residue at position B29. In some embodiments, longer acting and higher stability insulin analogs are covalently modified as described by Formula I or Formula IB, and may contain mutations such as tyrosine at A14 replaced with glutamic acid, the tyrosine at B16 replaced with histidine, and the phenylalanine at B25 replaced with a histidine.

In some embodiments, the isoelectric point of insulins herein may be shifted relative to wild-type human insulin using any suitable method, for example by addition or substitution of suitable amino acids. In some embodiments, the isoelectric point of the modified insulins may be modulated by glucose (e.g., by interaction with glucose). For example, insulin glargine is a basal insulin in which two arginine residues have been added to the C-terminus of the B-peptide, and A21 has been replaced by glycine. In some embodiments, the insulin may not have one or more of the residues B1, B2, B3, B26, B27, B28, B29, and B30 (e.g., the insulin may be a deletion mutant at one or more of the listed residues). In some embodiments, the insulin molecule contains up to five additional amino acid residues on the N- or C-terminus of the A-chain or B-chain. In some embodiments, one or more amino acid residues are located at positions A1, A21, B1, B29, B30 and/or B31 or are missing. In some embodiments, an insulin molecule of the present disclosure is mutated such that one or more amino acids are replaced (substituted) with their acidic forms. In some embodiments, an asparagine is replaced with aspartic acid or glutamic acid. In some embodiments, glutamine is replaced with aspartic acid or glutamic acid. In some embodiments, A21 may be an aspartic acid, B3 may be an aspartic acid, or both positions may contain an aspartic acid. One skilled in the art will recognize that it is possible to make any previously reported, or widely accepted mutations or modifications to insulin that retains biological activity, and that such an insulin analogue can be used in embodiments of the present disclosure. In some embodiments, an insulin may be linked at any position to a fatty acid, or acylated with a fatty acid at any amino group, including those on lysine side chains and the alpha-amino group on the N-terminus of insulin, and the fatty acid may include a C8, C9, C10, C11, C12, C14, C15, C16, C17, or C18 chain. In some embodiments, the fatty acid chain is 8-20 carbons long. In some embodiments, is an insulin detemir, in which a myristic acid is covalently conjugated to lysine at B29, and B30 is deleted or absent. In some embodiments, position B28 of the insulin molecule is lysine and the epsilon(s)-amino group of this lysine is conjugated to a fatty acid.

In some embodiments, the N- or C-terminal end of the A- or B-chain of the modified insulin is ligated using a peptide ligase. In some embodiments, a polypeptide is added to the C-terminus of the insulin A- and/or B-chain or to the N-terminus of insulin A- and/or B-chain using a protein ligase, and in some embodiments thereof the ligase is chosen from sortases, butelases, Trypsiligases, Subtilisins, Peptiligases or enzymes having at least 75% homology to these ligases. In some embodiments, ligation is achieved through expressed protein ligation as described in: Muir T W, Sondhi D, Cole P A. "Expressed protein ligation: a general method for protein engineering." *Proc Natl Acad Sci USA*. 1998; 95(12):6705-6710. In some embodiments, the polypeptide is linked to the modified insulin using Staudinger ligation, utilizing the Staudinger reaction and as described for example in Nilsson, B. L.; Kiessling, L. L.; Raines, R. T. (2000). "Staudinger ligation: A peptide from a thioester and azide". *Org. Lett.* 2 (13): 1939-1941. In some embodiments, a polypeptide is conjugated to the modified insulin using Ser/Thr ligation as, for example, described in: Zhang Y, Xu C, Kam H Y, Lee C L, Li X. 2013, "Protein chemical synthesis by serine/threonine ligation." *Proc. Natl. Acad. Sci. USA*. 17:6657-6662. In some embodiments, the B-chain itself has less than 32 amino acids or 34 amino acids, and in some embodiments the insulin has 4 disulfide bonds instead of 3. There are disulfide bonds present in the A and B chains of insulin. For example, a disulfide bond exists between the cysteine at position 6 of SEQ ID NO:1 and the cysteine at position 11 of SEQ ID NO:1, a disulfide bond exists between the cysteine at position 7 of SEQ ID NO:1 and the cysteine at position 7 of SEQ ID NO:2, and a disulfide bond exists between the cysteine at position 20 of SEQ ID NO:1 and the cysteine at position 19 of SEQ ID NO:2.

In some embodiments, a modified insulin of the present disclosure comprises one or more mutations and/or chemical modifications including, but not limited to one of the following insulin molecules: $N^{\varepsilon B29}$-octanoyl-$Arg^{B0}Gly^{A21}Asp^{B3}Arg^{B31}Arg^{B32}$-HI, $N^{\varepsilon B29}$-octanoyl-$Arg^{B31}Arg^{B32}$-HI, $N^{\varepsilon B29}$-octanoyl-$Arg^{40}Arg^{B31}Arg^{B32}$-HI, $N^{\varepsilon B28}$-myristoyl-$Gly^{A21}Lys^{B28}Pro^{B29}Arg^{B31}Ar^{B32}$-HI, $N^{\theta B28}$-myristoyl-$Gly^{A21}Gln^{B3}LyS^{B28}Pro^{B30}Arg^{B31}Arg^{B32}$-

HI, $N^{\varepsilon B28}$-myristoyl-$Arg^{40}Gly^{A21}Lys^{B28}Pro^{B29}Arg^{B31}Arg^{B32}$-HI, $N^{\geq B28}$-myristoyl-$Arg^{40}Gly^{A21}Gln^{B3}Lys^{B28}Pro^{B29}Arg^{B31}Arg^{B32}$-HI, $N^{\varepsilon B28}$-myristoyl-$Arg^{40}Gly^{A21}Asp^{B3}Lys^{B28}Pro^{B29}Arg^{B31}Arg^{B32}$-HI, $N^{\varepsilon B28}$-myristoyl-$Lys^{B28}Pro^{B29}Arg^{B31}Arg^{B32}$-HI, $N^{\varepsilon B28}$-myristoyl-$Arg^{40}Lys^{B28}Pro^{B29}Arg^{B31}Arg^{B32}$-HI, $N^{\varepsilon B28}$-octanoyl-$Gly^{A21}Lys^{B28}Pro^{B29}Arg^{B31}Arg^{B32}$-HI, $N^{\varepsilon B28}$-octanoyl-$Gly^{A21}Gln^{B3}Lys^{B28}Pro^{B29}Arg^{B31}Arg^{B32}$-HI, $N^{\varepsilon B28}$-octanoyl-$Arg^{40}Gly^{A21}Lys^{B28}Pro^{B29}Arg^{B31}Arg^{B32}$-HI, $N^{\varepsilon B29}$-palmitoyl-HI, $N^{\varepsilon B29}$-myrisotyl-HI, $N^{\varepsilon B28}$-palmitoyl-$Lys^{B28}Pro^{B29}$-HI, $N^{\varepsilon B28}$-myristoyl-$Lys^{B28}Pro^{B29}$-HI, $N^{\varepsilon B29}$-palmitoyl-des(B30)-HI, $NE^{B30}$-myristoyl-$Thr^{B29}Lys^{B30}$-HI, $NE^{B30}$-palmitoyl-$Thr^{B29}Lys^{B30}$-HI, $N^{\varepsilon B29}$—(N-palmitoyl-γ-glutamyl)-des(B30)-HI, $N^{\varepsilon B29}$—(N-lithocolyl-γ-glutamyl)-des(B30)-HI, $N^{\varepsilon B29}$-(ω-carboxyheptadecanoyl)-des(B30)-HI, $N^{\varepsilon B29}$-(ω-carboxyheptadecanoyl)-HI, $N^{\varepsilon B29}$-octanoyl-HI, $N^{\varepsilon B29}$-myristoyl-$Gly^{A21}Arg^{B31}Arg^{B31}$-HI, $N^{\varepsilon B29}$-myristoyl-$Gly^{A21}Gln^{B3}Arg^{B31}Arg^{B32}$-HI, $N^{\varepsilon B29}$-myristoyl-$Arg^{40}Gly^{A21}Arg^{B31}Arg^{B32}$-HI, $N^{\varepsilon B29}$-myristoyl-$Arg^{40}Gly^{A21}Gln^{B3}Arg^{B31}Arg^{B32}$-HI, $N^{\varepsilon B29}$-myristoyl-$Arg^{40}Gly^{A21}Asp^{B3}Arg^{B31}Arg^{B32}$-HI, $N^{\varepsilon B29}$-myristoyl-$Arg^{B31}Arg^{B32}$-HI, $N^{\varepsilon B29}$-myristoyl-$Arg^{40}Arg^{B31}Arg^{B32}$-HI, $N^{\varepsilon B29}$-octanoyl-$Gly^{A21}Arg^{B31}Arg^{B32}$-HI, $N^{\varepsilon B29}$-octanoyl-$Gly^{A21}Gln^{B3}Arg^{B31}Arg^{B32}$-HI, $N^{\varepsilon B29}$-octanoyl-$Arg^{40}Gly^{A21}Arg^{B31}Arg^{B32}$-HI, $N^{\varepsilon B29}$-octanoyl-$Arg^{40}Gly^{A21}Gln^{B3}Arg^{B31}Arg^{B32}$-HI, $N^{\varepsilon B28}$-octanoyl-$Arg^{40}Gly^{A21}Gln^{B3}Lys^{B28}Pro^{B29}Arg^{B31}Arg^{B32}$-HI, $N^{\varepsilon B28}$-octanoyl-$Arg^{40}Gly^{A21}Asp^{B3}Lys^{B28}Pro^{B29}Arg^{B31}Arg^{B32}$-HI, $N^{\varepsilon B28}$-octanoyl-$Lys^{B28}Pro^{B29}Arg^{B31}Arg^{B32}$-HI, $N^{\varepsilon B28}$-octanoyl-$Arg^{40}Lys^{B28}Pro^{B29}Arg^{B31}Arg^{B32}$-HI. $N^{\varepsilon B29}$-pentanoyl-$Gly^{A21}Arg^{B31}Arg^{B32}$-HI, $N^{\alpha B1}$-hexanoyl-$Gly^{A21}Arg^{B31}Arg^{B32}$-HI, $N^{\alpha A1}$-heptanoyl-$Gly^{A21}Arg^{B31}Arg^{B32}$-HI, $N^{\varepsilon B29}$-octanoyl-$N^{\alpha B1}$-octanoyl-$Gly^{A21}Arg^{B31}Arg^{B32}$-HI, $N^{\varepsilon B29}$-propionyl-$N^{\alpha A1}$-propionyl-$Gly^{A21}Arg^{B31}Arg^{B32}$-HI, $N^{\alpha A1}$-acetyl-$N^{\alpha B1}$-acetyl-$Gly^{A21}Arg^{B31}Arg^{B32}$-HI, $N^{\varepsilon B29}$-formyl-$N^{\alpha A1}$-formyl-$N^{\alpha B1}$-formyl-$Gly^{A21}Arg^{B31}Arg^{B32}$-HI, $N^{B29}$-formyl-des(B26)-HI, $N^{\alpha B1}$-acetyl-$Asp^{B28}$-HI, $N^{\varepsilon B29}$-propionyl-$N^{\alpha A1}$-propionyl-$N^{\alpha B1}$-propionyl-$Asp^{B1}Asp^{B3}Asp^{B21}$-HI, $N^{\varepsilon B29}$-pentanoyl-$Gly^{A21}$-HI, $N^{\alpha B1}$-hexanoyl-$Gly^{A21}$-HI, $N^{\alpha A1}$-heptanoyl-$Gly^{A21}$-HI, $N^{\varepsilon B29}$-octanoyl-$N^{\alpha B1}$-octanoyl-$Gly^{A21}$-HI, $N^{\varepsilon B29}$-propionyl-$N^{\alpha A1}$-propionyl-$Gly^{A21}$-HI, $N^{\alpha B1}$-acetyl-$N^{\alpha A1}$-acetyl-$Gly^{A21}$-HI, $N^{\varepsilon B29}$-formyl-$N^{\alpha A1}$-formyl-$N^{\alpha B1}$-formyl-$Gly^{A21}$-HI, $N^{B29}$-butyryl-des(B30)-HI, $N^{\alpha B31}$-butyryl-des(B30)-HI, $N^{\alpha A1}$-butyryl-des(B30)-HI, $N^{\varepsilon B29}$-butyryl-$N^{\alpha B3}$-butyryl-des(B30)-HI, $N^{\varepsilon B29}$-butyryl-$N^{\alpha A1}$-butyryl-des(B30)-HI, $N^{\alpha A1}$-butyryl-$N^{\alpha B31}$-butyryl-des(B30)-HI, $N^{\varepsilon B29}$-butyryl-$N^{\alpha A1}$-butyryl-$N^{\alpha B3}$-butyryl-des(B30)-HI, $Lys^{B28}Pro^{B29}$-HI (insulin lispro), $Asp^{B28}$-HI (insulin aspart), $Lys^{B3}Glu^{B29}$-HI (insulin glulisine), $Arg^{B31}Arg^{B32}$-HI (insulin glargine), $N^{\varepsilon B29}$-myristoyl-des(B30)-HI (insulin detemir), $Ala^{B26}$-HI, $Asp^{B1}$-HI, $Arg^{40}$-HI, $Asp^{B1}Glu^{B13}$-HI, $Gly^{A21}$-HI, $Gly^{A21}Arg^{B31}Arg^{B32}$-HI, $Arg^{40}Arg^{B3}$ $Ar^{B32}$-HI, $Arg^{40}Gly^{A21}$ $Arg^{B31}Arg^{B32}$-HI, des(B30)-HI, des(B27)-HI, des(B28-B30)-HI, des(B1)-HI, des(B1-B3)-HI $N^{\varepsilon B29}$-tridecanoyl-des(B30)-HI, $N^{\varepsilon B29}$-tetradecanoyl-des(B30)-HI, $N^{\varepsilon B29}$-decanoyl-des(B30)-HI, $N^{\varepsilon B29}$-dodecanoyl-des(B30)-HI, $N^{\varepsilon B29}$-tridecanoyl-$Gly^{A21}$-des(B30)-HI, $N^{\varepsilon B29}$-tetradecanoyl-$Gly^{A21}$-des(B30)-HI, $N^{\varepsilon B29}$-decanoyl-$Gly^{A21}$-des(B30)-HI, $N^{\varepsilon B29}$-dodecanoyl-$Gly^{A21}$-des(B30)-HI, $N^{\varepsilon B29}$-tridecanoyl-$Gly^{A21}Gln^{B3}$-des(B30)-HI, $N^{\varepsilon B29}$-tetradecanoyl-$Gly^{A21}Gln^{B3}$-des(B30)-HI, $N^{\varepsilon B29}$-decanoyl-$Gly^{A21}Gln^{B3}$-des(B30)-HI, $N^{\varepsilon B29}$-dodecanoyl-$Gly^{A21}Gln^{B3}$-des(B30)-HI, $N^{\varepsilon B29}$-tridecanoyl-$Ala^{A21}$-des(B30)-HI, $N^{\varepsilon B29}$-tetradecanoyl-$Ala^{A21}$-des(B30)-HI, $N^{\varepsilon B29}$-decanoyl-$Ala^{A21}$-des(B30)-HI, $N^{\varepsilon B29}$-dodecanoyl-$Ala^{A21}$- des(B30)-HI, $N^{\varepsilon B29}$-tridecanoyl-Ala$^{A21}$-Gln$^{B3}$-des(B30)-HI, $N^{\varepsilon B29}$-tetradecanoyl-Ala$^{A21}$Gln$^{B3}$-des(B30)-HI, $N^{\varepsilon B29}$-decanoyl-Ala$^{A21}$Gln$^{B3}$-des(B30)-HI, $N^{\varepsilon B29}$-dodecanoyl-Ala$^{A21}$Gln$^{B3}$-des(B30)-HI, $N^{\varepsilon B29}$-tridecanoyl-Gln$^{B3}$-des(B30)-HI, $N^{\varepsilon B29}$-tetradecanoyl-Gln$^{B3}$-des(B30)-HI, $N^{\varepsilon B29}$-decanoyl-Gln$^{B3}$-des(B30)-HI, $N^{\varepsilon B29}$-dodecanoyl-Gln$^{B3}$-des(B30)-HI, $N^{\varepsilon B29}$-Z1-Gly$^{A21}$-HI, $N^{\varepsilon B29}$-Z2-Gly$^{A21}$-HI, $N^{\varepsilon B29}$-Z4-Gly$^{A21}$-HI, $N^{\varepsilon B29}$-Z3-Gly$^{A21}$-HI, $N^{\varepsilon B29}$-Z1-Ala$^{A21}$-HI, $N^{\varepsilon B29}$-Z2-Ala$^{A21}$-HI, $N^{\varepsilon B29}$-Z4-Ala$^{A21}$-HI, $N^{\varepsilon B29}$-Z3-Ala$^{A21}$-HI, $N^{\varepsilon B29}$-Z1-Gly$^{A21}$Gln$^{B3}$-HI, $N^{\varepsilon B29}$-Z2-Gly$^{A21}$Gln$^{B3}$-HI, $N^{\varepsilon B29}$-Z4-Gly$^{A21}$Gln$^{B3}$-HI, $N^{\varepsilon B29}$-Z3-Gly$^{A21}$Gln$^{B3}$-HI, $N^{\varepsilon B29}$-Z1-Ala$^{A21}$Gln$^{B3}$-HI, $N^{\varepsilon B29}$-Z2-Ala$^{A21}$Gln$^{B3}$-HI, $N^{\varepsilon B29}$-Z4-Ala$^{A21}$Gln$^{B3}$-HI, $N^{\varepsilon B29}$-Z3-Ala$^{A21}$Gln$^{B3}$-HI, $N^{\varepsilon B29}$-Z1-Gln$^{B3}$-HI, $N^{\varepsilon B29}$-Z2-Gln$^{B3}$-HI, $N^{\varepsilon B29}$-Z4-Gln$^{B3}$-HI, $N^{\varepsilon B29}$-Z3-Gln$^{B3}$-HI, $N^{\varepsilon B29}$-Z1-Glu$^{B30}$-HI, $N^{\varepsilon B29}$-Z2-Glu$^{B30}$-HI, $N^{\varepsilon B29}$-Z4-Glu$^{B30}$HI, $N^{\varepsilon B29}$-Z3-Glu$^{B30}$-HI, $N^{\varepsilon B29}$-Z1-Gly$^{A21}$Glu$^{B30}$-HI, $N^{\varepsilon B29}$-Z2-Gly$^{A21}$Glu$^{B30}$-HI, $N^{\varepsilon B29}$-Z4-Gly$^{A21}$Glu$^{B30}$-HI, $N^{\varepsilon B29}$-Z3-Gly$^{A21}$Glu$^{B30}$-HI, $N^{\varepsilon B29}$-Z1-Gly$^{A21}$Gln$^{B3}$Glu$^{B30}$-HI, $N^{\varepsilon B29}$-Z2-Gly$^{A21}$Gln$^{B3}$Glu$^{B30}$-HI, $N^{\varepsilon B29}$-Z4-Gly$^{A21}$Gln$^{B3}$Glu$^{B30}$-HI, $N^{\varepsilon B29}$-Z3-Gly$^{A21}$Gln$^{B3}$Glu$^{B30}$-HI, $N^{\varepsilon B29}$-Z1-Ala$^{A21}$Glu$^{B30}$-HI, $N^{\varepsilon B29}$-Z2-Ala$^{A21}$Glu$^{B30}$-HI, $N^{\varepsilon B29}$-Z4-Ala$^{A21}$Gln$^{B30}$-HI, $N^{\varepsilon B29}$-Z3-Ala$^{A21}$Glu$^{B30}$-HI, $N^{\varepsilon B29}$-Z1-Ala$^{A21}$Gln$^{B3}$Glu$^{B30}$-HI, $N^{\varepsilon B29}$-Z2-Ala$^{A21}$Gln$^{B3}$Glu$^{B30}$-HI, $N^{\varepsilon B29}$-Z4-Ala$^{A21}$Gln$^{B3}$Glu$^{B30}$-HI, $N^{\varepsilon B29}$-Z3_Ala$^{A21}$Gln$^{B3}$Glu$^{B30}$-HI, $N^{\varepsilon B29}$-Z1-Gln$^{B3}$Glu$^{B30}$-HI, $N^{\varepsilon B29}$—Z2-Gln$^{B3}$Glu$^{B30}$-HI, $N^{\varepsilon B29}$-Z4-Gln$^{B3}$Glu$^{B30}$-HI, $N^{\varepsilon B29}$-Z3-Gln$^{B3}$Glu$^{B30}$-HI and where Z1 is tridecanoyl, Z2 is tetradecanoyl, Z3 is dodecanoyl, Z4 is decanoyl, and HI is human insulin.

In some embodiments, insulin includes one or more of the following mutations and/or chemical modifications: $N^{\varepsilon B28}$—XXXXX-Lys$^{B28}$Pro$^{B29}$-HI, $N^{\alpha B1}$—XXXXX-Lys$^{B28}$Pro$^{B29}$-HI, $N^{\alpha A1}$—XXXXX-Lys$^{B28}$Pro$^{B29}$-HI, $N^{\varepsilon B28}$—XXXXX—$N^{\alpha B1}$—XXXXX-Lys$^{B28}$Pro$^{B29}$-HI, $N^{\varepsilon B28}$—XXXXX—$N^{\alpha A1}$—XXXXX-Lys$^{B28}$Pro$^{B29}$-HI, $N^{\alpha A1}$—XXXXX—$N_{\alpha B1}$—XXXXX-Lys$^{B28}$Pro$^{B29}$-HI, $N^{\varepsilon B28}$—XXXXX—$N^{\alpha A1}$—XXXXX—$N^{\alpha B1}$—XXXXX-Lys$^{B28}$Pro$^{B29}$-HI, $N^{\varepsilon B29}$—XXXXX—HI, $N^{\alpha B1}$—XXXXX—HI, $N^{\alpha A1}$—XXXXX—HI, $N^{\varepsilon B29}$—XXXXX—$N^{\alpha B1}$—XXXXX—HI, $N^{\varepsilon B29}$—XXXXX—$N^{\alpha A1}$—XXXXX—HI, $N^{\alpha A1}$—XXXXX—$N^{\alpha B1}$—XXXXX—HI, $N^{\varepsilon B29}$—XXXXX—$N^{\alpha A1}$—XXXXX—$N^{\alpha B1}$—XXXXX—HI, $N^{\varepsilon B29}$—YYYYY—HI, $N^{\alpha B1}$—YYYYY—HI, $N^{\alpha A1}$—YYYYY—HI, $N^{\varepsilon B29}$—YYYYY—$N^{\alpha B1}$—YYYYY—HI, $N^{\varepsilon B29}$—YYYYY—$N^{\alpha A1}$—YYYYY—HI, $N^{\alpha A1}$—YYYYY—$N^{\alpha B1}$—YYYYY—HI, $N^{\varepsilon B29}$—YYYYY—$N^{\alpha A1}$—YYYYY—$N^{\alpha B1}$—YYYYY—HI, $N^{\varepsilon B28}$—YYYYY-Lys$^{B28}$Pro$^{B29}$-HI, $N^{\varepsilon B28}$—YYYYY-Lys$^{B28}$Pro$^{B29}$-HI, $N^{\alpha A1}$—YYYYY-Lys$^{B28}$Pro$^{B29}$-HI, $N^{\varepsilon B28}$—YYYYY—$N^{\alpha B1}$—YYYYY-Lys$^{B28}$Pro$^{B29}$-HI, $N^{\varepsilon B28}$—YYYYY—$N^{\alpha A1}$—YYYYY-Lys$^{B28}$Pro$^{B29}$-HI, $N^{\alpha A1}$—YYYYY—$N^{\alpha B1}$—YYYYY-Lys$^{B28}$Pro$^{B29}$-$N^{\varepsilon B28}$—YYYY—$N^{\alpha A1}$—YYYYY—$N^{\alpha B1}$—YYYYY-Lys$^{B28}$Pro$^{B29}$-HI, and where YYYYY is one of acetyl or formyl and where XXXXX is one of: propionyl, butyryl, pentanoyl, hexanoyl, heptanoyl, octanoyl, nonanoyl or decanoyl and HI is human insulin.

In some embodiments, insulin may be conjugated through a reactive moiety that is naturally present within the insulin structure or is added prior to conjugation, including, for example, carboxyl or reactive ester, amine, hydroxyl, aldehyde, sulfhydryl, maleimidyl, alkynyl, azido, etc. moieties. Insulin naturally includes reactive alpha-terminal amine and epsilon-amine lysine groups to which NHS-ester, isocyanates or isothiocyanates can be covalently conjugated. In some embodiments, a modified insulin may be employed in which a suitable amino acid (e.g., a lysine or a non-natural amino acid) has been added or substituted into the amino acid sequence in order to provide an alternative point of conjugation in addition to the modified amino acids of the embodiments described herein. In some embodiments, the conjugation process may be controlled by selectively blocking certain reactive moieties prior to conjugation. In some embodiments, insulin may include any combination of modifications and the present disclosure also encompasses modified forms of non-human insulins (e.g., porcine insulin, bovine insulin, rabbit insulin, sheep insulin, etc.) that comprise any one of the aforementioned modifications. It is understood that some embodiments include these and other previously described modified insulins such as those described in U.S. Pat. Nos. 5,474,978; 5,461,031; 4,421, 685; 7,387,996; 6,869,930; 6,174,856; 6,011,007; 5,866, 538; 5,750,4976; 906,028; 6,551,992; 6,465,426; 6,444,641; 6,335,316; 6,268,335; 6,051,551; 6,034,054; 5,952,297; 5,922,675; 5,747,642; 5,693,609; 5,650,486; 5,547,929; 5,504,188; US 2015/0353619, including non-natural amino acids described or referenced herein and including such modifications to the non-human insulins described herein. It is also to be understood that in some embodiments the insulin may be covalently conjugated to polyethylene glycol polymers, such as polyethylene glycol polymers of no more than Mn 60,000, or covalently conjugated either through permanent or reversible bonds to albumin.

In some embodiments, a compound of the present disclosure (e.g., Formula I or Formula IB) is conjugated to a chelator, and in some embodiments the chelator can be used to capture a radioactive payload, such as gallium 68, copper 64, lutetium 177, or actinium 225. In some embodiments, the chelator is based on DOTA, NOTA, TETA, or 4-arm DOTA, and in some embodiments, the chelator can be linked to the peptide using a PEG linker through amide bonds to the chelator and to the peptide.

In some embodiments, the activity, bioavailability, solubility, isoelectric point, charge and/or hydrophobicity of the modified insulins can be controlled through chemical modifications and/or as result of interaction of a small molecule such as a sugar with the compounds, such as the compounds described herein which are either covalently linked or mixed with insulin.

In some embodiments one or more elements, functional groups, or atoms may be specifically omitted or excluded from a depicted structure (e.g., a terminal functional group may be replaced by a hydrogen atom, or a linking group may be replaced by a bond), for example in Formulae FF1-FF11, FF12, FF12A, FF12B, FF12C, FF12D, FF13-FF115, FF116, FF116A, FF116B, FF116C, FF116D, and FF117-FF231, and it will be understood that such omitted or excluded elements make these groups (structures) distinct and non-equivalent. For example, if an alternative version (variation) of a formula structure does not have a nitro group in R1 for B1 or B2, that variation is not equivalent (e.g., is structurally and chemically inequivalent) to a structure that includes the nitro group, at least because the nitro group changes the pKa of B1 and B2 in physiological conditions and hence the overall affinity of Z1c for glucose.

Rotationally Constrained Tethered Boron Conjugates.

In some embodiments, aromatic boron-containing compounds and/or aromatic boron-containing groups are rotationally constrained tether boron conjugates. In some embodiments, rotationally constrained tether boron conjugates presented in this disclosure contain scaffolds that are rotationally hindered by disfavored steric interactions (e.g. gauche vs anti interactions of substituents), hindered rotation due to bond hybridization (e.g., cis- vs trans-amide rotations), or through rigid covalent bonds (e.g., (E) vs (Z) configurations for alkene moieties). For example, formulae FF50-FF62, FF116, FF116A, FF116B, FF116C, FF116D, and FF121-134 contain alkyl functionalities geminal (e.g., attached to the same atom) to the amine groups that are covalently conjugated to the boronic acid functionalized moieties. Alkyl functionalities may limit the accessible dihedral angles and the rotation freedom around the C—C or C—X bond (commonly referred to as $\chi$ (chi) dihedral angles in amino acids). For example, the hydroxyl sidechain on a serine residue can access dihedral angles of 60°, 180°, or 240° (–60°) with near equal distribution while the hydroxyl sidechain of threonine may only adopt dihedral angles of 180° or 240° (–60°). The presence of a methyl group geminal to the hydroxy on threonine may provide steric bulk, creating unfavorable interactions when other bulky substituents are in a gauche conformation relative to the methyl. Formulae FF50-FF62, FF116, FF116A, FF116B, FF116C, and FF116D and FF121-134 contain geminal alkyl substituents which may limit the accessible dihedral angles that the boron conjugated amines adopt, influencing adopted dihedral angles and placing the boronic functionalized groups closer together and allowing for increased binding of the conjugates to target molecules such as proteins or sugars.

In some embodiments, an insulin receptor agonist disclosed herein may have an onset of action between 1-2 hours, or longer. In certain embodiments, the insulin receptor agonist may have a maximum effectiveness (peak) within between 6-20 hours and or have prolonged action. In some embodiments, the insulin receptor agonist can be administered at a frequency of once daily or, for example, once weekly.

In some embodiments, the insulin receptor agonists have an extended duration of bioavailability (e.g., prolonged in vivo plasma half-life). In some embodiments, the insulin receptor agonists disclosed herein comprise one or more linker moieties (e.g., one or more Z1b) and/or diboronates (e.g., F7) that results in increased terminal half-life and/or decreased clearance (CL) for the compounds disclosed herein in the blood. In some embodiments, compounds disclosed herein have a terminal half-life of at least 1 hour, at least 1.5 hours, at least 2 hours, at least 2.5 hours, at least 3 hours, at least 3.5 hours, at least 4 hours, at least 4.5 hours, or at least 5 hours. In some embodiments, compounds disclosed herein have a half-life of up to 1 hour, 2 hours, 3 hours, 4 hours, or 5 hours. In some embodiments, compounds disclosed herein have a CL value ranging from about 0.13 ml/min/kg to about 2.4 ml/min/kg.

In some embodiments, the linker comprises a $C_2$-$C_{20}$ acyl group optionally terminating in an acid group selected from A″ (e.g., AB-1-AB-39). In some embodiments, the linker comprises a lipophilic side chain selected from A″ (e.g., AB1-AB7, AB15-AB28, AB-32).

In some embodiments, the compound comprises one or more linkers comprising a $C_2$-$C_{20}$ acyl group optionally terminating in an acid group. In some embodiments, the compound comprises one or more Z1c comprising at least one F7. In further embodiments, the compounds have a prolonged terminal half-life and/or a decrease in clearance.

In some embodiments, the stereochemistry of isomeric structures (e.g., the stereochemistry of a compound (for example within the Z1c moiety)) may selectively increase the affinity of the conjugate (e.g., the Z1c moiety) for a specific target diol, such as glucose. For example, in some embodiments one or more stereoisomers (e.g., cis- or trans-, (R) or (S), and (E) or (Z)) of Z1c may be selected to increase or decreases the affinity of Z1c (and the molecular architecture or conjugate as a whole) for glucose. In some embodiments, the cis form of Formulae FF1-FF231 (e.g., FF12, FF12B, FF12C, FF12D, FF114, FF115, FF116, FF116A, FF116B, FF116C, FF116D, FF117, FF193, and FF203) is used when applicable (e.g., Z1c includes a structure having cis stereochemistry). In some embodiments, the trans form of Formulae FF1-FF231 (e.g., FF12, FF12B, FF12C, FF12D, FF115, FF116, FF116A, FF116B, FF116C, FF116D, FF117, FF193, and FF203) is used when applicable, e.g., when these Formulae include two stereocenters linked by a bond, (e.g., Z1c includes a structure having trans stereochemistry). In some embodiments, the R form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include at least one stereocenter, (e.g., Z1c includes a structure having R stereochemistry). In some embodiments, the S form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include at least one stereocenter, (e.g., Z1c includes a structure having S stereochemistry). In some embodiments, the S,S form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include two stereocenters linked by a bond, (e.g., Z1c includes a structure having S,S stereochemistry). In some embodiments, the S,R form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include two stereocenters linked by a bond, (e.g., Z1c includes a structure having S,R stereochemistry). In some embodiments, the R,R form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include two stereocenters linked by a bond, (e.g., Z1c includes a structure having R,R stereochemistry). In some embodiments, the R,S form of Formulae FF1-FF231 (e.g., FF12, FF114, FF115, FF116, FF117, FF193, and FF203) is used when applicable, e.g., when Formulae FF12, FF114, FF115, FF116, FF117, FF193, and FF203 include two stereocenters linked by a bond, (e.g., Z1c includes a structure having R,S stereochemistry). In some embodiments, a compound includes one or more tautomers of a compound disclosed herein. In-some embodiments, a compound includes one or more stereoisomers or a mixture of stereoisomers of a compound disclosed herein.

In some embodiments, a compound is covalently conjugated to glucagon, GLP-1, GLP-2 or a variation of any of these (e.g., any variation with deletions, insertions and/or replacements of one or more amino acids). In some embodiments any suitable chemical modifications made to insulin discussed herein can be made to glucagon. In some embodiments the conjugate is mixed with a second or drug substance or one or more compounds chosen from: aminoethylglucose, aminoethylbimannose, aminoethyltrimannose, D-glucose, D-galactose, D-Allose, D-Mannose, D-Gulose, D-Idose, D-Talose, N-Azidomannosamine (ManNAz) or N-Azidogalactoseamine (GalNAz) or N-azidoglucoseamine (GlcNAz), 2'-fluororibose, 2'-deoxyribose, glucose, sucrose, maltose, mannose, derivatives of these (e.g., glucosamine, mannosamine, methylglucose, methylmannose, ethylglucose, ethylmannose, etc.), sorbitol, inositol, galactitol, dulcitol, xylitol, arabitol and/or higher order combinations of these (such as linear and/or branched bimannose, linear and/or branched trimannose), molecules containing cis-diols, catechols, tris, and DOPA molecules such as L-DOPA or L-3,4-dihydroxyphenylalanine.

Moreover, one skilled in the art will recognize that in some embodiments, one or more of suitable proteinogenic artificial amino acids can be used (included) in chain A or chain B. For example, in some embodiments one or more of the following artificial amino acids can be used based on the methods described in and referenced through, and the list of amino acids provided in: Liu, C. C.; Schultz, P. G. (2010). "Adding new chemistries to the genetic code." *Annual Review of Biochemistry* 79: 413-44. One skilled in the art will recognize that, in some embodiments, artificial amino acids can be incorporated in the drug or insulin (e.g., adding amino acids to chain A or chain B), and these include the amino acids referenced herein as well as previously reported non-proteinogenic amino acids. In some embodiments, artificial amino acids exist (e.g., may be included) in the insulin, and in some embodiments thereof, proteinogenic artificial amino acids can be incorporated through recombinant protein expression using suitable methods and approaches, including those described in United States patent and patent applications including: US 2008/0044854, U.S. Pat. Nos. 8,518,666, 8,980,581, US 2008/0044854, US 20140045261, US 2004/0053390, U.S. Pat. Nos. 7,229,634, 8,236,344, US 2005/0196427, US 2010/0247433, U.S. Pat. Nos. 7,198,915, 7,723,070, US 2002/0042097, US 2004/0058415, US 2008/0026422, US 2008/0160609, US 2010/0184193, US 2012/0077228, US 2014/025599, U.S. Pat. Nos. 7,198,915, 7,632,492, 7,723,070, and other proteinogenic artificial amino acids may be introduced recombinantly using methods and approaches described in: U.S. Pat. Nos. 7,736,872, 7,816,320, 7,829,310, 7,829,659, 7,883,866, 8,097,702, 8,946,148.

In some embodiments, cyclic amino acids such as 3-hydroxyproline, 4-hydroxyproline, aziridine-2-carboxylic acid, azetidine-2-carboxylic acid, piperidine-2-carboxylic acid, 3-carboxy-morpholine, 3-carboxy-thiamorpholine, 4-oxaproline, pyroglutamic acid, 1,3-oxazolidine-4-carboxylic acid, 1,3-thiazolidine-4-carboxylic acid, 3-thiaproline, 4-thiaproline, 3-selenoproline, 4-selenoproline, 4-ketoproline, 3,4-dehydroproline, 4-aminoproline, 4-fluoroproline, 4,4-difluoroproline, 4-chloroproline, 4,4-dichloroproline, 4-bromoproline, 4,4-dibromoproline, 4-methylproline, 4-ethylproline, 4-cyclohexyl-proline, 3-phenylproline, 4-phenylproline, 3,4-phenylproline, 4-azidoproline, 4-carboxyproline, a-methylproline, a-ethylproline, a-propylproline, a-allylproline, a-benzylproline, a-(4-fluorobenzyl)-proline, a-(2-chlorobenzyl)-proline, a-(3-chlorobenzyl)-proline, a-(2-bromobenzyl)-proline, a-(4-bromobenzyl)-proline, a-(4-methylbenzyl)-proline, a-(diphenylmethyl)-proline, a-(naphthylmethyl)-proline, D-proline, or S-homoproline, (2S, 4S)-4-fluoro-L-proline, (2S, 4R)-4-fluoro-L-proline, (2S)-3,4-dehydro-L-proline, (2S, 4S)-4-hydroxy-L-proline, (2S, 4R)-4-hydroxy-L-proline, (2S,4S)-4-azido-L-proline, (2S)-4,4-difluoro-L-proline, (2S)-azetidine-2-carboxylic acid, (2S)-piperidine-2-carboxylic acid, or (4R)-1,3-thiazolidine-4-carboxylic acid can be used in the molecular architecture that is conjugated to insulin.

It is to be understood that in some embodiments, a specific orientation of amino acids is achieved using, for example, methods of Albericio, F. (2000). *Solid-Phase Synthesis: A Practical Guide* (1 ed.). Boca Raton: CRC Press. p. 848. In some embodiments a compound of the present disclosure, such as a compound of Formula I, Formula IB, or Formula IF, can bind to a diol, a catechol, a hexose sugar, glucose, xylose, fucose, galactosamine, glucosamine, mannosamine, galactose, mannose, fructose, galacturonic acid, glucuronic acid, iduronic acid, mannuronic acid, acetyl galactosamine, acetyl glucosamine, acetyl mannosamine, acetyl muramic acid, 2-keto-3-deoxy-glycero-galacto-nononic acid, acetyl neuraminic acid, glycolyl neuraminic acid, a neurotransmitter, dopamine, or a disaccharide or polymer of saccharides or diols.

In some embodiments, modifications or intermediates may include the use of an N-methyliminodiacetic acid (MIDA) group to make a MIDA conjugated boronate or a MIDA boronate; such modifications can be used during preparation of boronates towards the final structures of use (e.g., in embodiments of methods for preparing the conjugates described herein). In some embodiments boronic acid pinacol esters are used towards the final structures wherein the pinacol group can be readily removed using standard techniques by one skilled in the art. The MIDA-protected boronate esters are easily handled, stable under air, compatible with chromatography, and unreactive under standard anhydrous cross-coupling conditions and easily deprotected at room temperature under mild aqueous basic conditions such as 1M NaOH, or even $NaHCO_3$, or as described by Lee, S. J. et al. (2008). *J. Am. Chem. Soc.* 130:466.

The biological mechanism by which wild type insulin binds to the insulin receptor is previously reported in Menting, J. G. et al. (2013). *Nature* 493, 241-245; and Menting, J. G. et al. (2014). "Protective hinge in insulin opens to enable its receptor engagement." *Proc. Natl. Acad. Sci. U.S.A.* 111, E3395-3404. The activity of such insulin can be measured using any suitable technique, for example, by using in vitro insulin receptor binding with TyrA14-$^{125}$I human insulin as tracer and utilizing antibody binding beads with an insulin receptor monoclonal antibody. In some embodiments, animal models can be used for in vivo assessment of insulin activity during glucose challenge using methods that are known to one skilled in the art. In some embodiments, a compound disclosed herein is partially or fully expressed along with a recombinant protein of interest such as insulin. The processes for expression of insulin in *E. coli* areknown and can be easily performed by one skilled in the art e.g., by using the procedures outlined in Jonasson (1996). *Eur. J. Biochem.* 236:656-661; Cowley (1997). *FEBS Lett.* 402:124-130; Cho (2001). *Biotechnol. Bioprocess Eng.* 6: 144-149; Tikhonov (2001). *Protein Exp. Pur.* 21: 176-182; Malik (2007). *Protein Exp. Pur.* 55: 100-111; and Min (2011). *J. Biotech.* 151:350-356. In the most common process, the protein is expressed as a single-chain proinsulin construct with a fission protein or affinity tag. The compound (e.g., a compound of Formula I or Formula IB) can be expressed as part of proinsulin, then modified chemically to conjugate, through amide linkages, to structures of interest. This approach provides good yield and reduces experimental complexity by decreasing the number of processing steps and allows refolding in a native-like insulin, see for example, Jonasson, *Eur. J. Biochem.* 236:656-661 (1996); Cho, *Biotechnol Bioprocess Eng.* 6: 144-149 (2001); Tikhonov, *Protein Exp. Pur.* 21: 176-182 (2001); Min, *J. Biotech.* 151:350-356 (2011)). When expressed in *E. coli*, proinsulin is usually found in inclusion bodies and can be easily purified by one skilled in the art.

In some embodiments, proinsulin can be expressed using standard IPTG (isopropylthio-β-galactoside) induction of IPTG inducible expression constructs and vectors in *E. coli* strains such as B21 strain. As an example, the expression construct consists of the B-chain, C-peptide, A-chain. For example, the c-peptide sequence of EAEDLQVGQVEL-GGGPGAGSLQPLALEGSLQR can be used for expression of the proinsulin. Proinsulin is expressed in inclusion bodies (IBs), IBs are captured, washed and further purified, for example via an existing his-tag before sensor conjugation. Expression of the desired proinsulin can be performed via known procedures in the art. See, e.g., U.S. Pat. Nos. 5,457,066, 5,700,662, 5,514,646, 9,050,371, and 10400021.

In some embodiments, a compound of the present disclosure (e.g. Formula I, Formula IB, Formula IF) may be formulated for injection. For example, it may be formulated for injection into a subject, such as a human. In some embodiments, the composition may be a pharmaceutical composition, such as a sterile, injectable pharmaceutical composition. In some embodiments, the composition may be formulated for subcutaneous injection. In some embodiments, the composition is formulated for transdermal, intradermal, transmucosal, nasal, inhalable or intramuscular administration. In some embodiments, the composition may be formulated in an oral dosage form or a pulmonary dosage form. Pharmaceutical compositions suitable for injection may include sterile aqueous solutions containing, for example, sugars, polyalcohols such as mannitol and sorbitol, phenol, meta-cresol, and sodium chloride and dispersions may be prepared in glycerol, liquid polyethylene glycols, and mixtures thereof and in oils and the carrier can, for example, be a solvent or dispersion medium containing, for example, water, saccharides, ethanol, polyol (for example, glycerol, propylene glycol, and liquid polyethylene glycol, and the like), and suitable mixtures thereof. One skilled in the art recognizes that specific formulations can be developed to best suit the application and method of use of the molecular architectures of the disclosure. General considerations in the formulation and manufacture of pharmaceutical compositions, routes of administrating and including suitable pharmaceutically acceptable carriers may be found, for example, in *Remington's Pharmaceutical Sciences,* 19th ed., Mack Publishing Co., Easton, Pa., 1995. In some embodiments, the pharmaceutical composition may include zinc, e.g., $Zn^{2+}$ along with insulin if the compound (e.g. a compound of Formula I or Formula IB) comprises insulin. Such zinc formulations are, for example, described in U.S. Pat. No. 9,034,818. For example, the pharmaceutical composition may comprise zinc at a molar ratio to the modified insulin of about M:N where M is 1-11 and N is 6-1. In some embodiments, such modified insulins may be stored in a pump, and that pump being either external or internal to the body releases the modified insulins. In some embodiments, a pump may be used to release a constant amount of modified insulin wherein the insulin is glucose responsive and can automatically adjust activity based on the levels of glucose in the blood and/or the release rate from the injection site. In some embodiments, the compositions may be formulated in dosage unit form for ease of administration and uniformity of dosage. In some embodiments, the pharmaceutical composition may further include a second insulin type to provide fast-acting or basal-insulin in addition to the effect afforded by the molecular architecture. In some embodiments, a compound of the present disclosure (e.g., a compound of Formula I or Formula IB) is injected separately from insulin but modulates the activity of insulin by binding to insulin, and in some embodiments this activity change is dependent on glucose.

In some embodiments, the pharmaceutical composition comprises one or more of the compounds disclosed herein and at least one additional component selected from pharmaceutically acceptable carriers, pharmaceutically acceptable vehicles, and pharmaceutically acceptable excipients. In some embodiments, the pharmaceutical composition comprises a compound of Formula I or Formula IB and at least one additional component selected from pharmaceutically acceptable carriers, pharmaceutically acceptable vehicles, and pharmaceutically acceptable excipients.

In some embodiments, the present disclosure includes compounds that can be part of a kit, wherein the kit includes a compound of Formula I or Formula IB comprising modified insulin, as well as a pharmaceutically acceptable carrier, and for injections may include a syringe or pen. In some embodiments, a kit may include a syringe or pen that is pre-filled with a pharmaceutical composition that includes the compound of Formula I or Formula IB with a liquid carrier. Alternatively, a kit may include a separate container such as a vial with a pharmaceutical composition that includes the compound of Formula I or Formula IB with a dry carrier and an empty syringe or pen. In some embodiments, such a kit may include a separate container that has a liquid carrier, which can be used to reconstitute a given composition that can then be taken up into the syringe or pen. In some embodiments, a kit may include instructions. In some embodiments, the kit may include blood glucose measuring devices that either locally or remotely calculate an appropriate dose of the modified insulin that is to be injected at a given point in time, or at regular intervals. Such a dosing regimen is unique to the patient and may, for example, be provided as instruction to program a pump either by a person or by a computer. The kit may include an electronic device which transfers blood glucose measurements to a second computer, either locally or elsewhere (for example, in the cloud) which then calculate the correct amount of compound of Formula I or Formula IB comprising, e.g., a modified insulin that needs to be used by the patient at a certain time.

In some embodiments, the disclosure relates to a method for treating a disease or condition in a subject, comprising administering to the subject a composition including a compound described herein. In some embodiments, the disease or condition may be hyperglycemia, type 2 diabetes, impaired glucose tolerance, type 1 diabetes, obesity, metabolic syndrome X, or dyslipidemia, diabetes during pregnancy, pre-diabetes, Alzheimer's disease, MODY 1, MODY 2 or MODY 3 diabetes, mood disorders and psychiatric disorders. It will be appreciated that this combination approach may also be used with insulin resistant patients who are receiving an insulin sensitizer or a secondary drug for diabetes (such as, for example, a biguanide such as metformin, a glitazone) or/and an insulin secretagogue (such as, for example, a sulfonylurea, GLP-1, exendin-4 etc.) or amylin.

In some embodiments, a compound of the present disclosure (e.g. a compound of Formula I or Formula IB) may be administered to a patient who is receiving at least one additional therapy or taking at least one additional drug or therapeutic protein. In some embodiments, the at least one additional therapy is intended to treat the same disease or disorder as the administered compound (e.g. a compound of Formula I or Formula IB). In some embodiments, the at least one additional therapy is intended to treat a side-effect of the compound (e.g. a compound of Formula I or Formula IB) or as an adjuvant. The timeframe of the two therapies may differ or be the same; they may be administered on the same or different schedules as long as there is a period when the patient is receiving a benefit from both therapies. The two or more therapies may be administered within the same or different formulations as long as there is a period when the patient is receiving a benefit from both therapies. Any of these approaches may be used to administer more than one anti-diabetic drug to a subject.

In some embodiments a therapeutically effective amount of the compound (e.g. a compound of Formula I or Formula IB) which is sufficient amount to treat (meaning for example to ameliorate the symptoms of, delay progression of, prevent recurrence of, or delay onset of) the disease or condition at a reasonable benefit to risk ratio will be used. In some embodiments, this may involve balancing of the efficacy and additional safety to toxicity. By additional safety, it is meant that, for example, the compound (e.g. a compound of Formula I or Formula IB) can be responsive to changes in blood glucose levels or level of other molecules, even when the patient is not actively monitoring the levels of that molecule, such as blood glucose levels at a given timeframe, for example during sleep. In some embodiments, therapeutic efficacy and toxicity may be determined by standard pharmacological procedures in cell cultures or in vivo with experimental animals, and for example measuring $ED_{50}$ and $LD_{50}$ for therapeutic index of the drug. In some embodiments, the average daily dose of insulin with the molecular architecture is in the range of 5 to 400 U, (for example 30-150 U where 1 Unit of insulin is about 0.04 mg). In some embodiments, an amount of compound (e.g. a compound of Formula I or Formula IB) with these insulin doses is administered on a daily basis or bi-daily basis or by every three days or by every 4 days.

In some embodiments, the basis is determined by an algorithm, which can be computed by a computer. In some embodiments, an amount of compound, such as a compound of Formula I or Formula IB, with 5 to 10 times the doses is administered on a weekly basis or at regular intervals. In some embodiments, an amount of conjugate with 10 to 20 times these doses is administered on a bi-weekly basis or at regular intervals. In some embodiments, an amount of compound (e.g. a compound of Formula I or Formula IB) with 20 to 40 times these doses is administered on a monthly basis or at regular intervals. In some embodiments, the C-terminus of the A-chain of insulin may be further extended with a peptide (amino acid sequence) including 1-20 amino acid residues. In some embodiments, the insulin analogue is a desB30 insulin.

In some embodiments, Z1a is an amino acid or a peptide. In at least some embodiments, the Z1a includes (is composed of) 1-50 amino acid residues, for example, 1 residue, 50 residues, or any intermediate number of residues (such as e.g., 10, 15, 25, 30, 42 residues, etc.). In some embodiments, the Z1a includes 1-15 amino acids. In at least some embodiments, the peptide Z1a includes 1-8 amino acids. In some embodiments, Z1a includes 5 to 6 amino acids. In some embodiments, Z1a comprises at least one amino acid independently selected from the: Alanine (A), Asparagine (N), Glutamine (Q), Threonine (T), Methionine (M), Histidine (H), Cysteine (C), Valine (V), Isoleucine (I), Lysine (K), and Leucine (L), and the rest of the amino acids each independent selected from any of the twenty naturally occurring amino acids. In some embodiments, Z1a may include diaminopropionic acid, diaminobutyric acid, or ornithine. In some embodiments, Z1a includes 1 to 5 lysines (K). In some embodiments, Z1a includes 1 to 3 K amino acids. In some embodiments Z1a includes 5 to 6 amino acids and at least one or more amino acids are K. In some embodiments, Z1a includes 5 to 6 amino acids and 1 to 3 amino acids are K. In some embodiments, Z1a is selected from any of KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75-24014, 24037-24046. In some embodiments, Z1a is selected from KSNAPQK (SEQ ID NO:24037), KNASPQK (SEQ ID NO:24038), KLWAVK (SEQ ID NO:24039), KGARLK (SEQ ID NO:24040), ADKKTLN (SEQ ID NO:24041), KGSHK (SEQ ID NO:4238), KNSTK (SEQ ID NO:5085), GKNSTK (SEQ ID NO:13989), GKGSHK (SEQ ID NO:13198), GSHKGSHK (SEQ ID NO:24042), GKPSHKP (SEQ ID NO:24043), GKGPSK (SEQ ID NO:24044), GKGSKK (SEQ ID NO:24045), and GKKPGKK (SEQ ID NO:24046).

In some embodiments Z1a is appended to the N-terminus and/or C-terminus, and/or inserted into the sequence of the A-chain or B-chain of insulin.

Compounds

In some embodiments, the present disclosure provides a compound comprising at least two aromatic boron containing groups or a tautomer, stereoisomer or a mixture of stereoisomers, or a pharmaceutically acceptable salt, or hydrate, or isotopic derivative of the compound, wherein at least one aromatic boron-containing group is covalently attached to the compound and selected from F3-F111, and the other aromatic boron-containing group is covalently attached to the compound and optionally selected from F1-F11 or a boronic acid, (F1)

(F2)

-continued (F3)

(F4)

(F5)

(F6)

(F7)

(F8)

(F9)

-continued (F10)

(F11)

wherein at least one R1 in each of F1-F11 is covalently attached to the compound, and each remaining $R_1$ and $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_m$ $CH_3$, and $OCF_3$, wherein m is 1, 2, 3, 4, 5, 6, or 7, wherein, for Formulae F3-F4:

$R_w$ is O or S;

for Formulae F5-F10:

when Y8 is O, i is 2, 3, 4, or 5; or when Y8 is NR, R is an alkyl group or H, and i is 1, 2, 3, 4, or 5;

Y9 is H, $CH_3$, or an alkyl group, provided that when Y8 is O, Y9 is a $CH_3$ or an alkyl group; and each Y10 is independently selected from H, $CH_3$, F, $CF_3$, and $OCH_3$, with the proviso that at least one Y10 is not H.

In some embodiments, the present disclosure provides a compound comprising at least one diboronate, wherein the diboronate comprises at least two aromatic boron containing groups, wherein at least one aromatic boron-containing group is covalently attached to the compound and selected from F3-F11, and the other aromatic boron-containing group is covalently attached to the compound and optionally selected from F1-F11 or a boronic acid, (F1)

(F2)

-continued (F3)

(F4)

(F5)

(F6)

(F7)

(F8)

(F9)

-continued (F10)

(F11)

wherein at least one $R_1$ in each of F1-F11 is covalently attached to the compound, and each remaining $R_1$ and $R_2$ is independently selected from H, F, Cl, Br, OH, $CH_2$—$NH_2$, $NH_2$, (C$=$O)—$NH_2$, CH$=$O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_m$ $CH_3$, and $OCF_3$, wherein m is 1, 2, 3, 4, 5, 6, or 7, wherein, for Formulae F3-F4:

$R_w$ is O or S;

for Formula F6:

when Y8 is O, i is 1, 2, 3, 4, or 5; or i is 2, 3, 4, or 5; and none, one, or two $R_1$ represents F, Cl, $CF_2$, $CF_3$, $SF_5$, $OCF_3$, $SO_2CH_3$ and/or $SO_2CF_3$; or when Y8 is NR, R is an alkyl group or H, and i is 1, 2, 3, 4, or 5;

for Formulae F5 and F7-F10:

when Y8 is O, i is 1, 2, 3, 4, or 5; or when Y8 is NR; R is an alkyl group or H, and i is 1, 2, 3, 4, or 5;

Y9 is $CH_3$, F, $CF_3$, $CHF_2$, or $OCH_3$; and each Y10 is independently selected from H, $CH_3$, F, $CF_3$, $CHF_2$, and $OCH_3$, with the proviso that at least one Y10 is not H.

In some embodiments, the compound comprises at least two aromatic boron containing groups or a tautomer, stereoisomer or a mixture of stereoisomers, or a pharmaceutically acceptable salt, or hydrate, or isotopic derivative thereof.

In some embodiments, the compound is a diboron containing compound (e.g., has at least two aromatic boron containing groups as covalent conjugates). In some embodiments, at least one aromatic boron-containing group is F7. In some embodiments, at least one aromatic boron-containing group is F7, and when Y8 is O, each Y10 is $CH_3$. In some embodiments, the compound comprising at least two aromatic boron containing groups comprises X1 and one or more Z1c, or a tautomer, stereoisomer or a mixture of stereoisomers, or a pharmaceutically acceptable salt, or hydrate, or isotopic derivative thereof.

In some embodiments, the present disclosure provides a compound comprising X1 and one or more Z1c, or a tautomer, stereoisomer or a mixture of stereoisomers, or a pharmaceutically acceptable salt, or hydrate, or isotopic derivative thereof, wherein: X1 comprises:

(i) $NH_2$ or OH (for example, X1 is $NH_2$ or OH);

(ii) a drug substance comprising an amine;

201

202

(iii) a drug substance that is covalently conjugated to an amine containing linker; or (iv) an amine configured to be covalently conjugated to a drug substance;

wherein each Z1c is independently selected from Formulae FF1-FF231; and wherein each Z1c is covalently conjugated, directly or indirectly, to an amine in X1 or to OH when X1 is OH.

In some embodiments, Z1c is independently selected from Formulae FF1-FF48, Formulae FF49-FF88, FF89-FF112, FF113-FF136, FF137-FF160, FF161-FF164, FF165-FF166, FF167-FF192, FF193-FF209, and FF210-FF231, wherein each Z1c is independently selected from:

a) Formulae FF1-FF48, wherein Formulae FF1-FF48 are:

-continued (FF1)

(FF2)

(FF3)

(FF4)

(FF5)

(FF6)

(FF7)

(FF8)

(FF9)

(FF10)

(FF11)

(FF12)

(FF13)

203
-continued (FF14)

5

10

204
-continued (FF21)

(FF15)

15

(FF22)

20

(FF16)

25

(FF17)

30

(FF23)

(FF18)

35

(FF24)

(FF19)

40

45

50

(FF25)

(FF20)

55

(FF26)

60

65

(FF27)

205

-continued (FF28)

(FF29)

(FF30)

(FF31)

(FF32)

(FF33)

(FF34)

(FF35)

206

-continued (FF36)

(FF37)

(FF38)

(FF39)

(FF40)

(FF41)

(FF42)

(FF43)

207

-continued (FF44)

(FF45)

(FF46)

(FF47)

and (FF48)

;

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7; and B1 and B2, which may be identical or different, each independently represents an aromatic boron-containing group;

b) Formulae FF49-FF88, wherein Formulae FF49-FF88 are:

(FF49)

(FF50)

208

-continued (FF51)

(FF52)

(FF53)

(FF54)

(FF55)

(FF56)

(FF57)

(FF58)

(FF59)

(FF60)

209

-continued (FF61)

(FF62)

(FF63)

(FF64)

(FF65)

(FF66)

(FF67)

(FF68)

210

-continued (FF69)

(FF70)

(FF71)

(FF72)

(FF73)

(FF74)

(FF75)

211
-continued

212
-continued (FF76)

(FF77)

(FF78)

(FF79)

(FF80)

(FF81)

(FF82)

(FF83)

(FF84)

(FF85)

(FF86)

(FF87)

and

5

10

15

20

25

30

35

40

45

50

55

60

65

-continued (FF88)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7; R1a is selected from COOH, CH$_3$, H, and OH; R2, R3, R4 and R5 are each independently selected from CH$_3$, H, OH, and COOH, and at least one of R2, R3, R4 and R5 is CH$_3$ or OH; and B1 and B2, which may be identical or different, are each independently an aromatic boron-containing group.

c) Formulae FF89-FF112, wherein Formulae FF89-FF112 are:

(FF89)

(FF90)

-continued (FF91)

(FF92)

(FF93)

(FF94)

(FF95)

(FF96)

215

-continued (FF97)

(FF98)

(FF99)

(FF100)

(FF101)

(FF102)

216

-continued (FF103)

(FF104)

(FF105)

(FF106)

(FF107)

-continued (FF108)

(FF109)

(FF110)

(FF111)

and (FF112)

wherein X represents a point of covalent attachment either
directly to an amine in X1 or to an amine that is
covalently conjugated directly or indirectly to X1, or to
OH when X1 is OH;

i is 1, 2, 3, 4, 5, 6, or 7; and

B1, B2 and B3, which may be identical or different, are
each independently an aromatic boron-containing group, a carboxylic acid derivative, or a H, wherein in
each FF89-FF112 structure containing B1, B2 and B3
groups, at least two of the B1, B2 and B3 groups are
independently an aromatic boron-containing group;

d) Formulae FF113-FF136, wherein Formulae FF113-
FF136 are:

(FF113)

(FF114)

(FF115)

(FF116)

(FF117)

(FF118)

219

-continued (FF119)

(FF120)

(FF121)

(FF122)

(FF123)

(FF124)

(FF125)

5

10

15

20

25

30

35

40

45

50

55

60

65

220

-continued (FF126)

(FF127)

(FF128)

(FF129)

(FF130)

(FF131)

221
222

-continued (FF132)

(FF133)

(FF134)

(FF135)

and (FF136)

(FF137)

(FF138)

(FF139)

(FF140)

(FF141)

(FF142)

(FF143)

wherein X represents a point of covalent attachment either directly to an amine in X1 or to an amine that is covalently conjugated directly or indirectly to X1, or to OH when X1 is OH;

i is 0, 1, 2, 3, 4, 5, 6, or 7;

j is 0, 1, 2, 3, 4, 5, 6, or 7;

k is 0, 1, 2, 3, 4, 5, 6, or 7;

m is 0, 1, 2, 3, 4, 5, 6, or 7;

wherein i+j+k+m is greater than 0;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl or aryl groups; and B1 and B2, which may be identical or different, each independently represents an aromatic boron-containing group;

e) Formulae FF137-FF160, wherein Formulae FF137-FF160 are:

223

-continued (FF144)

(FF145)

(FF146)

(FF147)

(FF148)

(FF149)

(FF150)

5

10

15

20

25

30

35

40

45

50

55

60

65

224

-continued (FF151)

(FF152)

(FF153)

(FF154)

(FF155)

(FF156)

-continued (FF157)

(FF158)

(FF159)

and (FF160)

wherein X represents a point of covalent attachment either
directly to an amine in X1 or to an amine that is
covalently conjugated directly or indirectly to X1, or to
OH when X1 is OH;
i is 0, 1, 2, 3, 4, 5, 6, or 7;
j is 0, 1, 2, 3, 4, 5, 6, or 7;
k is 0, 1, 2, 3, 4, 5, 6, or 7;
m is 0, 1, 2, 3, 4, 5, 6, or 7;
wherein i+j+k+m is greater than 0;
each R1 is independently selected from H, an alkyl group,
an acyl group, a cycloalkyl group, a haloalkyl group, an
aryl group, and a heteroaryl group, each R1 optionally
comprises one or more alkyl-halide, halide, sulfhydryl,
aldehyde, amine, acid, hydroxyl, alkyl or aryl groups;
and
B1 and B2, which may be identical or different, each
independently represents an aromatic boron-containing
group. In one embodiment, B1 and B2 may be identical
or different;
f) Formulae FF161-FF164, wherein Formulae FF161-
FF164 are:

(FF161)

-continued (FF162)

(FF163)

(FF164)

wherein X represents a point of covalent attachment either
directly to an amine in X1 or to an amine that is
covalently conjugated directly or indirectly to X1, or to
OH when X1 is OH;
i is 1, 2, 3, 4, or 5 (e.g., 1, 2, 3, or 5);
j is 1, 2, 3, 4, or 5 (e.g., 1, 2, 3, or 5);
each R6, R7, R8, and R9 for different values of j is
independently selected from H, $CF_3$, $CH_3$, $CHF_2$, and
$(CH_2)_m CH_3$, wherein m is 1, 2, 3, 4, or 5;
Y3, Y4, Y5, Y6 and Y7 are each independently selected
from H, $CH_2$—X4, and Formulae IV-1 to IV-135;
wherein X4 is selected from —COOH, —$(CH_2)_m$COOH,
an alkyl group, an acyl group, a cycloalkyl group, a
haloalkyl group, an aryl group, and a heteroaryl group,
each X4 optionally comprises one or more alkyl-halide,
halide, sulfhydryl, aldehyde, amine, acid, hydroxyl,
alkyl or aryl groups; wherein m is 1, 2, 3, 4, or 5;
wherein at least one of Y5, Y6 and Y7 in Formulae FF162
and FF163 is not H and at least one of Y7, R8 and R9
in FF164 is not H; and
wherein Formulae IV-1 to IV-135 are:

(IV-1)

(IV-2)

227

-continued (IV-3)

(IV-4)

(IV-5)

(IV-6)

(IV-7)

(IV-8)

(IV-9)

(IV-10)

(IV-11)

(IV-12)

(IV-13)

228

-continued (IV-14)

(IV-15)

(IV-16)

(IV-17)

(IV-18)

(IV-19)

(IV-20)

(IV-21)

(IV-22)

(IV-23)

(IV-24)

229
-continued (IV-25)

5

(IV-26)

10

(IV-27)

15

(IV-28)

20

(IV-29)

25

(IV-30) 30

(IV-31) 35

(IV-32)

40

(IV-33)

45

(IV-34)

50

(IV-35)

(IV-36) 55

(IV-37)
60

65

230
-continued (IV-38)

(IV-39)

(IV-40)

(IV-41)

(IV-42)

(IV-43)

(IV-44)

(IV-45)

(IV-46)

(IV-47)

(IV-48)

231
-continued

232
-continued (IV-49)

(IV-50)

(IV-51)

(IV-52)

(IV-53)

(IV-54)

(IV-55)

(IV-56)

(IV-57)

(IV-58)

(IV-59)

(IV-60)

(IV-61)

(IV-62)

(IV-63)

5

10

15

20

25

30

35

40

45

50

55

60

65

233
-continued

234
-continued (IV-64)

(IV-65)

(IV-66)

(IV-67)

(IV-68)

(IV-69)

(IV-70)

(IV-71)

(IV-72)

(IV-73)

(IV-74)

(IV-75)

(IV-76)

5

10

15

20

25

30

35

40

45

50

55

60

65

235

-continued (IV-77)

(IV-78)

(IV-79)

(IV-80)

(IV-81)

(IV-82)

(IV-83)

(IV-84)

(IV-85)

5

10

15

20

25

30

35

40

45

50

55

60

65

236

-continued (IV-86)

(IV-87)

(IV-88)

(IV-89)

(IV-90)

(IV-91)

(IV-92)

(IV-93)

(IV-94)

237

-continued (IV-95)

(IV-96)

(IV-97)

(IV-98)

(IV-99)

(IV-100)

(IV-101)

(IV-102)

(IV-103)

238

-continued (IV-104)\

(IV-105)

(IV-106)

(IV-107)

(IV-108)

(IV-109)

5

10

15

20

25

30

35

40

45

50

55

60

65

239

-continued (IV-110)

5

(IV-111)

10

(IV-112) 15

20

(IV-113)

25

30

(IV-114)

35

(IV-115)

40

(IV-116)

45

(IV-117)

50

55

(IV-118)

60

(IV-119)

65

240

-continued (IV-120)

(IV-121)

(IV-122)

(IV-123)

(IV-124)

(IV-125)

(IV-126)

(IV-127)

-continued (IV-128)

(IV-129)

(IV-130)

(IV-131)

(IV-132)

(IV-133)\

(IV-134)

(IV-135)

wherein Xa represents CH=O, $CHF_2$, $CF_3$, $CH_2SH$, COOH, $CH_2OH$, $CH_2NO_2$, $CH_2NH_2$, $CH_3$, $C(CH_3)_3$, $CH(CH_3)_2$, $CH((CH_2)_3\ CH_3)_2$, or $CH(CH_2\ CH_3)_2$;

Xb represents O, NH, $CH_2$, or S;

Xc represents CH or N;

each $R_{10}$ is independently selected from H, F, Cl, Br, $CH_3$, $CF_3$, CH=O, OH, COOH, and $(CH_2)_nCH_3$, m is 1, 2, 3, 4, or 5; and n is 1, 2, 3, 4, or 5;

B1 and B2, which may be identical or different, each independently represents an aromatic boron-containing group; and \* in Formulae IV-1 to IV-135 represents the point of attachment to corresponding Formulae FF161-164;

g) Formulae FF165-FF166, wherein Formulae FF165-FF166 are:

(FF165)

and (FF166)

wherein X represents a point of covalent attachment either directly to an amine in X1 or to an amine that is covalently conjugated directly or indirectly to X1, or to OH when X1 is OH;

m is 1, 2, 3, 4, 5, 6, or 7;

n is 1, 2, 3, 4, 5, 6, or 7;

X5 is S, O, or NH; and each $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —($SO_2$)NH $CH_3$, —($SO_2$)NH$(CH_2)_mCH_3$, and $OCF_3$, wherein m is 1, 2, 3, 4, 5, 6, or 7;

h) Formulae FF167-FF192, wherein Formulae FF167-FF192 are:

243                           244

(FF167)

(FF168)

(FF169)

(FF170)

(FF171)

(FF172)

(FF173)

(FF174)

(FF175)

(FF176)

(FF177)

(FF178)

(FF179)

(FF180)

(FF181)

245
-continued

246
-continued (FF182)

(FF183)

(FF184)

(FF185)

(FF186)

(FF187)

(FF188)

(FF189)

(FF190)

(FF191)

and

-continued (FF192)

wherein X represents a point of covalent attachment either directly to an amine in X1 or to an amine that is covalently conjugated directly or indirectly to X1, or to OH when X1 is OH; and $B_1$ and $B_2$, which may be identical or different, each independently represents an aromatic boron-containing group;

i) Formulae FF193-FF209, wherein Formulae FF193-FF209 are:

FF193

FF194

FF195

FF196

FF197

-continued

FF198

FF199

FF200

FF201

FF202

FF203

FF204

FF205

249
-continued

250
-continued

FF206

5

FF212

FF207

10

FF213

FF208

15

20

FF214

FF209

25

30

FF215 wherein R in FF208 and FF209 is an alkyl, aryl or halide that is covalently conjugated through at least one $CH_2$ group to the amino group in the side chain of FF208 or FF209,

35

FF216

R1 and R2 are independently selected from H, CH3, alkyl, and formulae IV-1 to IV-135;

i is 1, 2, 3, 4, or 5;

j is 1, 2, 3, 4, or 5; and

40

FF217 wherein X represents a point of covalent attachment either directly to an amine in X1 or to an amine that is covalently conjugated directly or indirectly to X1, or to OH when X1 is OH; and $B_1$ and $B_2$, which may be identical or different, each independently represents an aromatic boron-containing group;

45 j) Formulae FF210-FF224, wherein Formulae FF210-FF224 are:

50

FF218

FF210

55

FF219

FF211

60

65

FF220

251
-continued

FF221

FF222

FF223

FF224 wherein R11 in FF210 to FF212 is selected from Formulae IV-1 to IV-135 and R12 is selected from an amine, a hydroxyl, an alkyl, and a halide group;

wherein each R13 is independently selected from H, CH₃, alkyl, aryl and Formulae IV-1 to IV-135; R14 is selected from H, CH₃, alkyl, aryl and heteroaryl;

wherein X represents a point of covalent attachment either directly to an amine in X1 or to an amine that is covalently conjugated directly or indirectly to X1, or to OH when X1 is OH;

X" represents a point of covalent attachment to an amine —N in the compound, wherein — represents a single covalent bond to a CH₂ or CH group in the compound;

i is 1, 2, 3, 4, or 5;

j is 1, 2, 3, 4, or 5; and

B₁, B₂, B₃, B₄, B₅, and B₆ each independently represents an aromatic boron-containing group, wherein in each FF structure containing B₁, B₂ and B₃ groups, at least two of the B1, B2 and B3 groups are independently an aromatic boron-containing group; and k) Formulae FF225-FF231, wherein Formulae FF225-FF231 are:

(FF225)

252
-continued (FF226)

(FF227)

(FF228)

(FF229)

(FF230)

(FF231)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

$B_1$ and $B_2$, which may be identical or different, each independently represents an aromatic boron-containing group; and wherein at least one primary or secondary amine in FF1-FF223 and FF225-231 is optionally covalently conjugated to $B_6$.

In some embodiments, $B_1$, $B_2$, $B_3$, $B_4$, $B_5$, and $B_6$ each independently represents the aromatic boron-containing groups, wherein in each FF structure containing $B_1$, $B_2$ and $B_3$ groups, at least two of the $B_1$, $B_2$ and $B_3$ groups are independently the aromatic boron-containing groups.

In some embodiments, at least one Z1c is (FF227)

In some embodiments, at least one Z1c is FF227 and i is 1.

In some embodiments, at least one Z1c is selected from FF12-FF35, FF104-FF117, FF180-FF193, and FF196-FF205. In some embodiments, Z1c is selected from FF12, FF116, FF193, and FF203.

In some embodiments, $B_1$ and $B_2$ in Formulae FF225-FF231 are not a boronic acid or an F2 or F6 aromatic boron-containing group, wherein Formulae F2 and F6 are:

(F2)

and (F6)

$R_1$ at position 5' represents (C=O)—*, wherein —* represents the attachment point to the rest of Z1c;

zero, one, or two $R_1$ represent F, Cl, $CF_2$, $CF_3$, $SF^5$, $OCF_3$, $SO_2CH_3$, and/or $SO_2CF_3$, and each remaining $R_1$ represents H;

Y8 is O; and i is 1.

In some embodiments, the aromatic boron-containing group is not an aromatic boron-containing group as disclosed in patent application PCT/US2020/058641 (filed Mar. 27, 2020) as Formula R1a, Formula R1b, Formula R1c, Formula R2a, Formula R2b, and Formula R2c; the disclosure of which is herein expressly incorporated by reference in its entirety.

In some embodiments, the present disclosure provides a compound of Formula (I) or a molecular conjugate represented by Formula I, or a stereoisomer or a mixture of stereoisomers, or pharmaceutically acceptable salt thereof:

(Formula I)

$$[[[Z1c]_{\overline{p'}}Z1a_{\overline{m'}}]_{o'}Z1b_{\overline{n'}}]_{q'}X1,$$

wherein X1 comprises:
  (i) $NH_2$ or OH (for example, X1 is $NH_2$ or OH),
  (ii) a polypeptide drug substance comprising an amine,
  (iii) a polypeptide drug substance that is covalently conjugated to an amine containing linker, or
  (iv) an amine configured to be covalently conjugated to a polypeptide drug substance;
each Z1c is independently selected from Formulae FF1-FF231; each Z1a independently comprises 1 to 50 amino acids connected together using amide or peptide bonds; each Z1b is independently a small-molecule linker; each m' is independently 0 or 1; each n' is independently 0 or a positive integer; each o' is independently an integer of 1 or greater; each p' is a positive integer; and q' is a positive integer of at least 1 and not more than two times the total number of amine groups in X1, wherein when any of n', o', p', or q' is 2 or more, the corresponding groups Z1a, Z1b, and Z1c are independently selected and may be the same or different; wherein each Z1c is independently covalently conjugated, directly or indirectly, to an amine of Z1a, to an amine of Z1b, or to X1; and wherein optionally the molecular conjugate may comprise one or more isotopes at any position of the molecular conjugate of Formula I.

In at least some embodiments, X1 comprises one of:
  (i) $NH_2$ or OH (for example, X1 is $NH_2$ or OH),
  (ii) a polypeptide drug substance comprising an amine,
  (iii) a polypeptide drug substance that is covalently conjugated to an amine containing linker, or
  (iv) an amine configured to be covalently conjugated to a polypeptide drug substance.

In some embodiments, the compound is a molecular conjugate represented by Formula I, or a stereoisomer or a mixture of stereoisomers, or pharmaceutically acceptable salts:

(Formula I)

$$[[[Z1c]_{\overline{p'}}Z1a_{\overline{m'}}]_{o'}Z1b_{\overline{n'}}]_{q'}X1,$$

wherein:
X1 is $NH_2$ or OH; or
X1 comprises:
  i. a polypeptide drug substance comprising an amine;
  ii. a polypeptide drug substance that is covalently conjugated to an amine containing linker; or
  iii. an amine configured to be covalently conjugated to a polypeptide drug substance;
each Z1c is independently selected from Formulae FF1-FF231;
each Z1a independently comprises 1 to 50 amino acids connected together using amide or peptide bonds; each Z1b is independently a small-molecule linker;
each m' is independently 0 or 1;
each n' is independently 0 or a positive integer;

each o' is independently an integer greater than or equal to 1;

each p' is a positive integer; and q' is a positive integer of at least 1 and not more than two times the total number of amine groups in X1, wherein when any of n', o', p', or q' is 2 or more, the corresponding groups Z1a, Z1b, and Z1c are independently selected and may be the same or different; wherein each Z1c is independently covalently conjugated, directly or indirectly, to an amine of Z1a, to an amine of Z1b, or to X1; and wherein optionally the molecular conjugate may comprise one or more isotopes at any position of the molecular conjugate of Formula I. In some embodiments, the compound is additionally covalently conjugated as described by Formula I, and/or wherein one or more amines are each independently acetylated and/or independently alkylated.

In some embodiments, the compound of Formula I is covalently conjugated to $B_1$ using a covalent linkage $X—B_1$, wherein X is an amino group in Formula I.

In some embodiments, X1 comprises a polypeptide drug substance and the covalent conjugation to X1 is to amino group(s) in one or more lysine residues and/or to the N-terminal amino groups in X1.

In some embodiments, the compound comprises at least one of $B_1$, $B_2$ and $B_3$ independently selected from Formulae F1-F11 or wherein the compound comprises at least one of $B_4$, $B_5$ and $B_6$ independently selected from Formulae F1-F11, wherein Formulae F1-F11 are:

(F1)

(F2)

(F3)

(F4)

-continued (F5)

(F6)

(F7)

(F8)

(F9)

(F10)

-continued (F11)

wherein for $B_1$, $B_2$, and $B_3$:

one $R_1$ represents (C=O)—*, S(=O)(=O)—*, $(CH_2)_m$ (C=O)—*, or $(CH_2)_m$—*, wherein —* represents an attachment point to the rest of Z1c or to the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c or to the compound and one $R_1$ for $B_5$ represents (C=O)—*, S(=O)(=O)—*, $(CH_2)_m(C=O)$—*, or $(CH_2)_m$—*, wherein —* represents an attachment point to the rest of Z1c or to the compound, and m is 1, 2, 3, 4, 5, 6, or 7; and each remaining $R_1$ or R2 is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7;

wherein, for Formulae F3-F4:

$R_w$ is O or S;

for Formulae F5-F10:

when Y8 is O, i is 1, 2, 3, 4, or 5; or when Y8 is NR, R is an alkyl group or H; and i is 1, 2, 3, 4, or 5;

Y9 is H, $CH_3$, or an alkyl group, provided that when Y8 is O, Y9 is a $CH_3$ or an alkyl group; and each Y10 is independently selected from H, $CH_3$, F, $CF_3$, and $OCH_3$, with the proviso that at least one Y10 is not H.

In some embodiments, for Formulae F5-F10:

when Y8 is O, i is 2, 3, 4, or 5; or when Y8 is NR, R is an alkyl group or H; and i is 1, 2, 3, 4, or 5;

Y9 is H, $CH_3$, or an alkyl group, provided that when Y8 is O, Y9 is a $CH_3$ or an alkyl group; and each Y10 is independently selected from H, $CH_3$, F, $CF_3$, and $OCH_3$, with the proviso that at least one Y10 is not H.

In at least some embodiments, $B_1$, $B_2$ and $B_3$ may be identical or different. If $B_1$, $B_2$ and $B_3$ are all present in a compound of the present disclosure, then each is independently an aromatic boron-containing group, a carboxylic acid derivative, or a H, wherein in each FF structure (i.e., FF1 to FF231) containing $B_1$, $B_2$ and $B_3$ groups, at least two of the B1, B2 and B3 are independently an aromatic boron-containing group.

In some embodiments, the compound comprises at least one group selected from $B_1$, $B_2$, $B_3$ $B_4$, $B_5$ and $B_6$, each independently selected from Formulae F2, F7, F8, and F11, wherein Formulae F2, F7, F8, and F11 are:

(F2)

(F7)

(F8)

(F11)

wherein for $B_1$, $B_2$, and $B_3$:

one $R_1$ represents (C=O)—* or $(CH_2)_m(C=O)$—*, wherein —* represents the attachment point to the rest of Z1c or to the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$— $CH_3$, —$(SO_2)NH(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c or to the compound and one R1 for $B_5$ represents (C=O)—*, S(=O)(=O)—*, $(CH_2)_m$(C=O)—*, or $(CH_2)_m$—*, wherein —* represents an attachment point to the rest of Z1c or to the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, $(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7; and wherein for Formula F7:

Y8 is O or NR, wherein R is an alkyl group or H; and each Y10 is independently selected from $CH_3$, F, $CF_3$, and $OCH_3$;

wherein for Formula F8:

when Y8 is O, i is 1, 2, 3, 4, or 5; and when Y8 is NR, R is an alkyl group or H, and i is 1, 2, 3, 4, or 5;

each Y10 is independently selected from H, $CH_3$, F, $CF_3$, and $OCH_3$, with the proviso that at least one Y10 is not H; and — represents an attachment point to the rest of Z1c or to the compound.

In some embodiments, the compound comprises at least one group selected from $B_1$, $B_2$, $B_3$, $B_4$, $B_5$ and $B_6$, each independently selected from:

(F2)

(F7)

-continued (F8)

(F11)

wherein for $B_1$, $B_2$, and $B_3$:

one $R_1$ represents (C=O)—*, wherein —* represents the attachment point to the rest of Z1c or to the compound; and each remaining $R_1$ or R2 is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_m$, $CH_3$, —$(SO_2)NH$—$CH_3$, —$(SO_2)$ $NH(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c or to the compound and one $R_1$ for $B_5$ represents (C=O)—*, S(=O)(=O)—*, $(CH_2)_m$(C=O)—*, or $(CH_2)_m$—*, wherein —* represents an attachment point to the rest of Z1c or to the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for Formula F7:

Y8 is O; and each Y10 is independently selected from $CH_3$, F, and $CF_3$;

wherein for Formula F8:

Y8 is O;

i is 1, 2, 3, 4, or 5; and each Y10 is independently selected from H, $CH_3$, F, and $CF_3$, with the proviso that at least one Y10 is not H; and — represents an attachment point to the rest of Z1c or to the compound.

In some embodiments, the compound comprises at least one group selected from $B_1$, $B_2$, $B_3$, $B_4$, $B_5$ and $B_6$, each independently selected from:

(F7A)

(F8A)

and, (F11)

wherein for $B_1$, $B_2$, and $B_3$:

$R_1$ at position 5' represents (C=O)—*, wherein —* represents the attachment point to the rest of Z1c or to the compound; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c or to the compound and one $R_1$ for $B_5$ represents (C=O)—*, S(=O)(=O)—*, $(CH_2)_m(C=O)$—*, or $(CH_2)_m$—*, wherein —* represents an attachment point to the rest of Z1c or to the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

wherein for $B_6$: one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

wherein for Formulae F7A and F8A:

Y8 is O; and i is 1, 2, 3, 4, or 5; and

— represents an attachment point to the rest of Z1c or to the compound.

In some embodiments, for Formulae F7A and F8A:

Y8 is O; and i is 2, 3, 4, or 5.

In some embodiments, the compound comprises at least one group selected from $B_1$, $B_2$ $B_3$, $B_4$, $B_5$ and $B_6$, wherein each $B_1$, $B_2$ $B_3$, $B_4$, $B_5$ and $B_6$ is Formula F7A, (F7A)

wherein for $B_1$, $B_2$, and $B_3$:

$R_1$ at position 5' represents (C=O)—*, wherein —* represents the attachment point to the rest of Z1c or to the compound; and each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c or to the compound and one $R_1$ for $B_5$ represents (C=O)—*, S(=O)(=O)—*, $(CH_2)_m(C=O)$—*, or $(CH_2)_m$—*, wherein —* represents an attachment point to the rest of Z1c or to the compound, and m is 1, 2, 3, 4, 5, 6, or 7; and each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

Y8 is O; and

— represents an attachment point to the rest of Z1c or to the compound.

In some embodiments, at least one Z1c is covalently conjugated indirectly via a linker to an amine of X1 or to $NH_2$ when X1 is $NH_2$ or to OH when X1 is OH or to an amine of Z1a, wherein the linker is represented by Formula $(X'')_{n1}$, wherein each n1 is independently selected from 1, 2, 3, 4, and 5, and each X" is independently selected from:

i. an L- or D-amino acid, wherein an amine functional group of the L- or D-amino acid is covalently conjugated, directly or indirectly, to Z1c and an acid functional group of the L- or D-amino acid is conjugated, directly or indirectly, to X1 or to Z1a; and ii. Formulae FL(IA), FL(IB), FL69, and FL70;

wherein Formula FL(IA) and FL(IB) are:

FL(IA)

FL(IB)

and stereoisomers thereof;

wherein:

G is selected from a 3- to 6-membered cycloalkyl group, a 3- to 10-membered heterocyclyl group, a heteroaryl group, and an aryl group, wherein each group is optionally substituted with 1-3 groups independently selected from hydroxy, amino, halogen, cycloalkyl, alkoxy, and alkyl;

E is absent or is an alkylene group optionally substituted with 1-3 groups independently selected from halogen, hydroxy, and amino;

Q is absent or is selected from hydrogen, alkyl, halo, cyano, alkoxy, carboxylic acid, amino, hydroxy, amide, halo alkyl, cycloalkyl, heterocycle, heteroaryl, and aryl, wherein the alkyl, alkoxy, cycloalkyl, heterocycle, heteroaryl, and aryl is each optionally substituted with 1-5 groups independently selected from alkyl, amino, amide, halo, hydroxy, cyano, halo alkyl, and alkoxy;

Q' is selected from hydrogen, alkyl, and an acyl group;

Q and Q', together with the carbon and nitrogen atom to which they are attached, optionally form a 4-membered heterocyclyl, a 5-membered heterocyclyl, a 6-membered heterocyclyl, a 9-membered bicyclic heterocyclyl, or a 10-membered bicyclic heterocyclyl, wherein the 4-membered heterocyclyl, 5-membered heterocyclyl, 6-membered heterocyclyl, 9-membered bicyclic heterocyclyl, and 10-membered bicyclic heterocyclyl are each optionally substituted with 1-5 groups independently selected from alkyl, amino, halo, hydroxy, cyano, amide, halo alkyl, and alkoxy;

p is 0, 1, 2, 3, 4, or 5;

q is 0, 1, 2, 3, 4, or 5;

R" represents a covalent bond, directly or indirectly, to Z1c;

Z" represents a covalent bond, directly or indirectly, to X1 or to Z1a; and any primary amine is optionally acetylated or alkylated;

wherein Formulae FL69 and FL70 are:

FL69

FL70 and stereoisomers thereof;

wherein:

R" represents a covalent bond, directly or indirectly, to Z1c;

Z" represents a covalent bond, directly or indirectly, to X1 or to Z1a;

A' is selected from H, an alkyl, a saturated fatty acid, an unsaturated fatty acid, a cycloalkyl, a haloalkyl, an aryl, and a heteroaryl; and A" is (i) a bile acid conjugated, directly or indirectly, via its acid group to the amine in FL69 or FL70; or (ii) a $C_2$-$C_{20}$ acyl group optionally terminating in an acid group, wherein one or more carbon atoms of the $C_2$-$C_{20}$ acyl group are optionally and independently replaced by a group selected from C(=O), O, NH, $NH_2$, S, S(O), $SO_2$, phenyl, 5-membered heterocyclyl, 6-membered heterocyclyl, 5-membered heteroaryl, 6-membered heteroaryl, and wherein the one or more carbon atoms of the $C_2$-$C_{20}$ acyl group, NH, $NH_2$, $SO_2$, phenyl, 5-membered heterocyclyl, 6-membered heterocyclyl, 5-membered heteroaryl, and 6-membered heteroaryl is each independently substituted with 0, 1, 2, 3, or 4 $R_x$, wherein $R_x$ is selected from $C_1$-$C_5$ alkyl, halogen, $C_1$-$C_5$ haloalkyl, carboxylic acid, hydroxyl, —O—$C_1$-$C_5$ alkyl, $NH_2$, and a substituted or unsubstituted 5-membered heterocyclyl, 6-membered heterocyclyl, 5-membered heteroaryl, and 6-membered heteroaryl;

p is 1, 2, 3, 4, or 5, q is 1, 2, 3, 4, or 5, and any primary amine is optionally acetylated or alkylated.

In some embodiments, each A" is independently selected from:

AB-1

AB-2

265

-continued

AB-3

AB-4

AB-5

AB-6

AB-7

AB-8

AB-9

AB-10

AB-11

AB-12

AB-13

266

-continued

AB-14

AB-15

AB-16

AB-17

AB-18

AB-19

AB-20

AB-21

AB-22

AB-23

5

10

15

20

25

30

35

40

45

50

55

60

65

267
-continued

268
-continued

AB-24

AB-25

AB-26

AB-27

AB-28

AB-29

AB-30

AB-31

AB-32

AB-33

AB-34

AB-35

AB-36

AB-37

AB-37A

AB-38

5

10

15

20

25

30

35

40

45

50

55

60

65

-continued

AB-39

In some embodiments, the compound comprises at least one Z1b selected from Formulae IIa-IIai or Formulae IIIa-IIIai, wherein Formulae IIa-IIai are:

Formula IIa

Formula IIb

Formula IIc

Formula IId

Formula IIe

Formula IIf

Formula IIg

Formula IIh

Formula IIi

Formula IIj

Formula IIk

-continued

Formula IIl

Formula IIm

Formula IIn

Formula IIo

Formula IIp

Formula IIq

Formula IIr

Formula IIs

Formula IIt

Formula IIu

Formula IIv

Formula IIw

Formula IIx

Formula IIy

271

-continued

Formula IIz

Formula IIaa

Formula IIab

Formula IIac

Formula IIad

Formula IIae

Formula IIaf

Formula IIag

Formula IIah and

Formula IIai wherein:

r is 0, 1, 2, 3, 4, or 5;

s is 0, 1, 2, 3, 4, or 5;

W represents $CH_2$—~ or (C=O)—~, wherein —~ is a covalent linkage to X1; and each $V_1$ is independently selected from NH—†, $CH_2$—†, and (C=O)—† and each $V_2$ is N—†, wherein —† is a covalent linkage towards successive Z1b, Z1a or Z1c, provided that $V_1$ is NH—† when connected to Z1c; and the covalent linkages between Z1a and Z1b units each independently comprise an amine linkage or an amide

272 linkage; and when n'=0 and m'=1, Z1a is directly conjugated to X1 by an amine linkage or amide linkage, and wherein Formulae IIIa-IIIai are:

Formula IIIa

Formula IIIb

Formula IIIc

Formula IIId

Formula IIIe

Formula IIIf

Formula IIIg

Formula IIIh

Formula IIIi

Formula IIIj

Formula IIIk

Formula IIIl

273

-continued

274

-continued

Formula IIIm

Formula IIIaa

Formula IIIab

Formula IIIn

Formula IIIac

Formula IIIo

Formula IIIad

Formula IIIp

Formula IIIac

Formula IIIq

Formula IIIr

Formula IIIs

Formula IIIaf

Formula IIIt

Formula IIIag

Formula IIIu

Formula IIIah    and

Formula IIIv

Formula IIIai

Formula IIIw wherein:

r is 1, 2, 3, 4, or 5;

s is 1, 2, 3, 4, or 5; and each V₁ is independently selected from NH—†, CH₂—†, and (C═O)—† and each V₂ is N—†, wherein —† is a covalent linkage towards successive Z1b, Z1a or Z1c, provided that V₁ is NH—† when connected to Z1c; and the covalent linkages between Z1a and Z1b units each independently comprise an amine linkage or an amide linkage; and when n'=0 and m'=1, Z1a is directly conjugated to X1 by an amine linkage or amide linkage.

Formula IIIx

In some embodiments, at least one Z1c is covalently conjugated indirectly via a linker (indirect linker) to the compound (e.g., the compound of Formula I). In some embodiments, the linker is selected from (i) Formulae FL1-FL19, FL5A, FL5B, FL65A, FL65B, FL69, FL69A, FL69B, FL70, FL70A, and FL70B:

Formula IIIy

Formula IIIZ (FL1)

(FL2)

(FL3)

(FL4)

(FL4A)

(FL5)

(FL6)

(FL7)

(FL7A)

(FL8)

(FL9)

(FL8A)

(FL9A)

(FL10)

(FL11)

(FL12)

(FL13)

277

278

(FL14)

(FL15)

(FL16)

(FL17)

(FL18)

(FL19)

FL5B

FL65A

FL65B

FL69

FL69A

FL69B

FL70

FL70A

FL70B wherein, in Formulae FL1-FL19, FL5A, FL5B, FL65A, FL65B, FL69, FL69A, FL69B, FL70, FL70A, and FL70B:

Z" represents an attachment point toward X1;

R" represents an attachment point toward Z1c;

p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group directly conjugated to Z1c, wherein an acid functional group of the amino acid is conjugated toward X1 in Formula I.

In some embodiments, n' is 1 and each of the Z1b is independently selected from (i) Formulae FL1-FL19, FL5A, FL5B, FL65A, FL65B, FL69, FL69A, FL69B, FL70, FL70A, and FL70, and;

wherein, in Formulae FL1-FL19, FL5A, FL5B, FL65A, FL65B, FL69, FL69A, FL69B, FL70, FL70A, and FL70B:

Z" represents an attachment point toward X1;

R" represents an attachment point toward Z1c;

p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group directly conjugated to Z1c, wherein an acid functional group of the amino acid is conjugated toward X1 in Formula I.

In some embodiments, in Formula I, Z1c is directly connected to X1 through an optional covalent-spacer, and the optional covalent-spacer is independently selected from gamma-glutamic acid, beta-alanine, and (FL3)

$$Z'' - \left[ \phantom{x} \right]_p - \overset{\overset{\displaystyle O}{\|}}{\phantom{C}} - \overset{H}{N} - R''$$

Formula FL3, wherein p is 1 or 2; and (FL5)

$$R'' - \overset{H}{N} - \left[ \phantom{x} \right]_p - Z''$$

Formula FL5, wherein p is 2, 3, or 4;

In some embodiments, X1 is OH or $NH_2$, and X1 further comprises a drug substance covalently conjugated directly or indirectly to the compound.

In at least some embodiments, the compound of the present disclosure comprises a drug substance comprising a polypeptide hormone, a human polypeptide hormone and/or insulin, or an analogue thereof, or a hybrid polypeptide comprising one or more combinations thereof.

In at least some embodiments, the compound of the present disclosure comprises an amine in the compound that is conjugated via an amide linkage to an aromatic boron-containing compound (e.g., group). In some embodiments, the aromatic boron-containing group is selected from a phenylboronic acid, boroxole, and phenylboronate.

In at least some embodiments, the compound of the present disclosure is dehydrated (loses) by 1, 2, 3, 4, 5, 6, 7, 8, or more water molecules.

In at least some embodiments, the compound of the present disclosure is formulated in a solution comprising one or more of a buffer, stabilizer, vasodilator, preservative, surfactant, salt, sugar, or compounds containing one or more hydroxyls, alcohols, diols, or phenols. For example, the solution could comprise one or more of citrate, zinc, and/or cresol.

In at least some embodiments, X1 comprises a human polypeptide hormone of the human pancreas, insulin, glucagon, GLP-1, a somatostatin, a gastric inhibitory polypeptide, a glucose-dependent insulinotropic polypeptide, a hybrid peptide comprising sequences from two or more human polypeptide hormones, or an analogue thereof.

In some embodiments, X1 comprises human insulin or a human insulin analogue comprising an A-chain and a B-chain, wherein the A-chain comprises a sequence selected from SEQ ID NOs 1 and 3 to 33, and the B-chain comprises a sequence selected from SEQ ID NOs 2 and 34 to 74, 24047, and 24048;

each Z1c is independently selected from FF1, FF10, FF12, FF14, FF15, FF114, FF115, FF116, FF163, FF193, FF194, FF203, and FF221-FF231 and covalently conjugated either directly, or indirectly via the linker, to Z1a and/or Z1b, or to X1;

each Z1a is independently absent or independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKGSTK (SEQ ID NO:13205), GKHENK (SEQ ID NO:13271), GKNSHK (SEQ ID NO:13982), GKNSTK (SEQ ID NO:13989), GKQSSK (SEQ ID NO:14380), GKYQFK (SEQ ID NO:15128), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042);

each linker is selected from FL1, FL3, FL4, and FL5;

each m' is independently 0 or 1;

each n' is independently 0, 1, 2, or 3;

each o' is independently 1, 2, 3, 4, or 5;

each p' is 1, 2, 3, 4, or 5; and q' is 1, 2, 3, or 4, wherein when any of n', o', p', or q' is 2 or more, the corresponding groups Z1a, Z1b, and Z1c are independently selected and may be the same or different; and wherein each Z1c is independently covalently conjugated, directly or indirectly, to an amine of Z1a, to an amine of Z1b, or to X1.

In some embodiments, X1 comprises the human insulin or human insulin analogue comprising an A-chain and a B-chain, wherein the A-chain comprises SEQ ID NO:1; and the B-chain is selected from SEQ ID NOs 2, 36, 24047, and 24048;

each Z1c is independently selected from FF1, FF10, FF12, FF14, FF15, FF114, FF115, FF116, FF193, FF194, FF203, and FF221-FF224 and covalently conjugated either directly, or indirectly via the linker, to Z1a and/or Z1b, or to X1;

each Z1a independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKG-STK (SEQ ID NO:13205), GKHENK (SEQ ID NO:13271), GKNSHK (SEQ ID NO:13982), GKN-STK (SEQ ID NO:13989), GKQSSK (SEQ ID NO:14380), GKYQFK (SEQ ID NO:15128), GKG-SKK (SEQ ID NO:24045), GKKPGKK (SEQ ID NO:24046), GKGPSK (SEQ ID NO:24044), GKP-SHKP (SEQ ID NO:24043), and GSHKGSHK (SEQ ID NO:24042);

each linker is independently absent or independently selected from FL3 and FL5;

each m' is independently 0 or 1;

each n' is independently 0 or 2;

each o' is independently 1, 2, or 3;

each p' is 1, 2, or 3; and q' is 1, 2, or 3, wherein when any of n', o', p', or q' is 2 or more, the corresponding groups Z1a, Z1b, and Z1c are independently selected and may be the same or different;

wherein each Z1c is independently covalently conjugated, directly or indirectly, to an amine of Z1a, to an amine of Z1b, or to X1.

In some embodiments, each of the Z1a is independently absent or independently comprises a sequence selected from K, GK, KGSH (SEQ ID NO:24049), GKGSH (SEQ ID NO:24050), KGSHK (SEQ ID NO:4238), and GKGSHK (SEQ ID NO:13198).

In some embodiments, each of the Z1c is independently selected from FF1, FF10, FF12, FF14, FF15, FF114, FF115, FF116, and FF221-FF231. In some embodiments, $B_1$ and $B_2$ are independently selected from Formulae F1 and F2. In some embodiments, the $B_1$ and the $B_2$ are independently selected from F2 and F7. In some embodiments, the $B_1$ and the $B_2$ are F2. In some embodiments, the $B_1$ and the $B_2$ are F7. In some embodiments, the $B_1$ is F2 and the $B_2$ is F7. In some embodiments, the $B_1$ is F7 and the $B_2$ is F2. In some embodiments, at least one R1 in $B_1$ or $B_2$ is F or $CF_3$. In some embodiments, Z1b is independently absent, FL3, or FL5. In some embodiments, each of the Z1c is independently selected from FF10, FF12, FF116, FF221, FF222, and FF224.

In some embodiments, each $B_1$ and $B_2$ is independently selected from F2 and F7 and is covalently conjugated to Z1c using an amide linkage, each Z1b is independently absent; FL3 wherein p is 1, 2, or 3; or FL5 wherein p is 2, 3, or 4;

each FF is independently selected from FF10, FF12, FF116, FF134, FF163, FF193, FF203, FF221, FF222 and FF224; wherein FF12 and FF222 has either (S,R) or (S,S) stereochemistry;

each Z1c is conjugated either directly or indirectly through FL3 or FL5 to the amine group in one or more lysine side chain in X1 or the N-terminus in X1; and X1 is a polypeptide drug substance and/or an insulin optionally having from 0 to 4 residues replaced, inserted, or mutated to lysines, and wherein the lysines are each conjugated directly or indirectly to a Z1c.

In some embodiments, each $B_1$ and $B_2$ is F2 and is covalently conjugated to Z1c using an amide linkage, each Z1b is independently absent; FL3 wherein p is 1, 2, or 3; or FL5 wherein p is 2, 3, or 4;

each FF is independently selected from FF10, FF12, FF116, FF134, FF163, FF193, FF203, FF221, FF222 and FF224; wherein FF12 and FF222 has either (S,R) or (S,S) stereochemistry;

each Z1c is conjugated either directly or indirectly through FL3 or FL5 to the amine group in one or more lysine side chain in X1 or the N-terminus in X1; and X1 is a polypeptide drug substance and/or an insulin optionally having from 0 to 4 residues replaced, inserted, or mutated to lysines, and wherein the lysines are each conjugated directly or indirectly to a Z1c.

In some embodiments, each $B_1$ and $B_2$ is F7 and is covalently conjugated to Z1c using an amide linkage, each Z1b is independently absent; FL3 wherein p is 1, 2, or 3; or FL5 wherein p is 2, 3, or 4;

each FF is independently selected from FF10, FF12, FF116, FF134, FF163, FF193, FF203, FF221, FF222 and FF224; wherein FF12 and FF222 has either (S,R) or (S,S) stereochemistry;

each Z1c is conjugated either directly or indirectly through FL3 or FL5 to the amine group in one or more lysine side chain in X1 or the N-terminus in X1; and X1 is a polypeptide drug substance and/or an insulin optionally having from 0 to 4 residues replaced, inserted, or mutated to lysines, and wherein the lysines are each conjugated directly or indirectly to a Z1c.

In some embodiments, Z1c is FF224, n' is 0, and Z1a is an amine containing amino acid.

In some embodiments, Z1c is covalently conjugated directly to X1 via a linker, and wherein the linker is independently selected from gamma-glutamic acid, beta-alanine, and Formula FL3

(FL3)

wherein p is 1, 2, or 3; and

Formula FL5

(FL5)

wherein p is 2, 3, or 4.

In some embodiments, the compound further comprises a drug substance covalently conjugated directly or indirectly to the compound.

In some embodiments, the compound of Formula I is selected from Examples 315, 318, 320, 605-608, 610-612, 589-595, 562-574, and 803-914.

In some embodiments, X1 is a polypeptide drug substance and/or an insulin optionally having from 0 to 4 residues replaced, inserted, or mutated to lysines, and wherein the lysines are each conjugated to a Z1c.

In some embodiments, one or more amines are each independently acetylated and/or independently alkylated.

In some embodiments, X1 comprises a polypeptide drug substance and the covalent conjugation to X1 is to amino group(s) in one or more lysine residues and/or to the N-terminal amino groups in X1.

In some embodiments, each R1 in FF1-FF231 is independently selected from a $C_1$-$C_{22}$ alkyl group, a $C_1$-$C_{22}$ acyl group, a ($C_3$-$C_8$)cycloalkyl group, a $C_1$-$C_{22}$ haloalkyl group, an aryl group, and a heteroaryl group, each R1 optionally comprises one or more $C_1$-$C_{22}$ alkyl-halide, halide, sulfhydryl, aldehyde, amine, acid, hydroxyl, $C_1$-$C_{22}$ alkyl, or aryl groups.

In some embodiments, X4 is selected from —COOH, —$(CH_2)_m$COOH, a $C_1$-$C_{22}$ alkyl group, a $C_1$-$C_{22}$acyl group, a ($C_3$-$C_8$)cycloalkyl group, a $C_1$-$C_{22}$ haloalkyl group, an aryl group, and a heteroaryl group, each X4 optionally comprises one or more $C_1$-$C_{22}$ alkyl-halide, halide, sulfhydryl, aldehyde, amine, acid, hydroxyl, $C_1$-$C_{22}$ alkyl, or aryl groups; wherein m is 1, 2, 3, 4, or 5.

In some embodiments, the alkyl group of Y9 is a $C_1$-$C_{22}$ alkyl. In some embodiments, Y9 is $CH_3$.

In some embodiments, at least one primary or secondary amine in FF1-FF223 and FF225-FF231 is covalently conjugated to $B_6$.

In some embodiments, an amine in the compound is conjugated via an amide linkage to an aromatic boron-containing group.

In some embodiments, the aromatic boron-containing group is selected from a phenylboronic acid, boroxole, and phenylboronate.

In some embodiments, the compound is formulated in a solution comprising one or more of a buffer, stabilizer, vasodilator, preservative, surfactant, salt, sugar, or compounds containing one or more hydroxyls, alcohols, diols, or phenols. In some embodiments, the solution comprises one or more of citrate, zinc, and/or cresol.

In some embodiments, Z1c is conjugated to a cysteine.

In some embodiments, the compound (e.g., the compound of Formula I) is covalently conjugated either directly or through a linker to a diol, sugar, carbohydrate or a diol containing molecule.

In some embodiments, the compound (e.g., the compound of Formula I) is covalently conjugated to an antibody, albumin or a fragment thereof, or covalently conjugated either directly or through a linker to a molecule that can bind to at least one protein present in human plasma. In at least one embodiment, the present disclosure provides a method to administer the compounds disclosed herein to a human subject as a therapeutic or prophylactic agent.

In some embodiments, the compounds disclosed herein are used as intermediate compounds for the manufacture of any compounds disclosed herein.

In some embodiments, the compounds disclosed herein comprise at least one Z1c. In at least some embodiments, the Z1c is a boron containing compound. In some embodiments, a subset of boron containing compounds is selected from a non-aromatic and/or an aromatic boron-containing group. In some embodiments, Z1c is an aromatic boron-containing group. In at least one embodiment, the compound of the present disclosure comprises at least one Z1c selected from FF1-FF18, FF35, FF56-FF62, FF65-FF67, FF70-FF72, FF75-FF77, FF80-FF81, FF84, FF88, FF92, FF101-FF102, FF107-FF136, FF193-194, FF203, and FF225-231. In at least some embodiments, the Z1c is selected from FF1-FF231. In some embodiments, the compound comprises at least one Z1c having at least one chiral center and selected from FF1, FF2, FF5, FF9, FF11-FF13, FF15-FF24, FF27, FF31, FF34-FF36, FF38, FF39, FF43-FF58, FF60-FF70, FF72-FF75, FF77-FF80, FF82-FF84, FF86-FF212, FF216-FF220, FF222, FF223, FF227, FF229, FF230, FF231, and combinations thereof.

In some embodiments, the compound comprises at least one FF12 and/or FF116. In some embodiments, the stereochemistry of FF12 and FF116 is independently selected from (S,S); (S,R); (R,R); and (R,S).

In some embodiments, X1 comprises human insulin or a human insulin analogue comprising an A-chain and a B-chain, wherein the C-terminus of the A-chain of the human insulin analogue is optionally extended with a polypeptide of up to 20 residues, and/or the N-terminus of the B-chain of the human insulin analogue is optionally extended with a polypeptide of up to 10 residues. In some embodiments, one to six residues of the insulin A-chain and/or the insulin B-chain are deleted or mutated.

In some embodiments, X1 comprises at least one lysine having an amine side chain, and Z1c is covalently conjugated directly to the amine side chain. In some embodiments, the compound of the present disclosure comprises at least one Z1a comprising one or more amino acids having an amine side chain, and wherein the one or more amino acids are selected from lysine, diaminopropionic acid, diaminobutyric acid, and ornithine; and wherein Z1c is covalently conjugated, directly or indirectly, to the amine side chain.

In some embodiments, the compound of the present disclosure may include one or more isotopes selected from deuterium, tritium, carbon-13, carbon-14, and iodine-124. In at least one embodiment, the compound comprises deuterium.

In some embodiments, X1 comprises a drug substance covalently conjugated to at least one Z1c through an acid containing linker. In some embodiments, a composition of the present disclosure comprises at least one compound as disclosed herein (e.g., a compound comprising X1 and one or more Z1c, Formula I), or a tautomer, stereoisomer or a mixture of stereoisomers, or a pharmaceutically acceptable salt, or hydrate, or isotopic derivative thereof formulated together with one or more pharmaceutically acceptable carriers.

In some embodiments, the present disclosure also provides a composition or a mixture comprising at least one compound as disclosed herein, for use as a medicament for the treatment of diabetes, for control of blood sugar levels, or to control the release of a drug based on physiological levels of diol containing small molecules or sugars.

In some disclosed embodiments are a method of administering a compound as disclosed herein to a human subject as a therapeutic or prophylactic agent.

In some embodiments, the disclosure provides a method of making a compound as disclosed herein comprising at least one alkylation and/or amidation step.

In some embodiments, the disclosure provides a method of treating a subject by administering a device or formulation comprising a compound as disclosed herein, such as Examples 1-915. For example, the device can be a fixed dose injector, microdosing injector, an internal or external patch.

In some embodiments, the disclosure provides a method of treating or preventing diabetes, impaired glucose tolerance, hyperglycemia, or metabolic syndrome (metabolic syndrome X, insulin resistance syndrome) comprising administering to a subject in need thereof a therapeutically effective amount of a compound disclosed herein.

In at least some embodiments, the present disclosure is directed to a compound of Formulae FF1-FF231, or a tautomer, stereoisomer or a mixture of stereoisomers, or a pharmaceutically acceptable salt, or hydrate, or isotopic derivative thereof. In at least some embodiments, the present disclosure is directed to a compound selected from Formulae FF1-FF48, Formulae FF49-FF88, FF89-FF112, FF113-FF136, FF137-FF160, FF161-FF164, FF165-FF166, FF167-FF192, FF193-FF209, and FF210-FF231.

In some embodiments, the present disclosure is directed to a compound selected from Formulae FF1-FF48, wherein X is selected from maleimide, an amine, OH, and halogen; and i is 1, 2, 3, 4, 5, 6, or 7;

j is 1, 2, 3, 4, 5, 6, or 7; and $B_1$ and $B_2$, which may be identical or different, each independently represents an aromatic boron-containing group.

In some embodiments, the present disclosure is directed to a compound selected from Formulae FF49-FF88, wherein X is selected from maleimide, an amine, OH, and halogen;

i is 1, 2, 3, 4, 5, 6, or 7;

j is 1, 2, 3, 4, 5, 6, or 7;

R1a is selected from COOH, $CH_3$, H, and OH;

R2, R3, R4 and R5 is each independently selected from $CH_3$, H, OH, and COOH, and at least one of R2, R3, R4 and R5 is $CH_3$ or OH; and $B_1$ and $B_2$, which may be identical or different, are each independently an aromatic boron-containing group.

In some embodiments, the present disclosure is directed to a compound selected from Formulae FF89-FF112, wherein X is selected from maleimide, an amine, OH, and halogen;

i is 1, 2, 3, 4, 5, 6, or 7; and $B_1$, $B_2$ and $B_3$, which may be identical or different, each independently represents an aromatic boron-containing group, a carboxylic acid derivative, or a H, wherein at least two of $B_1$, $B_2$ and $B_3$ in each FF structure are independently an aromatic boron-containing group.

In some embodiments, the present disclosure is directed to a compound selected from Formulae FF113-FF136, wherein X is selected from maleimide, an amine, OH, and halogen;

i is 0, 1, 2, 3, 4, 5, 6, or 7;

j is 0, 1, 2, 3, 4, 5, 6, or 7;

k is 0, 1, 2, 3, 4, 5, 6, or 7;

m is 0, 1, 2, 3, 4, 5, 6, or 7;

wherein i+j+k+m is greater than 0 each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group.

In some embodiments, the present disclosure is directed to a compound selected from Formulae FF137-FF160, wherein X is selected from maleimide, an amine, OH, and halogen;

i is 0, 1, 2, 3, 4, 5, 6, or 7;

j is 0, 1, 2, 3, 4, 5, 6, or 7;

k is 0, 1, 2, 3, 4, 5, 6, or 7;

m is 0, 1, 2, 3, 4, 5, 6, or 7;

wherein i+j+k+m is greater than 0;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group.

In some embodiments, the present disclosure is directed to a compound selected from Formulae FF161-FF164, wherein X is selected from maleimide, an amine, OH, and halogen;

i is 1, 2, 3, 4, or 5 (e.g., 1, 2, 3, or 5);

j is 1, 2, 3, 4, or 5 (e.g., 1, 2, 3, or 5);

each R6, R7, R8, and R9 for different values of j is independently selected from H, $CF_3$, $CH_3$, $CHF_2$, and $(CH_2)_m CH_3$, wherein m is 1, 2, 3, 4, or 5;

Y3, Y4, Y5, Y6 and Y7 are each independently selected from H, $CH_2$—X4, and Formulae IV-1 to IV-135 (as previously defined);

wherein X4 is selected from —COOH, —$(CH_2)_m$COOH, an alkyl group, an acyl group, a cycloalkyl group, a haloalkyl group, an aryl group, and a heteroaryl group, each optionally comprising one or more alkyl-halide, halide, sulfhydryl, aldehyde, amine, acid, hydroxyl, alkyl or aryl groups; wherein m is 1, 2, 3, 4, or 5;

wherein at least one of Y5, Y6, and Y7 in Formulae FF162 and FF163 is not H; and at least one of Y7, R8 and R9 in FF164 is not H; and Xa represents CH═O, $CHF_2$, $CF_3$, $CH_2SH$, COOH, $CH_2OH$, $CH_2NO_2$, $CH_2NH_2$, $CH_3$, $C(CH_3)_3$, $CH(CH_3)_2$, $CH((CH_2)_3 CH_3)_2$, or $CH(CH_2 CH_3)_2$;

Xb represents O, NH, $CH_2$, or S;

Xc represents CH or N;

each $R_{10}$ is independently selected from H, F, Cl, Br, $CH_3$, $CF_3$, CH═O, OH, COOH, and $(CH_2)$, $CH_3$, m is 1, 2, 3, 4, or 5; and n is 1, 2, 3, 4, or 5; and $B_1$ and $B_2$, which may be identical or different, each independently represents an aromatic boron-containing group. In some embodiments, when j is 4, X is not $NH_2$ for FF163.

In some embodiments, the present disclosure is directed to a compound selected from Formulae FF165-FF166, wherein X is selected from maleimide, an amine, OH, and halogen;

m is 1, 2, 3, 4, 5, 6, or 7;

n is 1, 2, 3, 4, 5, 6, or 7;

X5 is S, O, or NH; and each $R_1$ is independently selected from H, F, Cl, Br, OH, $CH_2$—$NH_2$, $NH_2$, (C═O)—$NH_2$, CH═O, $SO_2CH_3$, $SO_2CF_3$, $CF_3$, $CHF_2$, $NO_2$, $CH_3$, $OCH_3$, $O(CH_2)_m CH_3$, —$(SO_2)NH CH_3$, —$(SO_2)NH(CH_2)_m$, $CH_3$, and $OCF_3$, wherein m is 1, 2, 3, 4, 5, 6, or 7.

In some embodiments, the present disclosure is directed to a compound selected from Formulae FF167-FF192, wherein X is selected from maleimide, an amine, OH, and halogen; and $B_1$ and $B_2$, which may be identical or different, each independently represents an aromatic boron-containing group.

In some embodiments, the present disclosure is directed to a compound selected from Formulae FF193-FF209, wherein R in FF208 and FF209 is an alkyl, aryl or halide that is covalently conjugated through at least one $CH_2$ group to the amino group in the side chain of FF208 or FF209;

R1 and R2 are independently selected from H, $CH_3$, alkyl, and formulae IV-1 to IV-135;

i is 1, 2, 3, 4, or 5;

j is 1, 2, 3, 4, or 5; and wherein X is selected from maleimide, an amine, OH, and halogen; and $B_1$ and $B_2$, which may be identical or different, each independently represents an aromatic boron-containing group.

In some embodiments, the present disclosure is directed to a compound selected from Formulae FF210-FF224, wherein R11 in FF210 to FF212 is independently selected from Formulae IV-1 to IV-135 and R12 is selected from an amine, a hydroxyl, an alkyl, and a halide group;

wherein each R13 is independently selected from H, $CH_3$, alkyl, aryl, and formulae IV-1 to IV-135; R14 is selected from H, $CH_3$, alkyl, aryl, and heteroaryl; wherein X is independently selected from maleimide, an amine, OH, and halogen;

X" is an amine;

i is 1, 2, 3, 4, or 5;

j is 1, 2, 3, 4, or 5; and $B_1$, $B_2$, $B_3$, $B_4$, $B_5$, and $B_6$, each independently represents an aromatic boron-containing group, wherein in any compound containing $B_1$, $B_2$ and $B_3$ groups, at least two groups are independently an aromatic boron-containing group.

In some embodiments, the present disclosure is directed to a compound selected from Formulae FF225-FF231, (FF225)

(FF226)

(FF227)

(FF228)

-continued (FF229)

(FF230)

(FF231)

wherein X is selected from maleimide, an amine, OH, and halogen;

i is 1, 2, 3, 4, 5, 6, or 7;

$B_1$ and $B_2$, which may be identical or different, each independently represents an aromatic boron-containing group, wherein $B_1$ and $B_2$ in Formulae FF225-FF231 are not an F2 or F6 aromatic boron-containing group, wherein Formulae F2 and F6 are:

(F2)

and (F6)

R$_1$ at position 5' represents (C=O)—*, wherein —* represents the attachment point to the rest of FF225-FF231;

zero, one, or two R$_1$ represents F, Cl, CF$_2$, CF$_3$, SF$_5$, OCF$_3$, SO$_2$CH$_3$, and/or SO$_2$CF$_3$, and each remaining R$_1$ represents H;

Y8 is O; and i is 1; and each remaining R$_1$ is H;

Y8 is O; and i is 1.

In at least some embodiments, when X is an amine in any one of Formulae FF1 to FF223 and FF225-FF231, X is optionally acetylated or alkylated.

In some embodiments, the compound comprises at least one of B$_1$, B$_2$ and B$_3$ independently selected from Formulae F1-F11 or wherein the compound comprises at least one of B$_4$, B$_5$ and B$_6$ independently selected from Formulae F1-F11. In at least some embodiments, B$_1$, B$_2$ and B$_3$ may be identical or different. If B$_1$, B$_2$ and B$_3$ are all present in a compound of the present disclosure, then each is independently an aromatic boron-containing group, a carboxylic acid derivative, or a H, with the proviso that in each FF structure (i.e., FF1 to FF231) containing B$_1$, B$_2$ and B$_3$ groups, at least two groups are independently an aromatic boron-containing group.

In some embodiments, for B$_1$, B$_2$, B$_3$:

one R$_1$ represents (C=O)—*, S(=O)(=O)—*, (CH$_2$)$_m$ (C=O)—*, or (CH$_2$)$_m$—*, wherein —* represents an attachment point to the rest of Z1c or to the compound, and m is 1, 2, 3, 4, 5, 6, or 7;

each remaining R$_1$ or R$_2$ is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH CH$_3$, —(SO$_2$)NH (CH$_2$)$_m$CH$_3$, and OCF$_3$, wherein m is 1, 2, 3, 4, 5, 6, or 7;

In some embodiments, for B$_4$, B$_5$:

one R$_1$ for B$_4$ represents (CH$_2$)$_m$—ø, wherein —ø represents the attachment point (representing a covalent bond) to an amine in X1 and one R$_1$ for B$_5$ represents (C=O)—*, S(=O)(=O)—*, (CH$_2$)$_m$(C=O)—*, or (CH$_2$)$_m$—*, wherein —* represents the attachment point to the same amine in X1, and m is 1, 2, 3, 4, 5, 6, or 7;

each remaining R$_1$ or R$_2$ is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH CH$_3$, —(SO$_2$)NH (CH$_2$)$_m$CH$_3$, and OCF$_3$, wherein m is 1, 2, 3, 4, 5, 6, or 7.

In some embodiments, for B$_6$:

one R$_1$ for B$_6$ represents (CH$_2$)$_m$—ø, wherein —ø represents the attachment point (representing a covalent bond) to the rest of the compound, and m is 1, 2, 3, 4, 5, 6, or 7;

each remaining R$_1$ or R$_2$ is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$, CH$_3$, —(SO$_2$)NH CH$_3$, —(SO$_2$)NH (CH$_2$)$_m$CH$_3$, and OCF$_3$, wherein m is 1, 2, 3, 4, 5, 6, or 7.

In some embodiments, for Formulae F3-F4:

R$_w$ is O or S;

for Formulae F5-F10:

when Y8 is O, i is 1, 2, 3, 4, or 5; or when Y8 is NR, R is an alkyl group or H, and i is 1, 2, 3, 4, or 5;

Y9 is H, CH$_3$, or an alkyl group, provided that when Y8 is O, Y9 is a CH$_3$ or an alkyl group; and each Y10 is independently selected from H, CH$_3$, F, CF$_3$, and OCH$_3$, with the proviso that at least one Y10 is not H.

In some embodiments, for Formulae F5-F10:

when Y8 is O, i is 2, 3, 4, or 5;

Y9 is H, CH$_3$, or an alkyl group, provided that when Y8 is O, Y9 is a CH$_3$ or an alkyl group; and each Y10 is CH$_3$.In some embodiments, the compound is selected from:

N-(3-(3-borono-5-nitrobenzamido)propyl)-N-(3-borono-5-nitrobenzoyl)glycine (DS01);

N-(4-((4-(3-borono-5-nitrobenzamido)cyclohexyl)methyl) cyclohexyl)-N-(3-borono-5-nitrobenzoyl)glycine (DS02);

N-(4-((3-borono-5-nitrobenzamido)methyl)benzyl)-N-(3-borono-5-nitrobenzoyl)glycine (DS03);

N-(3-((3-borono-5-nitrobenzamido)methyl)benzyl)-N-(3-borono-5-nitrobenzoyl)glycine (DS04);

N-(4-(3-borono-5-nitrobenzamido)butyl)-N-(3-borono-5-nitrobenzoyl)glycine (DS05);

N-(3-(3-borono-5-fluorobenzamido)propyl)-N-(3-borono-5-fluorobenzoyl)glycine (DS06);

N-(3-(3-borono-5-fluorobenzamido)-2,2-dimethylpropyl)-N-(3-borono-5-fluorobenzoyl)glycine (DS07);

bis(3-(3-borono-5-fluorobenzamido)propyl)glycine (DS08);

N-(4-((3-borono-5-fluorobenzamido)methyl)benzyl)-N-(3-borono-5-fluorobenzoyl)glycine (DS09);

N-(3-((3-borono-5-fluorobenzamido)methyl)benzyl)-N-(3-borono-5-fluorobenzoyl)glycine (DS10);

N-(2-(3-borono-5-fluorobenzamido)cyclohexyl)-N-(3-borono-5-fluorobenzoyl)glycine (DS11);

N-(3-(3-borono-4-fluorobenzamido)propyl)-N-(3-borono-4-fluorobenzoyl)glycine (DS12);

N-(4-((4-(3-borono-4-fluorobenzamido)cyclohexyl)methyl) cyclohexyl)-N-(3-borono-4-fluorobenzoyl)glycine (DS13);

N-(3-(3-borono-4-fluorobenzamido)-2,2-dimethylpropyl)-N-(3-borono-4-fluorobenzoyl)glycine (DS14);

N-(4-((3-borono-4-fluorobenzamido)methyl)benzyl)-N-(3-borono-4-fluorobenzoyl)glycine (DS15);

N-(3-((3-borono-4-fluorobenzamido)methyl)benzyl)-N-(3-borono-4-fluorobenzoyl)glycine (DS16);

N-((1S,2R)-2-(3-borono-4-fluorobenzamido)cyclohexyl)-N-(3-borono-4-fluorobenzoyl)glycine (DS17);

N-((1S,2S)-2-(3-borono-4-fluorobenzamido)cyclohexyl)-N-(3-borono-4-fluorobenzoyl)glycine (DS18);

N-(3-(3-borono-5-bromobenzamido)propyl)-N-(3-borono-5-bromobenzoyl)glycine (DS19);

N-(4-((4-(3-borono-5-bromobenzamido)cyclohexyl) methyl)cyclohexyl)-N-(3-borono-5-bromobenzoyl)glycine (DS20);

bis(3-(3-borono-5-bromobenzamido)propyl)glycine (DS21);

N-(4-((3-borono-5-bromobenzamido)methyl)benzyl)-N-(3-borono-5-bromobenzoyl)glycine (DS22);

N-(3-((3-borono-5-bromobenzamido)methyl)benzyl)-N-(3-borono-5-bromobenzoyl)glycine (DS23);

N-(2-(3-borono-5-bromobenzamido)cyclohexyl)-N-(3-borono-5-bromobenzoyl)glycine (DS24);

N-(3-(4-borono-3-fluorobenzamido)propyl)-N-(4-borono-3-fluorobenzoyl)glycine (DS25);

N-(4-((4-(4-borono-3-fluorobenzamido)cyclohexyl)methyl)cyclohexyl)-N-(4-borono-3-fluorobenzoyl)glycine (DS26);

N-(3-(4-borono-3-fluorobenzamido)-2,2-dimethylpropyl)-N-(4-borono-3-fluorobenzoyl)glycine (DS27);

bis(3-(4-borono-3-fluorobenzamido)propyl)glycine (DS28);

N-(4-((4-borono-3-fluorobenzamido)methyl)benzyl)-N-(4-borono-3-fluorobenzoyl)glycine (DS29);

N-(3-((4-borono-3-fluorobenzamido)methyl)benzyl)-N-(4-borono-3-fluorobenzoyl)glycine (DS30);

N-((1S,2R)-2-(4-borono-3-fluorobenzamido)cyclohexyl)-N-(4-borono-3-fluorobenzoyl)glycine (DS31);

N-(1-hydroxy-1,3-dihydrobenzo[c][1,2]oxaborole-6-carbonyl)-N-(3-(1-hydroxy-1,3-dihydrobenzo[c][1,2]oxaborole-6-carboxamido)propyl)glycine (DS32);

N-(1-hydroxy-1,3-dihydrobenzo[c][1,2]oxaborole-6-carbonyl)-N-(5-(1-hydroxy-1,3-dihydrobenzo[c][1,2]oxaborole-6-carboxamido)pentyl)glycine (DS33);

N-(1-hydroxy-1,3-dihydrobenzo[c][1,2]oxaborole-6-carbonyl)-N-(3-(1-hydroxy-1,3-dihydrobenzo[c][1,2]oxaborole-6-carboxamido)-2,2-dimethylpropyl)glycine (DS34);

bis(3-(1-hydroxy-1,3-dihydrobenzo[c][1,2]oxaborole-6-carboxamido)propyl)glycine (DS35);

N-(1-hydroxy-1,3-dihydrobenzo[c][1,2]oxaborole-6-carbonyl)-N-(3-((1-hydroxy-1,3-dihydrobenzo[c][1,2]oxaborole-6-carboxamido)methyl)benzyl)glycine (DS36);

N-(1-hydroxy-1,3-dihydrobenzo[c][1,2]oxaborole-6-carbonyl)-N-((1S,2R)-2-(1-hydroxy-1,3-dihydrobenzo[c][1,2]oxaborole-6-carboxamido)cyclohexyl)glycine (DS37);

N-(1-hydroxy-1,3-dihydrobenzo[c][1,2]oxaborole-6-carbonyl)-N-(4-(1-hydroxy-1,3-dihydrobenzo[c][1,2]oxaborole-6-carboxamido)butyl)glycine (DS38);

N-(1-hydroxy-1,3-dihydrobenzo[c][1,2]oxaborole-6-carbonyl)-N-((1S,2S)-2-(1-hydroxy-1,3-dihydrobenzo[c][1,2]oxaborole-6-carboxamido)cyclohexyl)glycine (DS39);

(R)—N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)propyl)glycine (DS40);

(S)—N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)propyl)glycine (DS41);

N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)cyclohexyl)glycine (DS42);

N-(3-(4-borono-3,5-difluorobenzamido)propyl)-N-(4-borono-3,5-difluorobenzoyl)glycine (DS43);

N-(3-(4-borono-2-fluorobenzamido)propyl)-N-(4-borono-2-fluorobenzoyl)glycine (DS44);

N-(2-(N-ethyl-1-hydroxy-1,3-dihydrobenzo[c][1,2]oxaborole-6-carboxamido)ethyl)-N-(1-hydroxy-1,3-dihydrobenzo[c][1,2]oxaborole-6-carbonyl)glycine (DS45);

N-(1-hydroxy-1,3-dihydrobenzo[c][1,2]oxaborole-6-carbonyl)-N-(2-(1-hydroxy-N-(2-hydroxyethyl)-1,3-dihydrobenzo[c][1,2]oxaborole-6-carboxamido)ethyl)glycine (DS46);

N-(1-hydroxy-1,3-dihydrobenzo[c][1,2]oxaborole-6-carbonyl)-N-(5-(1-hydroxy-1,3-dihydrobenzo[c][1,2]oxaborole-6-carboxamido)hexyl)glycine (DS47);

N-(1-hydroxy-1,3-dihydrobenzo[c][1,2]oxaborole-6-carbonyl)-N-(4-((4-(1-hydroxy-1,3-dihydrobenzo[c][1,2]oxaborole-6-carboxamido)cyclohexyl)methyl)cyclohexyl)glycine (DS48);

((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)glycine (DS49);

((2S,4S)-4-(3-borono-4-fluorobenzamido)-1-(3-borono-4-fluorobenzoyl)pyrrolidine-2-carbonyl)glycine (DS50);

((2S,4S)-4-(3-borono-5-nitrobenzamido)-1-(3-borono-5-nitrobenzoyl)pyrrolidine-2-carbonyl)glycine (DS51);

((2S,4S)-4-(5-borono-2-fluorobenzamido)-1-(5-borono-2-fluorobenzoyl)pyrrolidine-2-carbonyl)glycine (DS52);

(S)-(1,4-bis(1-hydroxy-1,3-dihydrobenzo[c][1,2]oxaborole-6-carbonyl)piperazine-2-carbonyl)glycine (DS53);

(S)—N-(3-amino-2-(1-hydroxy-1,3-dihydrobenzo[c][1,2]oxaborole-6-carboxamido-3-oxopropyl)-N-benzyl-1-hydroxy-1,3-dihydrobenzo[c][1,2]oxaborole-6-carboxamide (DS54);

(S)—N-(3-amino-2-(1-hydroxy-1,3-dihydrobenzo[c][1,2]oxaborole-6-carboxamido)-3-oxopropyl)-1-hydroxy-N-(4-(trifluoromethyl)benzyl)-1,3-dihydrobenzo[c][1,2]oxaborole-6-carboxamide (DS55);

(S)—N-(3-amino-2-(1-hydroxy-1,3-dihydrobenzo[c][1,2]oxaborole-6-carboxamido)-3-oxopropyl)-N-ethyl-1-hydroxy-1,3-dihydrobenzo[c][1,2]oxaborole-6-carboxamide (DS56);

(S)—N-(3-amino-2-(1-hydroxy-1,3-dihydrobenzo[c][1,2]oxaborole-6-carboxamido)-3-oxopropyl)-1-hydroxy-N-propyl-1,3-dihydrobenzo[c][1,2]oxaborole-6-carboxamide (DS57);

(S)—N-(3-amino-2-(1-hydroxy-1,3-dihydrobenzo[c][1,2]oxaborole-6-carboxamido)-3-oxopropyl)-1-hydroxy-N-isobutyl-1,3-dihydrobenzo[c][1,2]oxaborole-6-carboxamide (DS58);

(S)—N-(3-amino-2-(1-hydroxy-1,3-dihydrobenzo[c][1,2]oxaborole-6-carboxamido)-3-oxopropyl)-1-hydroxy-N-((5-(thiophen-2-yl)pyridin-2-yl)methyl)-1,3-dihydrobenzo[c][1,2]oxaborole-6-carboxamide (DS59);

(S)—N-(3-amino-2-(1-hydroxy-1,3-dihydrobenzo[c][1,2]oxaborole-6-carboxamido)-3-oxopropyl)-1-hydroxy-N-isopentyl-1,3-dihydrobenzo[c][1,2]oxaborole-6-carboxamide (DS60);

(S)—N-(3-amino-2-(1-hydroxy-1,3-dihydrobenzo[c][1,2]oxaborole-6-carboxamido)-3-oxopropyl)-1-hydroxy-N-(quinolin-5-ylmethyl)-1,3-dihydrobenzo[c][1,2]oxaborole-6-carboxamide (DS61);

(S)—N-(3-amino-2-(1-hydroxy-1,3-dihydrobenzo[c][1,2]oxaborole-6-carboxamido)-3-oxopropyl)-1-hydroxy-N-(2-(trifluoromethoxy)benzyl)-1,3-dihydrobenzo[c][1,2]oxaborole-6-carboxamide (DS62);

(S)—N-(3-amino-2-(1-hydroxy-1,3-dihydrobenzo[c][1,2]oxaborole-6-carboxamido)-3-oxopropyl)-1-hydroxy-N-(4-(methylsulfonyl)benzyl)-1,3-dihydrobenzo[c][1,2]oxaborole-6-carboxamide (DS63);

(3-((2S,4S)-4-(5-borono-2-(methylsulfonyl)benzamido)-2-carbamoylpyrrolidine-1-carbonyl)-4-(methylsulfonyl)phenyl)boronic acid (DS64);

(4-(((3S,5S)-1-(4-borono-2,6-difluorobenzoyl)-5-carbamoylpyrrolidin-3-yl)carbamoyl)-3,5-difluorophenyl)boronic acid (DS65);

(R,E)-4,5-bis(1-hydroxy-1,3-dihydrobenzo[c][1,2]oxaborole-6-carboxanido)pent-2-enoic acid (DS66);

(2S,4S)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carboxamide (DS67);

N,N'-((2S,3S)-1-amino-1-oxobutane-2,3-diyl)bis(1-hydroxy-1,3-dihydrobenzo[c][1,2]oxaborole-6-carboxamide) (DS68);

(R)-3,4-bis(1-hydroxy-1,3-dihydrobenzo[c][1,2]oxaborole-6-carboxamido)butanoic acid (DS69);

3-((2S,4S)-1-(1-hydroxy-1,3-dihydrobenzo[c][1,2]oxa-
borole-6-carbonyl)-4-(1-hydroxy-1,3-dihydrobenzo[c][1,
2]oxaborole-6-carboxamido)pyrrolidine-2-carboxamido)
propanoic acid (DS70);

(S)-3-(1-hydroxy-1,3-dihydrobenzo[c][1,2]oxaborole-5-
carboxamido)-4-(1-hydroxy-1,3-dihydrobenzo[c][1,2]
oxaborole-6-carboxamido)butanoic acid (DS71);

(R)-4-(1-hydroxy-1,3-dihydrobenzo[c][1,2]oxaborole-5-
carboxamido)-5-(1-hydroxy-1,3-dihydrobenzo[c][1,2]
oxaborole-6-carboxamido)pentanoic acid (DS72);

(2S,4R)-1-(1-hydroxy-1,3-dihydrobenzo[c][1,2]oxaborole-
6-carbonyl)-4-(1-hydroxy-1,3-dihydrobenzo[c][1,2]oxa-
borole-6-carboxamido)pyrrolidine-2-carboxylic    acid
(DS73);

(2S,4R)-1-(1-hydroxy-4-(trifluoromethyl)-1,3-dihyd-
robenzo[c][1,2]oxaborole-6-carbonyl)-4-(1-hydroxy-4-
(trifluoromethyl)-1,3-dihydrobenzo[c][1,2]oxaborole-6-
carboxamido)pyrrolidine-2-carboxylic acid (DS74);

(2S,3S)-3-(1-hydroxy-4-(trifluoromethyl)-1,3-dihyd-
robenzo[c][1,2]oxaborole-6-carboxamido)-2-(1-hydroxy-
7-(trifluoromethyl)-1,3-dihydrobenzo[c][1,2]oxaborole-
5-carboxamido)butanoic acid (DS75);

(R)-5-(1-hydroxy-4-(trifluoromethyl)-1,3-dihydrobenzo[c]
[1,2]oxaborole-6-carboxamido)-4-(1-hydroxy-7-(trifluo-
romethyl)-1,3-dihydrobenzo[c][1,2]oxaborole-5-carbox-
amido)pentanoic acid (DS76);

((2S,4S)-1-(5-borono-2-nitrobenzoyl)-4-(1-hydroxy-1,3-di-
hydrobenzo[c][1,2]oxaborole-6-carboxamido)pyrroli-
dine-2-carbonyl)glycine (DS77);

((2S,4S)-1-(5-borono-2-(methylsulfonyl)benzoyl)-4-(1-hy-
droxy-1,3-dihydrobenzo[c][1,2]oxaborole-6-carbox-
amido)pyrrolidine-2-carbonyl)glycine (DS78);

((2S,4S)-1-(3-borono-2,6-difluorobenzoyl)-4-(1-hydroxy-1,
3-dihydrobenzo[c][1,2]oxaborole-6-carboxamido)pyrro-
lidine-2-carbonyl)glycine (DS79);

(S)-(3-(3-borono-4-fluorobenzyl)(5,6-diamino-6-oxo-
hexyl)carbamoyl)-5-nitrophenyl)boronic acid (DS80);

(S)-(3-((4-borono-3,5-difluorobenzyl)(5,6-diamino-6-oxo-
hexyl)carbamoyl)-5-nitrophenyl)boronic acid (DS81);

(S)-(3-((3-boronobenzyl)(5,6-diamino-6-oxohexyl)carbam-
oyl)-5-nitrophenyl)boronic acid (DS82);

(S)-(3-((4-borono-2-methoxybenzyl)(5,6-diamino-6-oxo-
hexyl)carbamoyl)-5-nitrophenyl)boronic acid (DS83);

(S)-(3-((4-borono-2-(trifluoromethyl)benzyl)(5,6-diamino-
6-oxohexyl)carbamoyl)-5-nitrophenyl)boronic    acid
(DS84);

(S)-(5-((3-borono-N-(5,6-diamino-6-oxohexyl)-4-fluo-
robenzamido)methyl)-2-fluorophenyl)boronic    acid
(DS85);

(S)-(5-((4-borono-3,5-difluorobenzyl)(5,6-diamino-6-oxo-
hexyl)carbamoyl)-2-fluorophenyl)boronic acid (DS86);

(S)-(3-((3-borono-N-(5,6-diamino-6-oxohexyl)-4-fluo-
robenzamido)methyl) phenyl)boronic acid (DS87);

(S)-(5-((4-borono-2-methoxybenzyl)(5,6-diamino-6-oxo-
hexyl)carbamoyl)-2-fluorophenyl)boronic acid (DS88);

(S)-(5-((4-borono-3-(trifluoromethyl)benzyl)(5,6-diamino-
6-oxohexyl)carbamoyl)-2-fluorophenyl)boronic    acid
(DS89);

(S)-(4-((3-borono-4-fluorobenzyl)(5,6-diamino-6-oxo-
hexyl)carbamoyl)-2-fluorophenyl)boronic acid (DS90);

(S)-(4-((4-borono-3,5-difluorobenzyl)(5,6-diamino-6-oxo-
hexyl)carbamoyl)-2-fluorophenyl)boronic acid (DS91);

(S)-(4-((3-boronobenzyl)(5,6-diamino-6-oxohexyl)carbam-
oyl)-2-fluorophenyl)boronic acid (DS92);

(S)-(4-((4-borono-2-methoxybenzyl)(5,6-diamino-6-oxo-
hexyl)carbamoyl)-2-fluorophenyl)boronic acid (DS93);

(S)-(4-((4-borono-2-(trifluoromethyl)benzyl)(5,6-diamino-
6-oxohexyl)carbamoyl)-2-fluorophenyl)boronic    acid
(DS94);

(S)-(5-((3-borono-5-bromo-N-(5,6-diamino-6-oxohexyl)
benzamido)methyl)-2-fluorophenyl)boronic acid (DS95);

(S)-(3-((4-borono-3,5-difluorobenzyl)(5,6-diamino-6-oxo-
hexyl)carbamoyl)-5-bromophenyl)boronic acid (DS96);

(S)-(3-((3-borono-5-bromo-N-(5,6-diamino-6-oxohexyl)
benzamido)methyl) phenyl)boronic acid (DS97);

(S)-(3-((3-borono-5-bromo-N-(5,6-diamino-6-oxohexyl)
benzamido)methyl)-5-methoxyphenyl)boronic    acid
(DS98);

(S)-(3-((4-borono-2-(trifluoromethyl)benzyl)(5,6-diamino-
6-oxohexyl)carbamoyl)-5-bromophenyl)boronic    acid
(DS99);

(S)-(3-((3-borono-4-fluorobenzyl)(5,6-diamino-6-oxo-
hexyl)carbamoyl)-5-fluorophenyl)boronic acid (DS100);

(S)-(3-((4-borono-3-methoxybenzyl)(5,6-diamino-6-oxo-
hexyl)carbamoyl)-5-fluorophenyl)boronic acid (DS101);

(S)-(3-((4-borono-2-(trifluoromethyl)benzyl)(5,6-diamino-
6-oxohexyl)carbamoyl)-5-fluorophenyl)boronic    acid
(DS102);

(S)-(4-((N-(5,6-diamino-6-oxohexyl)-1-hydroxy-1,3-dihyd-
robenzo[c][1,2]oxaborole-6-carboxamido)methyl)-2-
fluorophenyl)boronic acid (DS103);

(S)-(4-((N-(5,6-diamino-6-oxohexyl)-1-hydroxy-1,3-dihyd-
robenzo[c][1,2]oxaborole-6-carboxamido)methyl)-2,6-
difluorophenyl)boronic acid (DS104);

(S)-(3-((N-(5,6-diamino-6-oxohexyl)-1-hydroxy-1,3-dihyd-
robenzo[c][1,2]oxaborole-6-carboxamido)methyl)phe-
nyl)boronic acid (DS105);

(S)-(4-((N-(5,6-diamino-6-oxohexyl)-1-hydroxy-1,3-dihyd-
robenzo[c][1,2]oxaborole-6-carboxamido)methyl)-3-
methoxyphenyl)boronic acid (DS106);

(S)—N-(5,6-diamino-6-oxohexyl)-1-hydroxy-N-((1-hy-
droxy-1,3-dihydrobenzo[c][1,2]oxaborol-6-yl)methyl)-1,
3-dihydrobenzo[c][1,2]oxaborole-6-carboxamide
(DS107);

(S)—N-(4-amino-3-(1-hydroxy-1,3-dihydrobenzo[c][1,2]
oxaborole-6-carboxamido-4-oxobutyl)-1-hydroxy-N-
((1-hydroxy-1,3-dihydrobenzo[c][1,2]oxaborol-6-yl)
methyl)-1,3-dihydrobenzo[c][1,2]oxaborole-6-
carboxamide (DS108);

(S)—N-(6-amino-5-(1-hydroxy-1,3-dihydrobenzo[c][1,2]
oxaborole-6-carboxamido)-6-oxohexyl)-1-hydroxy-N-
((1-hydroxy-1,3-dihydrobenzo[c][1,2]oxaborol-6-yl)
methyl)-1,3-dihydrobenzo[c][1,2]oxaborole-6-
carboxamide (DS109);

(2S,4S)-1-(1-hydroxy-1,3-dihydrobenzo[c][1,2]oxaborole-
6-carbonyl)-4-(1-hydroxy-1,3-dihydrobenzo[c][1,2]oxa-
borole-6-carboxamido)pyrrolidine-2-carboxylic    acid
(DS110);

(2S,3S)-2-(1-hydroxy-1,3-dihydrobenzo[c][1,2]oxaborole-
5-carboxamido)-3-(1'-hydroxy-1,3-dihydrobenzo[c][1,2]
oxaborole-6-carboxamido)butanoic acid (DS111); and (2S,4R)-1-(1-hydroxy-1,3-dihydrobenzo[c][1,2]oxaborole-
6-carbonyl)-4-(1-hydroxy-1,3-dihydrobenzo[c][1,2]oxa-
borole-6-carboxamido)pyrrolidine-2-carboxylic    acid
(DS112);

N-(1-hydroxy-3,3-dimethyl-1,3-dihydrobenzo[c][1,2]oxa-
borole-6-carbonyl)-N-(2-(1-hydroxy-3,3-dimethyl-1,3-
dihydrobenzo[c][1,2]oxaborole-6-carboxanido)ethyl)gly-
cine (DS113);

N-(1-hydroxy-3,4-dihydro-1H-benzo[c][1,2]oxaborinine-7-
carbonyl)-N-(2-(1-hydroxy-3,4-dihydro-1H-benzo[c][1,
2]oxaborinine-7-carboxamido)ethyl)glycine (DS114);

N-(2-(2-(1-hydroxy-1,3-dihydrobenzo[c][1,2]oxaborol-7-yl)acetamido)ethyl)-N-(2-(1-hydroxy-1,3-dihydrobenzo[c][1,2]oxaborol-7-yl)acetyl)glycine (DS115);

N-(1-hydroxy-3,3-dimethyl-1,3-dihydrobenzo[c][1,2]oxaborole-7-carbonyl)-N-(2-(1-hydroxy-3,3-dimethyl-1,3-dihydrobenzo[c][1,2]oxaborole-7-carboxamido)ethyl) glycine (DS116);

N-(1-hydroxy-1,3-dihydrobenzo[c][1,2]oxaborole-3-carbonyl)-N-(2-(1-hydroxy-1,3-dihydrobenzo[c][1,2]oxaborole-3-carboxamido)ethyl)glycine (DS117);

3,5-bis((1-hydroxy-3,3-dimethyl-1,3-dihydrobenzo[c][1,2]oxaborole-6-carboxamido)methyl)benzoic acid (DS118);

3,5-bis((1-hydroxy-3,4-dihydro-1H-benzo[c][1,2]oxaborinine-7-carboxamido) methyl)benzoic acid (DS119);

3,5-bis((2-(1-hydroxy-1,3-dihydrobenzo[c][1,2]oxaborol-7-yl)acetamido)methyl) benzoic acid (DS120);

3,5-bis((1-hydroxy-3,3-dimethyl-1,3-dihydrobenzo[c][1,2]oxaborole-7-carboxamido)methyl) benzoic acid (DS121);

3,5-bis((1-hydroxy-1,3-dihydrobenzo[c][1,2]oxaborole-3-carboxamido)methyl)benzoic acid (DS122);

(S)-3-(2,3-bis(1-hydroxy-3,3-dimethyl-1,3-dihydrobenzo[c][1,2]oxaborole-6-carboxamido) propanamido)propanoic acid (DS123);

(S)-3-(2,3-bis(1-hydroxy-3,4-dihydro-1H-benzo[c][1,2]oxaborinine-7-carboxamido) propanamido)propanoic acid (DS124);

(S)-3-(2,3-bis(2-(1-hydroxy-1,3-dihydrobenzo[c][1,2]oxaborol-7-yl)acetamido) propanamido)propanoic acid (DS125);

(S)-3-(2,3-bis(1-hydroxy-3,3-dimethyl-1,3-dihydrobenzo[c][1,2]oxaborole-7-carboxamido) propanamido)propanoic acid (DS126);

3-((2S)-2,3-bis(1-hydroxy-1,3-dihydrobenzo[c][1,2]oxaborole-3-carboxamido) propanamido)propanoic acid (DS127);

(3,5-bis((1-hydroxy-3,3-dimethyl-1,3-dihydrobenzo[c][1,2]oxaborole-6-carboxamido) methyl)benzoyl)glutamic acid (DS128);

(3,5-bis((1-hydroxy-3,4-dihydro-1H-benzo[c][1,2]oxaborinine-7-carboxamido) methyl)benzoyl)glutamic acid (DS129);

(3,5-bis((2-(1-hydroxy-1,3-dihydrobenzo[c][1,2]oxaborol-7-yl)acetamido)methyl)benzoyl) glutamic acid (DS130);

(3,5-bis((1-hydroxy-3,3-dimethyl-1,3-dihydrobenzo[c][1,2]oxaborole-7-carboxamido)methyl) benzoyl)glutamic acid (DS131);

(3,5-bis((1-hydroxy-1,3-dihydrobenzo[c][1,2]oxaborole-3-carboxamido)methyl)benzoyl) glutamic acid (DS132);

4-(3,4-bis(1-hydroxy-3,3-dimethyl-1,3-dihydrobenzo[c][1,2]oxaborole-6-carboxamido) pyrrolidin-1-yl)-4-oxobutanoic acid (DS133);

4-(3,4-bis(1-hydroxy-3,4-dihydro-1H-benzo[c][1,2]oxaborinine-7-carboxamido)pyrrolidin-1-yl)-4-oxobutanoic acid (DS134);

4-(3,4-bis(2-(1-hydroxy-1,3-dihydrobenzo[c][1,2]oxaborol-7-yl)acetamido)pyrrolidin-1-yl)-4-oxobutanoic acid (DS135);

4-(3,4-bis(1-hydroxy-3,3-dimethyl-1,3-dihydrobenzo[c][1,2]oxaborole-7-carboxamido)pyrrolidin-1-yl)-4-oxobutanoic acid (DS136);

4-(3,4-bis(1-hydroxy-1,3-dihydrobenzo[c][1,2]oxaborole-3-carboxamido)pyrrolidin-1-yl)-4-oxobutanoic acid (DS137);

((S)-2,3-bis(1-hydroxy-3,3-dimethyl-1,3-dihydrobenzo[c][1,2]oxaborole-6-carboxamido)propanoyl)-L-glutamic acid (DS138);

((S)-2,3-bis(1-hydroxy-3,4-dihydro-1H-benzo[c][1,2]oxaborinine-7-carboxamido) propanoyl)-L-glutamic acid (DS139);

((S)-2,3-bis(2-(1-hydroxy-1,3-dihydrobenzo[c][1,2]oxaborol-7-yl)acetamido)propanoyl)-L-glutamic acid (DS140);

((S)-2,3-bis(1-hydroxy-3,3-dimethyl-1,3-dihydrobenzo[c][1,2]oxaborole-7-carboxamido) propanoyl)-L-glutamic acid (DS141);

((2S)-2,3-bis(1-hydroxy-1,3-dihydrobenzo[c][1,2]oxaborole-3-carboxamido) propanoyl)-L-glutamic acid (DS142);

(4-(3,4-bis(1-hydroxy-3,3-dimethyl-1,3-dihydrobenzo[c][1,2]oxaborole-6-carboxamido)pyrrolidin-1-yl)-4-oxobutanoyl)-L-glutamic acid (DS143);

(4-(3,4-bis(1-hydroxy-3,4-dihydro-1H-benzo[c][1,2]oxaborinine-7-carboxamido) pyrrolidin-1-yl)-4-oxobutanoyl)-L-glutamic acid (DS144);

(4-(3,4-bis(2-(1-hydroxy-1,3-dihydrobenzo[c][1,2]oxaborol-7-yl)acetamido)pyrrolidin-1-yl)-4-oxobutanoyl)-L-glutamic acid (DS145);

(4-(3,4-bis(1-hydroxy-3,3-dimethyl-1,3-dihydrobenzo[c][1,2]oxaborole-7-carboxamido) pyrrolidin-1-yl)-4-oxobutanoyl)-L-glutamic acid (DS146);

(4-(3,4-bis(1-hydroxy-1,3-dihydrobenzo[c][1,2]oxaborole-3-carboxamido)pyrrolidin-1-yl)-4-oxobutanoyl)-L-glutamic acid (DS147);

(S)-2,3-bis(1-hydroxy-3,3-dimethyl-1,3-dihydrobenzo[c][1,2]oxaborole-6-carboxamido)propanoic acid (DS148);

(S)-2,3-bis(1-hydroxy-3,4-dihydro-1H-benzo[c][1,2]oxaborinine-7-carboxamido)propanoic acid (DS149);

(S)-2,3-bis(2-(1-hydroxy-1,3-dihydrobenzo[c][1,2]oxaborol-7-yl)acetamido)propanoic acid (DS150);

(S)-2,3-bis(1-hydroxy-3,3-dimethyl-1,3-dihydrobenzo[c][1,2]oxaborole-7-carboxamido)propanoic acid (DS151); and (2S)-2,3-bis(1-hydroxy-1,3-dihydrobenzo[c][1,2]oxaborole-3-carboxamido)propanoic acid (DS152). In some embodiments, the compound of Formula (I) is selected from:

$$\left( (Z1c)_{\overline{p'}}(Z1a)_{\overline{m'}} \right)_{q'} X1; \qquad \text{(Formula IA)}$$

$$\left[ Z1c{-}(Z1b)_{\overline{n'}} \right]_{q'} X1; \qquad \text{(Formula IB)}$$

$$\left( (Z1c)_{\overline{p'}}(Z1b)_{\overline{n'}} \right)_{q'} X1; \quad \text{and} \qquad \text{(Formula IC)}$$

$$\left( (Z1c)_{\overline{p'}} \right)_{q'} X1. \qquad \text{(Formula ID)}$$

In some embodiments, the compound of Formula I is selected from:

$$\left[ [Z1c]_1 \right]_1 X1; \quad \left[ [Z1c]_1 \right]_2 X1; \quad \left[ [Z1c]_1 \right]_3 X1; \quad \left[ [Z1c]_1 \right]_4 X1;$$

$$\left[ [Z1c]_1 \right]_5 X1; \quad \left[ [Z1c]_2{-}[Z1a]_1 \right]_2 X1;$$

$$\left[ [Z1c]_2{-}[Z1a]_1 \right]_2 X1{-}[Z1c]_1 \right]_1;$$

$$\left[ [Z1c]_2{-}[Z1a]_1 \right]_2 X1{-}[Z1c]_1 \right]_2;$$

-continued $$\left[[Z1c]_2 {-\!\!-\!} [Z1a]_1\!\!\mid\!\!_1\!\!\mid\!\!_1\!\!+\!\![Z1b]_1\!\mid\!\!_1\!\!\mid\!\!_1 {-\!} X1;\right.$$

$$\left[[Z1c]_2 {-\!\!-\!} [Z1a]_1 {-\!} [Z1b]_1\!\!\mid\!\!_1 {-\!} X1 {-\!}[Z1c]_1\right]_1;$$

$$\left[[Z1c]_1 {-\!\!-\!} [Z1b]_1\!\!\mid\!\!_1 {-\!} X1;\right. \quad \left[[Z1c]_2 {-\!\!-\!} [Z1a]_1\!\!\mid\!\!_1 {-\!} X1 {-\!}[Z1c]_1\right];$$

$$\left[[Z1c]_2 {-\!\!-\!} [Z1a]_1\!\!\mid\!\!_1 {-\!} X1 {-\!}[Z1c]_1\right]_2; \quad \text{and}$$

$$\left[[Z1c]_2 {-\!\!-\!} [Z1a]_1\!\!\mid\!\!_1 {-\!} X1 {-\!}[Z1c]_1\right]_2$$

In some embodiments, the compound is selected from $$\left[[Z1c]_2 {-\!\!-\!} [Z1a]_1\!\!\mid\!\!_1 {-\!} X1 {-\!}[Z1c]_1\right]_1 \quad \text{and} \quad \left[[Z1c]_1\!\!\mid\!\!_1 {-\!} X1.\right.$$

In some embodiments, the compound of Formula I is selected from:

$$\left[[Z1c]_1 {-\!}\boxed{\begin{matrix}\text{indirect}\\\text{linker}\end{matrix}}\!\mid\!\!_1 {-\!} X1;\right. \quad \left[\left[[Z1c]_1 {-\!}\boxed{\begin{matrix}\text{indirect}\\\text{linker}\end{matrix}}\!\mid\!\!_1 {-\!} Z1a {-\!} X1;\right.\right.$$

$$\left[\left[[Z1c]_1 {-\!}\boxed{\begin{matrix}\text{indirect}\\\text{linker}\end{matrix}}\!\mid\!\!_1 {-\!} Z1a {-\!} X1;\right]_2\right.$$

$$\left[\left[[Z1c]_1 {-\!}\boxed{\begin{matrix}\text{indirect}\\\text{linker}\end{matrix}}\!\mid\!\!_1 {-\!} Z1a\right]_2 {-\!} X1 {-\!}\boxed{\begin{matrix}\text{indirect}\\\text{linker}\end{matrix}} {-\![Z1c]_1}\right]_1; \quad \text{and}$$

$$\left[\left[[Z1c]_1 {-\!}\boxed{\begin{matrix}\text{indirect}\\\text{linker}\end{matrix}}\!\mid\!\!_1 {-\!} Z1a\right]_2 {-\!} X1 {-\!}\boxed{\begin{matrix}\text{indirect}\\\text{linker}\end{matrix}} {-\![Z1c]_1}\right]_2.$$

In some embodiments, the compound is $$\left[[Z1c]_1\!\!\mid\!\!_1 {-\!} X1,\right.$$

when p'=1, m'=0, o'=1, n'=0, and q'=1.

In some embodiments, the compound is $$\left[[Z1c]_2 {-\!\!-\!} [Z1a]_1\!\!\mid\!\!_2 {-\!} X1 {-\!}[Z1c]_1\right]_1,$$

when p'=1 and 2, m'=0 and 1, o'=1 and 1, n'=0, and q'=2 and 1.

In some embodiments, the present disclosure is directed to a compound comprising one or more diboronates, wherein the compound is represented by Formula IB, or a stereoisomer or a mixture of stereoisomers, or pharmaceutically acceptable salt thereof:

(Formula IB)

$$\left[Z1c {-\!}(Z1b)_{n'}\!\!\mid\!\!\right]_{q'} {-\!} X1\right.\!_{c,}$$

wherein:

each Z1b is independently a linker moiety, and each n' is 0, 1, 2, 3, 4, or 5;

X1 comprises a drug substance or a polypeptide;

each Z1c is covalently conjugated directly or via one or more Z1b to an amine in X1;

wherein a) at least one Z1c is independently selected from a diboronate, wherein the diboronate is independently selected from Formulae FF12A, FF12B, FF12C, FF12D, FF116A, FF116B, FF116C, FF116D, FF225, and FF227; and b) each additional Z1c is optionally independently selected from a diboronate, a sugar moiety, a diol containing moiety, and a polyol containing moiety, wherein the diboronate is independently selected from Formulae FF12A, FF12B, FF12C, FF12D, FF116A, FF116B, FF116C, FF116D, FF225, and FF227; and each q' is 1, 2, 3, 4, or 5, wherein when q' is 2 or more, each corresponding Z1c and Z1b is independently selected and may be the same or different; and wherein Formulae FF12A, FF12B, FF12C, FF12D, FF116A, FF116B, FF116C, FF116D, FF225, and FF227 are:

FF12A

FF12B

FF12C

FF12D

FF116A

FF116B

-continued

FF116C

FF116D

FF225

FF227 wherein X represents a point of covalent attachment to an amine of Z1b or to an amine of X1 when n' is 0;

i is 1, 2, 3, 4, 5, 6, or 7; and wherein $B_1$ and $B_2$, which may be identical or different, each independently represent an aromatic boron-containing group; and wherein when each Z1c is selected from Formulae FF225 and FF227, at least one of the $B_1$ and the $B_2$ is Formula F7, wherein Formula F7 is:

(F7)

wherein:

one $R_1$ represents (C=O)—*, wherein —* represents the attachment point to the rest of Z1c;

each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)$ $NH(CH_2)_mCH_3$, and $OCF_3$, wherein m is 1, 2, 3, 4, 5, 6, or 7;

Y8 is O or NR, wherein R is an alkyl group (e.g., $C_1$-$C_6$alkyl group) or H; and each Y10 is independently selected from H, $CH_3$, F, and $CF_3$, wherein for at least one F7 at least one Y10 is not H.

In some embodiments, each Z1b is independently a linker moiety, and each n' is 0, 1, 2, 3, 4, or 5, wherein at least one n' is 1, 2, 3, 4, or 5. In some embodiments, each n' is 1, 2, 3, 4, or 5. In some embodiments, each n' is 2, 3, or 4.

In some embodiments, the compound is selected from a compound represented by Formula IB, a stereoisomer thereof, a mixture of stereoisomers thereof, and pharmaceutically acceptable salt thereof, with the proviso that the compound is not any of Examples 1-880 disclosed in PCT/US2021/059802.

In some embodiments, the compound is represented by Formula IB, or a stereoisomer or a mixture of stereoisomers, or pharmaceutically acceptable salt thereof:

(Formula IB)

$$\left[ Z1c\text{—}(Z1b)_{n'} \right]_{q'}\text{—}X1,$$

wherein:

each n' is 0, 1, 2, or 3, wherein at least one n' is 1, 2, or 3;

each q' is 1, 2, 3, or 4;

each Z1b is independently a linker moiety, wherein each Z1c is covalently conjugated directly or via one or more of the Z1b to an amine of X1, with the proviso that the Z1b is not a diol containing moiety, and wherein one or more positions of the compound may comprise an isotope.

In some embodiments, each Z1c is covalently conjugated via one or more of the Z1b to an amine of X1, wherein each Z1b is independently selected from Formulae FL3, FL5, FL5A, FL5B, FL65A, FL65B, FL69, FL69A, FL69B, FL70, FL70A, and FL70B;

wherein FL3, FL5, FL5A, FL5B, FL65A, FL65B, FL69, FL69A, FL69B, FL70, FL70A, and FL70B are:

FL3

FL5

FL5A

FL5B

FL65A

-continued

FL65B

FL69

FL69A

FL69B

FL70

FL70A

FL70B wherein:

R″ represents a covalent bond, directly or indirectly, to Z1c;

Z″ represents a covalent bond, directly or indirectly, to X1;

A' is selected from H and a $C_1$- to $C_2$0 alkyl; and

A″ is a $C_2$-$C_{20}$ acyl group optionally terminating in an acid group, wherein one or more carbon atoms of the $C_2$-$C_{20}$ acyl group are optionally and independently replaced by a group selected from C(=O), O, NH, $NH_2$, S, S(O), $SO_2$, phenyl, 5-membered heterocyclyl, 6-membered heterocyclyl, 5-membered heteroaryl, 6-membered heteroaryl, and wherein the $C_2$-$C_{20}$ acyl group, NH, $NH_2$, $SO_2$, phenyl, 5-membered heterocyclyl, 6-membered heterocyclyl, 5-membered heteroaryl, and 6-membered heteroaryl is each independently substituted with 0, 1, 2, 3, or 4 $R_x$, wherein $R_x$ is selected from $C_1$-$C_5$ alkyl, halogen (e.g., F, Cl, Br, I), $C_1$-$C_5$ haloalkyl, carboxylic acid, hydroxyl, —O—$C_1$-$C_5$ alkyl, —S(=O)$_2$NH$_2$, $NH_2$, 5-membered heterocyclyl, 6-membered heterocyclyl, 5-membered heteroaryl, phenyl, and 6-membered heteroaryl;

p is 1, 2, 3, 4, or 5, q is 1, 2, 3, 4, or 5, and any primary amine is optionally acetylated or alkylated.

In some embodiments, A' is H. In some embodiments, A' is a $C_1$- to $C_{20}$ alkyl. In some embodiments, the alkyl group is a CI-Cis alkyl group. In some embodiments, the alkyl group is a $C_1$-$C_{16}$ alkyl group. In some embodiments, the alkyl group is a $C_1$-$C_{14}$ alkyl group. In some embodiments, the alkyl group is a $C_1$-$C_{12}$ alkyl group. In some embodiments, the alkyl group is a $C_1$-$C_{10}$ alkyl group. In some embodiments, the alkyl group is a $C_1$-$C_8$ alkyl group. In some embodiments, the alkyl group is a $C_1$-$C_6$ alkyl group. In some embodiments, the alkyl group is a $C_1$-$C_4$ alkyl group. Exemplary alkyl groups include, but are not limited to, methyl, ethyl, propyl, isopropyl, 2-methyl-1-propyl, 2-methyl-2-propyl, 2-methyl-1-butyl, 3-methyl-1-butyl, 2-methyl-3-butyl, 2,2-dimethyl-1-propyl, 2-methyl-1-pentyl, 3-methyl-1-pentyl, 4-methyl-1-pentyl, 2-methyl-2-pentyl, 3-methyl-2-pentyl, 4-methyl-2-pentyl, 2,2-dimethyl-1-butyl, 3,3-dimethyl-1-butyl, 2-ethyl-1-butyl, butyl, isobutyl, t-butyl, pentyl, isopentyl, neopentyl, hexyl, heptyl, and octyl. In some embodiments, "alkyl" is a straight-chain hydrocarbon. In some embodiments, "alkyl" is a branched hydrocarbon.

In some embodiments, each Z1b is independently selected from:

FL3

FL5B

FL65A

-continued

FL65B

5

10

In some embodiments, each A" is independently selected from:

-continued

FL69A

15

20 wherein:

p is 1, 2, 3, 4, or 5.

In some embodiments, each Z1b is independently selected from:

25

AB-1

AB-2

30

AB-3

35

AB-4

40

AB-5

45

AB-6

50

AB-7

55

AB-8

60

65

305
-continued

306
-continued

AB-9

AB-10

AB-11

AB-12

AB-13

AB-14

AB-15

AB-16

AB-17

AB-18

AB-19

AB-20

AB-21

AB-22

AB-23

AB-24

AB-25

AB-26

AB-27

AB-28

5

10

15

20

25

30

35

40

45

50

55

60

65

-continued

AB-29

AB-30

AB-31

AB-32

AB-33

AB-34

AB-35

AB-36

-continued

AB-37

AB-37A

AB-38

, and

AB-39

In some embodiments, each A″ is independently selected from AB-1, AB-2, AB-3, AB-4, AB-5, AB-7, AB-8, AB-9, AB-10, AB-li, AB-12, AB-13, AB-14, AB-15, AB-16, AB-17, AB-18, AB-19, AB-20, AB-21, AB-22, AB-23, AB-24, AB-25, AB-26, AB-27, AB-28, AB-29, AB-30, AB-31, AB-32, AB-33, AB-34, AB-35, AB-36, AB-37, AB-38, and AB-39. In some embodiments, each A″ is independently selected from AB-1, AB-2, AB-3, AB-4, AB-5, AB-7, AB-8, AB-9, AB-10, AB-11, AB-12, AB-13, and AB-14. In some embodiments, each A″ is independently selected from AB-15, AB-16, AB-17, AB-18, AB-19, AB-20, AB-21, AB-22, AB-23, AB-24, AB-25, AB-26, AB-27, and AB-28.

In some embodiments, $B_1$ and $B_2$ are independently selected from Formulae F2 and F7, wherein Formulae F2 and F7 are:

(F2)

-continued (F7)

wherein:

one $R_1$ represents (C=O)—*, wherein —* represents the attachment point to the rest of Z1c;

each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_m$, $CH_3$, —$(SO_2)NH$—$CH_3$, —$(SO_2)$ $NH(CH_2)_mCH_3$, and $OCF_3$, wherein m is 1, 2, 3, 4, 5, 6, or 7;

Y8 is O, or Y8 is NR, wherein R is an alkyl group (e.g., $C_1$-$C_6$alkyl group) or H; and each Y10 is independently selected from H, $CH_3$, F, and $CF_3$, wherein for at least one F7 at least one Y10 is not H. In some embodiments, the $R_1$ at position 5' represents (C=O)—*, wherein —* represents the attachment point to the rest of Z1c.

In some embodiments, $B_1$ and the $B_2$ are independently represented by Formula F2, wherein Formula F2 is:

(F2)

wherein:

$R_1$ at position 5' represents (C=O)—*, wherein —* represents the attachment point to the rest of Z1c; and each remaining $R_1$ is independently selected from H, F, Cl, Br, OH, $CF_3$, $CHF_2$, $NO_2$, $CH_3$, $OCH_3$, and $OCF_3$.

In some embodiments, $B_1$ and $B_2$ are independently Formula F7, (F7)

wherein:

$R_1$ at position 5' represents (C=O)—*, wherein —* represents the attachment point to the rest of Z1c;

each remaining $R_1$ is independently selected from H, F, Cl, Br, OH, $CF_3$, $CHF_2$, $NO_2$, $CH_3$, $OCH_3$, and $OCF_3$;

Y8 is O or NR, wherein R is an alkyl group (e.g., $C_1$-$C_6$alkyl group) or H; and each Y10 is independently selected from H, $CH_3$, F, and $CF_3$, wherein for at least one F7 at least one Y10 is not H.

In some embodiments, $B_1$ and $B_2$ are independently Formula F7A, (F7A)

wherein:

$R_1$ at position 5' represents (C=O)—*, wherein —* represents the attachment point to the rest of Z1c; and each remaining $R_1$ is independently selected from H, F, Cl, Br, OH, $CF_3$, $CHF_2$, $NO_2$, $CH_3$, $OCH_3$, and $OCF_3$.

In some embodiments, at least one diboronate is F7 and wherein Y8 is 0 and each Y10 is CH3. In some embodiments, each remaining $R_1$ is independently selected from (a) H, $CF_3$, and F; or (b) two remaining $R_1$ are H and one remaining $R_1$ is $CF_3$ or F. In some embodiments, at least one $R_1$ in the $B_1$ or the $B_2$ is F or $CF_3$. In some embodiments, each remaining $R_1$ is H.

In some embodiments, the compound is represented by Formula IE, or a stereoisomer or a mixture of stereoisomers, or pharmaceutically acceptable salt thereof:

(Formula IE)

$$[Z1c\!-\!Z1b1\!-\!Z1b2\!\overset{}{]}_{q'}\!-\!X_1$$

wherein:

q' is 2, 3, or 4;

each corresponding Z1c and Z1b1 is independently selected and may be the same or different;

each Z1b1 is a bond or is selected from FL70, FL70A, and FL70B;

each Z1b2 is FL3;

each Z1c is covalently conjugated to Z1b1 via an amine in beta or gamma position of a backbone of the Z1b1, and wherein at least one Z1c is covalently conjugated to at least one Z1b1 selected from FL70, FL70A, and FL70B.

In some embodiments, the compound is represented by Formula IE, or a stereoisomer or a mixture of stereoisomers, or pharmaceutically acceptable salt thereof:

(Formula IE)

$$[Z1c\!-\!Z1b1\!-\!Z1b2\!\overset{}{]}_{q'}\!-\!X_1$$

wherein:

q' is 2, 3, or 4;

each corresponding Z1c and Z1b1 is independently selected and may be the same or different;

each Z1b1 is a bond or is selected from FL70, FL70A, and FL70B;

each Z1b2 is selected from FL5, FL5A, and FL5B;

each Z1c is covalently conjugated to Z1b1 via beta or gamma position of a backbone of the Z1b1, and wherein at least one Z1c is covalently conjugated to at least one Z1b1 selected from FL70, FL70A, and FL70B.

In some embodiments, at least one Z1c is conjugated to an amine in the beta position of the backbone of the Z1b.

In some embodiments, the compound is represented by Formula IE, or a stereoisomer or a mixture of stereoisomers, or pharmaceutically acceptable salt thereof:

$$[\text{Z1c} \text{---} \text{Z1b1} \text{---} \text{Z1b2}]_{q'} \text{---} \text{X1} \quad \text{(Formula IE)}$$

wherein:

q' is 2, 3, or 4;

each corresponding Z1c and Z1b1 is independently selected and may be the same or different;

each Z1b1 is a bond or is selected from FL69, FL69A, and FL69B;

each Z1b2 is FL3 or FL5B;

each Z1c is covalently conjugated to Z1b1 via an amine in an alpha position of a backbone of the Z1b1, and wherein, at least one Z1c is covalently conjugated to at least one Z1b1 selected from FL69, FL69A, and FL69B.

In some embodiments, the compound is represented by Formula IE, or a stereoisomer or a mixture of stereoisomers, or pharmaceutically acceptable salt thereof:

$$[\text{Z1c} \text{---} \text{Z1b1} \text{---} \text{Z1b2}]_{q'} \text{---} \text{X1} \quad \text{(Formula IE)}$$

wherein:

q' is 2, 3, or 4;

each corresponding Z1c is independently selected and may be the same or different;

each Z1b1 is a bond;

each Z1b2 is FL3; and each Z1c is covalently conjugated to Z1b2 via an amine in a beta position of a backbone of the Z1b2.

In some embodiments, the polypeptide comprises an insulin receptor agonist having an A-chain and a B-chain. In some embodiments, In some embodiments, each Z1c is selected from Formulae FFL-1 to FFL-68, wherein Formulae FFL-1 to FFL-68 are:

FFL-1

FFL-2

FFL-3

FFL-4

313 314

-continued

FFL-5

FFL-6

FFL-7

FFL-8

FFL-9

FFL-10

FFL-11

-continued

FFL-12

FFl-13

FFL-14

FFL-15

FFL-16

317                                                                    318

-continued

FFL-17                                                              FFL-18

FFL-19                                                              FFL-20

FFL-21                                                              FFL-22

-continued

FFL-23

FFL-24

FFL-25

FFL-26

FFL-27

FFL-28

321

322

FFL-29

FFL-30

FFL-31

FFL-32

FFL-33

FFL-34

323                                                                                                         324

FFL-35

FFL-36

FFL-37

FFL-38

FFL-39

FFL-40

FFL-41

-continued

FFL-42

FFL-43

FFL-44

FFL-45

FFL-46

FFL-47

-continued

FFL-48

FFL-49

FFL-50

FFL-51

-continued

FFL-52

FFL-53

FFL-54

FFL-55

FFL-56

FFL-57

331

332

FFL-58

FFL-59

FFL-60

FFL-61

FFL-62

FFL-63

-continued

FFL-64

FFL-65

FFL-66

FFL-67

FFL-68 or stereoisomers thereof;

wherein X represents a point of covalent attachment to the amine of X1.

In some embodiments, $B_1$ and $B_2$ are each independently selected from Formulae F2 and F7; wherein each remaining $R_1$ is independently selected from H, $CF_3$, and F, wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67, or stereoisomers thereof; wherein X represents a point of covalent attachment to the amine of X1.

In some embodiments, $B_1$ and $B_2$ are each independently Formula F2, wherein each remaining $R_1$ is independently selected from H, $CF_3$, and F; wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67, or stereoisomers thereof; wherein X represents a point of covalent attachment to the amine of X1.

In some embodiments, $B_1$ and $B_2$ are each independently Formula F7A, wherein each remaining $R_1$ is independently selected from H, $CF_3$, and F; wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67, or stereoisomers thereof; wherein X represents a point of covalent attachment to the amine of XL.

In some embodiments, the compound (e.g., Formula I or Formula IB) has affinity to bind to one or more glycated proteins or glycosylated proteins and/or sugar moieties or saccharides or polysaccharides on surface of cells.

In some embodiments, q' is at least 2 and at least one of the Z1c is a sugar moiety, a diol containing moiety, and a polyol containing moiety. In some embodiments, the sugar moiety is selected from Formulae STR1, STR2, STR3, STR4, and STR5:

STR1

STR2

STR3

STR4

STR5 wherein:

one $R_1$''' represents the attachment point to a Z1b;

each remaining $R_1$''' is independently selected from —H, —$OR^3$, —$N(R^3)_2$, —$SR^3$, —OH, —$OCH_3$, —$OR^5$, $NHC(O)CH_3$, —$CH_2R^3$, —$C(O)NHOH$, —$NHC(O)CH_3$, —$CH_2OH$, —$CH_2OR^5$, —$NH_2$, —$CH_2R^4$, —$R^6$, and —$R^7$, wherein in STR1, STR2, and STR4 at least one of the remaining $R_1$''' is OH, each $R^3$ is independently selected from —H, acetyl, phosphate, —$R^2$, —$SO_2R^2$, —$S(O)R^2$, —$P(O)(OR^2)_2$, —$C(O)R^2$, —$CO_2R^2$, and —$C(O)N(R^2)_2$, each $R^2$ is independently selected from —H, $C_{1-6}$ aliphatic ring, phenyl ring, substituted 5-6 membered monocyclic heteroaryl ring having 1-4 heteroatoms selected from nitrogen, oxygen, and sulfur, a 4-7 membered heterocyclic ring having 1-2 heteroatoms selected from nitrogen, oxygen, and sulfur, and an alkyl (e.g., $C_1$-$C_6$alkyl), each $R^4$ is independently selected from —H, —OH, —$OR^3$, —$N(R^3)_2$, —$OR^5$ and —$SR^3$;

each $R^5$ is independently selected from a mono-saccharide, a di-saccharide, a tri-saccharide, a pentose, and a hexose, each $R^6$ is independently selected from —$NCOCH_2$—, —$(OCH_2CH_2)_n$—, a —O—$C_{1-9}$ alkylene group, and a substituted $C_{1-9}$ alkylene group in which one or more methylene groups are optionally replaced by —O—, —$(CH_2)_n$—, —$OCH_2$—, —$N(R^2)C(O)$—, —$N(R^2)C(O)N(R^2)$—, —$SO_2$—, —$SO_2N(R^2)$—, —$N(R^2)SO_2$—, —S—, —$N(R^2)$—, —$C(O)$—, —$OC(O)$—, —$C(O)O$—, —$C(O)N(R^2)$—, or —$N(R^2)SO_2N(R^2)$—, wherein index n is 1, 2, 3, 4, 5, 6, 7, or 8, each $R^7$ is independently selected from —$N(R^2)_2$, —F, —Cl, —Br, —I, —SH, —$OR^2$, —$SR^2$, —$NH_2$, —$N_3$, —$C\equiv CR^2$, —$CH_2C\equiv CH$, —$C\equiv CH$, —$CO_2R^2$, —$C(O)R^2$, —$OSO_2R^2$—$N(R^2)_2$, —$OR^2$, —$SR^2$, and —$CH_3$, —$CH_2NH_2$, and structures STR1, STR2, STR3, STR4, and STR5 optionally include one or more acetyl, acetylene, acetonide, and/or pinacol protecting groups.

In some embodiments, X1 comprises a polypeptide human hormone, an insulin receptor agonist, an endocrine hormone, insulin, human insulin, glucagon, amylin, relaxin, GLP-1, GIP, oxyntomodulin, somatostatin, gastric inhibitory polypeptide, glucose-dependent insulinotropic polypeptide, a hybrid peptide comprising sequences from two or more human polypeptide hormones, or an analogue of any thereof.

In some embodiments, X1 comprises an insulin having an A-chain and a B-chain, wherein optionally the A-chain comprises a sequence selected from SEQ ID NOs 1, 25, 24051, and 24052, and optionally the B-chain comprises a sequence selected from SEQ ID NOs 24060, 24061, 24062, 24063, 24064, and 25000-25397.

In some embodiments, X1 comprises an insulin having an A-chain and a B-chain, wherein the A-chain comprises a sequence selected from SEQ ID NOs 1, 24051, and 24052, and wherein the B-chain comprises a sequence selected from SEQ ID NOs 24063, 25095, 25228, 25229, 25232, 25236, 25305, 25308, 25312, and 25380-25397;

each Z1b is independently selected from FL3, FL5, FL5A, FL5B, FL65A, FL65B, FL69A, and FL69B;

each Z1c is independently selected from FF12A, FF12B, FF12C, FF12D, FF116A, FF116B, FF116C, FF116D, and FF227, wherein each Z1c is covalently conjugated via one or more of the Z1b to a lysine residue in X1; and $B_1$ and $B_2$ are each independently Formula F2 or Formula F7.

In some embodiments, each $B_1$ and $B_2$ is independently selected from F2 and F7 and is covalently conjugated to Z1c using an amide linkage, each Z1b is independently selected from (i) FL3, wherein p is 1, 2, or 3; (ii) FL5B, wherein p is 2, 3, or 4; (iii) FL65A; and (iv) FL69A, wherein p is 2, 3, or 4;

each Z1c is independently selected from FF12A, FF116A, and FF227, wherein each Z1c is covalently conjugated via one or more of the Z1b to a lysine residue in X1; and X1 is a polypeptide comprising an insulin receptor agonist having an A-chain and a B-chain, wherein the A-chain comprises a sequence selected from SEQ ID NOs 1, 24051, and 24052, and wherein the B-chain comprises a sequence selected from SEQ ID NOs 24063, 25095, 25228, 25229, 25232, 25236, 25305, 25308, 25312, and 25380-25397, and wherein at least two lysine in X1 are each independently conjugated to Z1b.

In some embodiments, at least one Z1c is FF227 and i is 1.

In some embodiments, provided herein are compounds selected from the group consisting of a polypeptide comprising an A-chain and a B-chain, wherein the A-chain comprises a sequence selected from 1, 24051, and 24052; and wherein the B-chain comprises a sequence selected from SEQ ID NOs 24063, 25228, 25229, 25232, 25305, 25308, 25312, 25236, 25095, and 25380-25397.

In some embodiments, X1 is an insulin further comprising from 1 to 5 residues replaced, inserted, appended, or mutated to an amino acid that has a free amine conjugated via one or more of the Z1b to a Z1c.

In some embodiments, at least one Z1c is conjugated via one or more of the Z1b to a free amine side chain of an amino acid in X1 that has been replaced, inserted, or mutated on an insulin.

In some embodiments, a compound is represented by Formula IF, or a stereoisomer or a mixture of stereoisomers, or pharmaceutically acceptable salt thereof:

Z1c-Linker          (Formula IF)

wherein the Z1c-Linker is selected from:

FFL-1

FFL-2

FFL-3

FFL-4

-continued

FFL-5

FFL-6

FFL-7

FFL-8

FFL-9

341

342

FFL-10

FFL-11

FFL-12

FFL-13

FFL-14

343      344

-continued

FFL-15

FFL-16

FFL-17

FFL-18

FFL-19

FFL-20

345

346

FFL-21

FFL-22

FFL-23

FFL-24

FFL-25

FFL-26

FFL-27

FFL-28

347                                                              348

FFL-29                                                           FFL-30

FFL-31                                                           FFL-32

FFL-33                                                           FFL-34

349             350

FFL-35

FFL-36

FFL-37

FFL-38

FFL-39

FFL-40

-continued

FFL-41

FFL-42

FFL-43   FFL-44

FFL-45   FFL-46

-continued

FFL-47

FFL-48

FFL-49

FFL-50

FFL-51

-continued

FFL-52

FFL-53

FFL-54

FFL-55

FFL-56

FFL-57

357 358

FFL-58

FFL-59

FFL-60

FFL-61

FFL-62

FFL-63

-continued

FFL-64                                                                                                              FFL-65

FFL-66                                                                                                              FFL-67

FFL-68 wherein X is selected from a leaving group, NH$_2$, and H; and B$_1$ and B$_2$, which may be identical or different, each independently represents an aromatic boron-containing group.

In some embodiments, the compound represented by Formula IF comprises at least one B$_1$ or B$_2$ independently selected from Formulae F2 and F7,

361 wherein Formulae F2 and F7 are:

(F2)

(F7)

362 wherein:

$R_1$ at position 5' represents (C=O)—*, wherein —* represents the attachment point to the rest of Z1c;

each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

Y8 is O, or Y8 is NR, wherein R is an alkyl group (e.g., C—$C_6$alkyl group) or H; and each Y10 is independently selected from H, $CH_3$, F, and $CF_3$, wherein for at least one F7 at least one Y10 is not H.

In some embodiments, the Z1c-Linker (i.e., Formula IF) is selected from:

DSL-1

DSL-2

363

364

DSL-3

DSL-4

DSL-5

-continued

DSL-6

DSL-7

367 368

-continued

DSL-8

DSL-9

DSL-10

DSL-11

DSL-12

-continued

DSL-13

DSL-14

371                                                                              372

DSL-15                                                                          DSL-16

DSL-17                                                                          DSL-18

-continued

DSL-19

DSL-20

-continued

DSL-21

DSL-22

DSL-23

377

378

-continued

DSL-24

DSL-25

DSL-26

-continued

DSL-27

DSL-28

381

382

DSL-29

DSL-30

DSL-31

DSL-32

383                                            384

-continued

DSL-33                                          DSL-34

DSL-35                                          DSL-36

385

386

DSL-37

DSL-38

DSL-39

DSL-40

387                                                                388

DSL-41                                                              DSL-42

DSL-43                                                              DSL-44

389                                                                                                    390

DSL-45                                                                                                  DSL-46

DSL-47                                                                                                  DSL-48

391    392

-continued

DSL-49    DSL-50

DSL-51    DSL-52

-continued

DSL-53

DSL-54

DSL-55

DSL-56

-continued

DSL-57

DSL-58

DSL-59

DSL-60

-continued

DSL-61

DSL-62

DSL-63

DSL-64

-continued

DSL-65

DSL-66

DSL-67

DSL-68

401 402

DSL-69

DSL-70

DSL-71

DSL-72

403

404

DSL-73

DSL-74

DSL-75

-continued

DSL-76

DSL-77

407      408

-continued

DSL-78      DSL-79

DSL-80      DSL-81

DSL-82

-continued

DSL-83

DSL-84

411

412

-continued

DSL-85

DSL-86

DSL-87

DSL-88

-continued

DSL-89

DSL-90

-continued

DSL-91

DSL-92

DSL-93

-continued

DSL-94

DSL-95

420

-continued

DSL-96

DSL-97

-continued

DSL-98

DSL-99

DSL-100

423 424

DSL-101

DSL-102

DSL-103

DSL-104

425 426

-continued

DSL-105

DSL-106

DSL-107

DSL-108

DSL-109

DSL-110

427                                                                 428

DSL-111                                                             DSL-112

DSL-113                                                             DSL-114

429
430

DSL-115

DSL-116

DSL-117

DSL-118

431

432

DSL-119

DSL-120

DSL-121

DSL-122

433    434

DSL-123    DSL-124

DSL-125    DSL-126

435

436

DSL-127

DSL-128

DSL-129

DSL-130

437 438

-continued

DSL-131                                    DSL-132

DSL-133                                    DSL-134

439 440

DSL-135

DSL-136

DSL-137

DSL-138

-continued

DSL-139                                                                                    DSL-140

DSL-141                                                                                    DSL-142

DSL-143                                                                                    DSL-144

443

444

DSL-145

DSL-146

DSL-147

DSL-148

DSL-149

DSL-150

445
446

DSL-151

DSL-152

DSL-153

DSL-154

DSL-155

DSL-156

447 448

-continued

DSL-157

DSL-158

DSL-159

DSL-160

DSL-161

DSL-162

449

450

DSL-163

DSL-164

DSL-165

DSL-166

451            452

DSL-167

DSL-168

DSL-169

DSL-170

DSL-171

DSL-172

-continued

DSL-173

DSL-174

-continued

DSL-175 or a stereoisomer or a mixture of stereoisomers, a pharmaceutically acceptable salt thereof, and combinations thereof, wherein X is a leaving group or represents a point of covalent attachment directly to X1 of Formula I or Formula IB.

In some embodiments, when X is a leaving group, X is selected from N-oxysuccinimide, 2,3,5,6-tetrafluorophenoxy (TFP), pentafluorophenoxy (Pfp), OH, halogen, maleimide alkyl amino, maleimide amido polyethylene glycol amino, and maleimide polyethylene glycol amino. In some embodiments, X is selected from N-oxysuccinimide and OH. In some embodiments, X is OH. In some embodiments, X is N-oxysuccinimide. In some embodiments, the maleimide polyethylene glycol amino is selected from Mal-PEG2-amine, Mal-PEG4-amine, and Mal-PEG5-amine, or a pharmaceutically acceptable salt thereof. In some embodiments, the maleimide alkyl amino is selected from Mal-C6-amine and N-(2-Aminoethyl)maleimide, or a pharmaceutically acceptable salt thereof. In some embodiments, the maleimide amido polyethylene glycol amino is selected from Mal-amido-PEG9-amine, Mal-amido-PEG11-amine, Mal-amido-PEG23-amine, 4-Mal-methyl-cyclohexanecarboxamide-methyl-[1,2,3]triazole-PEG8-amine, or a pharmaceutically acceptable salt thereof. In some embodiments, the Z1c-Linker is selected from:

DSL-1A

DSL-2A 457 458

DSL-3A

DSL-4A

DSL-5A

DSL-6A

-continued

DSL-7A

DSL-8A

DSL-9A

DSL-10A

DSL-11A

-continued

DSL-12A

DSL-13A

-continued

DSL-14A

DSL-15A

DSL-16A

465

466

-continued

DSL-17A

DSL-18A

DSL-19A

-continued

DSL-20A

DSL-21A 469 470

DSL-22A

DSL-23A

DSL-24A

DSL-25A

-continued

DSL-26A

DSL-27A

-continued

DSL-28A

DSL-29A

DSL-30A

475

476

DSL-31A

DSL-32A

DSL-33A

DSL-34A 477 478

DSL-35A

DSL-36A

DSL-37A

DSL-38A

479

480

-continued

DSL-39A

DSL-40A

DSL-41A

DSL-42A 481 482

DSL-43A DSL-44A

DSL-45A DSL-46A 483 484

-continued

DSL-47A

DSL-48A

DSL-49A

DSL-50A

-continued

DSL-51A

DSL-52A

DSL-53A

DSL-54A

487

488

DSL-55A

DSL-56A

DSL-57A

DSL-58A 489                                                              490

DSL-59A                                                          DSL-60A

DSL-61A                                                          DSL-62A

-continued

DSL-63A

DSL-64A

DSL-65A

DSL-66A 493 494

-continued

DSL-67A

DSL-68A

DSL-69A

DSL-70A 495 496

DSL-71A

DSL-72A

DSL-73A

DSL-74A

DSL-75A

-continued

DSL-76A

DSL-77A 499 500

DSL-78A

DSL-79A

DSL-80A

-continued

DSL-81A

DSL-82A

-continued

DSL-83A

DSL-84A

-continued

DSL-85A

DSL-86A

DSL-87A

DSL-88A

-continued

DSL-89A

DSL-90A

-continued

DSL-91A

DSL-92A

DSL-93A

511

512

DSL-94A

DSL-95A

-continued

DSL-96A

DSL-97A 515 516

DSL-101A

DSL-102A

DSL-103A

DSL-104A 517 518

DSL-105A

DSL-106A

DSL-107A

DSL-108A

-continued

DSL-109A

DSL-110A

DSL-111A

DSL-112A 521                                    522

DSL-113A                                DSL-114A

DSL-115A                                DSL-116A 523 524

-continued

DSL-117A

DSL-118A

DSL-119A

DSL-120A

525

526

-continued

DSL-121A

DSL-122A

DSL-123A

DSL-124A

-continued

DSL-125A

DSL-126A

DSL-127A

DSL-128A 529 530

-continued

DSL-129A

DSL-130A

DSL-131A

DSL-132A

DSL-133A

DSL-134A 531                                                 532

-continued

DSL-135A

DSL-136A

DSL-143A

DSL-144A

DSL-145A

DSL-146A 533 534

-continued

DSL-147A

DSL-148A

DSL-149A

DSL-150A

DSL-151A

DSL-152A

535

536

-continued

DSL-153A

DSL-154A

DSL-155A

DSL-156A

DSL-157A

DSL-158A

537

538

DSL-159A

DSL-160A

DSL-161A

DSL-162A

-continued

DSL-163A

DSL-164A

DSL-165A

DSL-166A

-continued

DSL-167A

DSL-168A

DSL-169A

DSL-170A

DSL-171A

DSL-172A

543

544

-continued

DSL-173A

DSL-174A

DSL-175A a stereoisomer or a mixture of stereoisomers, a pharmaceutically acceptable salt thereof, and combinations thereof. In some embodiments, the Z1c-Linker is selected from:

DSL-1B

DSL-2B

DSL-3B

DSL-4B

DSL-5B

-continued

DSL-6B

DSL-7B

DSL-8B

DSL-9B

-continued

DSL-10B

DSL-11B

DSL-12B

-continued

DSL-13B

DSL-14B

-continued

DSL-15B

DSL-16B

DSL-17B

DSL-18B

-continued

DSL-19B

DSL-20B

DSL-21B

DSL-22B

DSL-23B

DSL-24B

-continued

DSL-25B

DSL-26B

-continued

DSL-27B

DSL-28B

-continued

DSL-29B

DSL-30B

DSL-31B

DSL-32B

DSL-33B

DSL-34B 565 566

-continued

DSL-35B

DSL-36B

DSL-37B

DSL-38B

DSL-39B

DSL-40B

-continued

DSL-41B

DSL-42B

DSL-43B

DSL-44B 569　　　　　　　　　　　　　　　　　　570

-continued

DSL-45B　　　　　　　　　　　　　　　　DSL-46B

DSL-47B　　　　　　　　　　　　　　　　DSL-48B

-continued

DSL-49B                                                    DSL-50B

DSL-51B                                                    DSL-52B

DSL-53B                                                    DSL-54B

-continued

DSL-55B

DSL-56B

DSL-57B

DSL-58B

DSL-59B

DSL-60B

-continued

DSL-61B

DSL-62B

DSL-63B

DSL-64B 577 578

-continued

DSL-65B DSL-66B

DSL-67B DSL-68B

-continued

DSL-69B

DSL-70B

DSL-71B

DSL-72B

DSL-73B

-continued

DSL-74B

DSL-75B

-continued

DSL-76B

DSL-77B

DSL-78B  DSL-79B

-continued

DSL-80B

DSL-81B

-continued

DSL-82B

DSL-83B

-continued

DSL-84B

DSL-85B

DSL-86B

DSL-87B

-continued

DSL-88B

DSL-89B

-continued

DSL-90B

DSL-91B

-continued

DSL-92B

DSL-93B

DSL-94B

DSL-95B

-continued

DSL-96B

DSL-97B

-continued

DSL-98B

DSL-99B

DSL-100B

DSL-101B

DSL-102B 601 602

-continued

DSL-103B

DSL-104B

DSL-105B

DSL-106B

DSL-107B

DSL-108B 603 604

-continued

DSL-109B

DSL-110B

DSL-111B

DSL-112B

DSL-113B

DSL-114B

-continued

DSL-115B

DSL-116B

DSL-117B

DSL-118B

-continued

DSL-119B

DSL-120B

DSL-121B

DSL-122B

DSL-123B

DSL-124B

-continued

DSL-125B

DSL-126B

DSL-127B

DSL-128B

DSL-129B

DSL-130B 611 612

-continued

DSL-131B

DSL-132B

DSL-133B

DSL-134B

DSL-135B

DSL-136B 613 614

-continued

DSL-137B DSL-138B

DSL-139B DSL-140B

615

616

-continued

DSL-141B

DSL-142B

DSL-143B

DSL-144B

DSL-145B

DSL-146B 617                                                                                    618

-continued

DSL-147B                                                                         DSL-148B

DSL-149B                                                                         DSL-150B

DSL-151B                                                                         DSL-152B 619 620

-continued

DSL-153B

DSL-154B

DSL-155B

DSL-156B

DSL-157B

DSL-158B

621

622

DSL-159B

DSL-160B

DSL-161B

DSL-162B

623

624

-continued

DSL-163B

DSL-164B

DSL-165B

DSL-166B

DSL-167B

DSL-168B 625 626

DSL-169B

DSL-170B

DSL-171B

DSL-172B

-continued

DSL-173B

DSL-174B

DSL-175B a stereoisomer or a mixture of stereoisomers, a pharmaceutically acceptable salt thereof, and combinations thereof.

In at least one embodiment, the compound of the present disclosure may be used, as an intermediate in the manufacture of a drug substance or a therapeutic of a prophylactic compound.

In another aspect, the disclosure provides a human insulin analog, comprising an A-chain and a B-chain, wherein the sequence of the A-chain comprises:

$X_{aa}X_{bb}X_{cc}X_{dd}$, $X_{ee}X_{ff}X_{gg}$VEQCCX$_{hh}X_{ii}$ICS-LYQLENYCNX$_{jj}X_{kk}X_{ll}X_{mm}X_{nn}X_{oo}X_{pp}$, (SEQ ID NO:24015); and wherein the sequence of the B-chain comprises:

(i)

(SEQ ID NO: 24016)

$X_{aa}X_{bb}X_{cc}X_{dd}$KX$_{ee}X_{ff}X_{gg}X_{hh}X_{ii}X_{jj}$KX$_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, (ii)

(SEQ ID NO: 24017)

$X_{aa}X_{bb}X_{cc}X_{dd}$KPX$_{ee}X_{ff}X_{gg}X_{hh}X_{ii}X_{jj}X_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, (iii)

(SEQ ID NO: 24018)

$X_{aa}X_{bb}X_{cc}X_{dd}$KX$_{ee}X_{ff}X_{gg}X_{hh}X_{ii}X_{jj}$KX$_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is G, (iv)

(SEQ ID NO: 24019)

$X_{aa}X_{bb}X_{cc}X_{dd}$KX$_{ee}X_{ff}X_{gg}X_{hh}X_{ii}X_{jj}$KX$_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is S, or (v)

(SEQ ID NO: 24020)

$X_{aa}X_{bb}X_{cc}X_{dd}$KX$_{ee}X_{ff}X_{gg}X_{hh}X_{ii}X_{jj}$KX$_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ are present and at least one of $X_{ee}$, $X_{ff}$, $X_{gg}$, $X_{hh}$, $X_{ii}$, $X_{jj}$ is S, and another is G.

In some embodiments, the A-chain comprises a sequence selected from SEQ ID NOs 1 and 3 to 33, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY and SEQ ID NOs 75 to 24014, 24037-24046, and wherein the B-chain comprises at least one of SEQ ID NOs 2 and 34 to 74, 24047, and 24048, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA; KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY and SEQ ID NOs 75 to 24014, 24037-24046.

In some embodiments, the A-chain comprises a sequence selected from SEQ ID NOs 1 and 3 to 33, the B-chain comprises at least one of SEQ ID NOs 2 and 34 to 74, 24047, and 24048, and (a)
the A-chain and the B-chain are each independently and optionally appended at the N-terminus and/or at the C-terminus by at least one selected from:
KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF; KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, 24037-24046, KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY and, KA, KD, KE, KF, KG, KH, KI, KL, KN, KP, KQ, KR, KS, KT, KY and SEQ ID NOs 75 to 3224, KA, KD, KE, KF, KG, KH, KI, KL, KN, KP, KQ, KR, KS, KT, KY and SEQ ID NOs 3225 to 6374, KA, KD, KE, KF, KG, KH, KI, KL, KN, KP, KQ, KR, KS, KT, KY and SEQ ID NOs 6375 to 15194, KA, KD, KE, KF, KG, KH, KI, KL, KN, KP, KQ, KR, KS, KT, KY and SEQ ID NOs 15195 to 18134, KA, KD, KE, KF, KG, KH, KI, KL, KN, KP, KQ, KR, KS, KT, KY and SEQ ID NOs 18135 to 21074, and KA, KD, KE, KF, KG, KH, KI, KL, KN, KP, KQ, KR, KS, KT, KY and SEQ ID NOs 21075 to 24014, 24037-24046, or (b)
both the N-terminus and the C-terminus of the B-chain are independently covalently conjugated, via a peptide bond, to one selected from:
KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, 24037-24036, KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, KA, KD, KE, KF, KG, KH, KI, KL, KN, KP, KQ, KR, KS, KT, KY and SEQ ID NOs 75 to 3224, KA, KD, KE, KF, KG, KH, KI, KL, KN, KP, KQ, KR, KS, KT, KY and SEQ ID NOs 3225 to 6374, KA, KD, KE, KF, KG, KH, KI, KL, KN, KP, KQ, KR, KS, KT, KY and SEQ ID NOs 6375 to 15194, KA, KD, KE, KF, KG, KH, KI, KL, KN, KP, KQ, KR, KS, KT, KY and SEQ ID NOs 15195 to 18134, KA, KD, KE, KF, KG, KH, KI, KL, KN, KP, KQ, KR, KS, KT, KY and SEQ ID NOs 18135 to 21074, and KA, KD, KE, KF, KG, KH, KI, KL, KN, KP, KQ, KR, KS, KT, KY and SEQ ID NOs 21075 to 24014, 24037-24036.

In some embodiments, the A-chain comprises a sequence selected from SEQ ID NOs 1 and 3 to 33, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KEN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, kSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, KGSH (SEQ ID NO:24049), GKGSH (SEQ ID NO:24050), GKGSKK-(SEQ ID NO:24045), GKKPGKK (SEQ ID NO:24046), GKGPSK (SEQ ID NO:24044), GKP-SHKP (SEQ ID NO:24043), and GSHKGSHK (SEQ ID NO:24042); and wherein the B-chain comprises a sequence selected from SEQ ID NOs 2 and 34 to 74, 24047, and 24048, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, KGSH (SEQ ID NO:24049), GKGSH (SEQ ID NO:24050), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042).

In some embodiments, no more than 4 residues are added or deleted from the A-chain and/or the B-chain of the insulin.

In some embodiments, a K residue is present at the N-terminus of the A-chain and/or the B-chain, and/or wherein no more than three K residues are present at the N-terminus of the A-chain and/or the B-chain, and/or wherein in (i) the tyrosine at A14 is replaced with glutamic acid, and/or (ii) the tyrosine at B16 is replaced with histidine, and/or (iii) the phenylalanine at B25 is replaced with a histidine, and/or wherein one to three residues selected from residues B20, B21, and B22-B29 of the B-chain, residues A4 or A8 of the A-chain, and residues of an optionally extended polypeptide, are lysine residues, and/or wherein only one K residue is present within 10 residues of the N-terminus of B-chain.

In some embodiments, X1 comprises an insulin and/or insulin analog as disclosed herein.

In some embodiments, X1 comprises an insulin and/or insulin analog as disclosed herein, and the insulin and/or insulin analog further comprises an optional covalent-spacer.

In some embodiments, an amino group of one or more side chain(s) of one to four lysine residues of insulin is each independently covalently conjugated as described by Formula I.

In some embodiments, the insulin comprises at least two amines that are covalently conjugated as described by Formula I, wherein one amine is the N-terminus amino group of the B-chain of insulin, and the other amine(s) are the side chain amine of a lysine that is 0 to 5 residues away from residue $B_{22}$ of the B-chain of insulin, and/or the side chain amine of a lysine that is 1 to 5 residues away from residue A21 of the A-chain of insulin.

In some embodiments, an amino group at the N-terminus of the B-chain of insulin is covalently conjugated as described by Formula I, and q' is optionally 2 or more, and the insulin includes at least one additional covalent conjugation to X1 as independently described by Formula I.

In some embodiments, the insulin is covalently conjugated as described by Formula I, such as in Examples 1-915, and wherein 1 to 4 residues are optionally added or deleted from the A-chain and/or B-chain of the insulins shown in Examples 1-915

In another aspect, the disclosure provides an insulin (e.g., a modified insulin) that may be used as an intermediate for the manufacture of a conjugate described by Formula I.

In some embodiments, each secondary amine in Formulae FF1-FF231 that is not conjugated to any of 1, $B_2$ or $B_3$, is optionally independently acetylated or alkylated.

In some embodiments, the N-terminus of the A-chain and/or the N-terminus of the B-chain of insulin are additionally each independently covalently conjugated to at least two aromatic boron-containing groups, and/or wherein the C-terminus of the B-chain is further extended with a polypeptide of up to 20 residues, or the C-terminus of the A-chain is further extended with a polypeptide of up to 40 residues, each polypeptide independently comprising, at least one lysine residue in which the amino group of the lysine side chain is covalently conjugated as described by Formula I.

In some embodiments, X1 is insulin having a sequence comprising one selected from: a lysine at residue B21 of the B-chain and an arginine at residue B29 of the B-chain; a lysine at residue B21 of the B-chain; and a lysine at residue B29 of the B-chain; wherein an amino group of at least one lysine of the sequence is covalently conjugated as described by Formula I.

In some embodiments, X1 is insulin having a sequence comprising: a lysine at residue B21 of the B-chain; and at least one lysine at the N-terminus of the B-chain; wherein an amino group of at least one lysine of the sequence is covalently-conjugated as described by Formula I.

In some embodiments, the C-terminus of Z1a is conjugated through an amide linkage to a Z1b, and the Z1b is conjugated to the N-terminus of the B-chain of insulin through an amine linkage, and wherein the insulin is optionally further conjugated as described by Formula I.

In some embodiments, the compound comprises at least one Z1a comprising at least three amino acid residues having a side chain; the side chain of two residues of Z1a are conjugated together through a covalent bond included in at least one selected from a triazole linkage, an amide linkage, a disulfide linkage, a thioether linkage, a thiolene linkage, and an amine linkage; and the two conjugated residues are at least one residue apart.

In some embodiments, the N-terminal amine of a Z1a is covalently conjugated to a Z1c.

In some embodiments, the compound comprises at least one Z1a comprising one or more amino acids selected from lysine, diaminopropionic acid, glycine, diaminobutyric acid, serine, histidine, and ornithine, and at least one or more of the side chains of the one or more amino acids, is covalently conjugated as described by Formula I.

In some embodiments, the compound comprises at least one Z1a comprising one or more glutamic or aspartic acid residues, and optionally other naturally occurring amino acids, and at least one lysine residue that is covalently conjugated as described by Formula I.

In some embodiments, the compound comprises at least one Z1a comprising at least one lysine residue that is covalently conjugated as described by Formula I, wherein the majority of the residues are negatively charged residues.

In some embodiments, the insulin is covalently conjugated as described by Formula I, and Z1b is absent and the C-terminus of Z1a is directly conjugated to the N-terminus of the B-chain of insulin through a peptide bond.

In some embodiments, the insulin is covalently conjugated as described by Formula I, n'=0 and the C-terminus of Z1a is directly conjugated to the N-terminus of the B-chain of insulin through a peptide bond; and Z1a comprises at least one amino acid from each of groups M1 and M2 such that no two adjacent residues are from the same group and Z1a contains at least one lysine that is covalently conjugated as described by Formula I, wherein: (i)group M1 comprises lysine and alanine and group M2 comprises glycine, glutamic acid, serine, threonine, alanine and proline; or (ii) group M1 consists of lysine and alanine; and group M2 consists of glycine, glutamic acid, serine, threonine, alanine and proline. 19. In some embodiments, the insulin is covalently conjugated as described by Formula I, n'=0 and the C-terminus of Z1a is directly conjugated to the N-terminus of the B-chain of insulin through a peptide bond;

Z1a comprises at least one amino acid selected from K, P, E, G, S, T, A, and R, such that the sequence comprises at least one lysine, at least one proline, and at least one amino acid selected from H, R, A and T; and the amino group of least one lysine side chain in Z1a is covalently conjugated as described by Formula I.

In some embodiments, the insulin is covalently conjugated as described by Formula I, n'=0 and the C-terminus of Z1a is directly conjugated to the N-terminus of the B-chain of Insulin through a peptide bond; and Z1a comprises at least one amino acid selected from the alanine, glycine, aspartic acid, threonine, histidine, methionine, cysteine, isoleucine, leucine, valine and glutamine; and at least one lysine having a side chain amino group that is covalently conjugated as described by Formula I; and the rest of the amino acids in Z1a are each independently selected from the twenty naturally occurring amino acids.

In some embodiments, the insulin is covalently conjugated as described by Formula I, n'=0 and the C-terminus of Z1a is directly conjugated to the N-terminus of the B-chain of Insulin through a peptide bond; Z1a has a sequence selected from: KPA, KPH, GKPA, GKPS, KP, GKPSG, and GKPGS; and Z1a comprises at least one lysine having a side chain amino group that is covalently conjugated as described by Formula I.

In some embodiments, the insulin is covalently conjugated as described by Formula I, n'=0 and the C-terminus of Z1a is directly conjugated to the N-terminus of the B-chain of Insulin through a peptide bond; Z1a comprises two or more copies of a sequence selected from: EGE, SGS, GSG, KP, GEG, E, GG, S, T, A, and R, such that no two adjacent copies are the same; Z1a optionally contains one or more of H, A, N and R; and the amino group of least one lysine side chain in Z1a is covalently conjugated as described by Formula I.

In some embodiments, the insulin is covalently conjugated as described by Formula I, n'=0 and the C-terminus of Z1a is directly conjugated to the N-terminus of the B-chain of Insulin through a peptide bond; Z1a comprises one or more amino acids selected from K, P, E, G, S, T, A, and R, such the sequence comprises at least one lysine, at least one proline, and at least one amino acid selected from H, R, A and T; and the amino group of least one lysine side chain in Z1a is covalently conjugated as described by Formula I.

In some embodiments, the insulin is covalently conjugated as described by Formula I, n'=0 and the C-terminus of Z1a is directly conjugated to the N-terminus of the B-chain of Insulin through a peptide bond; and at least one copy of KP is comprised in the polypeptide sequence of Z1a or insulin, wherein the amino group of the lysine side chain in KP is covalently conjugated as described by Formula I.

In some embodiments, the insulin is covalently conjugated as described by Formula I, n'=0 and the side chains of two residues of Z1a are conjugated via a covalent bond selected from a triazole, an amide bond, a disulfide bond, a thioether, a thiolene, and an amine; the two conjugated residues are separated by at least one amino acid; and the amino group of least one lysine side chain in Z1a is covalently conjugated as described by Formula I.

In some embodiments, the insulin is covalently conjugated as described by Formula I, n'=0 and the C-terminus of Z1a is directly conjugated to the N-terminus of the B-chain of insulin through a peptide bond; Z1a is a polypeptide selected from the a polypeptide from the sequence of human insulin, a polypeptide from the sequence of human glucagon, a polypeptide from the sequence of human C-peptide, a polypeptide from the sequence of human GLP-1, a polypeptide from the sequence of human GIP, a polypeptide from the sequence of human Extendin, and a human polypeptide hormone, and wherein the polypeptide comprises at least one lysine or Z1a contains at least one copy of dipeptide KP, and wherein the amino group of at least one lysine side chain in Z1a is covalently conjugated as described by Formula I.

In some embodiments, at least one lysine residue, an inserted cysteine residue, or a residue that has been mutated to cysteine is covalently conjugated to a structure independently selected from Formulae F411-F416:

(F411)

(F412)

(F413)

(F414)

(F415)

(F416)

and wherein in Formulae F411-F416, R represents an attachment point to the amine group of the lysine side chain, or the thiol group of the cysteine side chain; n is an integer in the range of 1 to 14, m is an integer between 1 and 12, o is an integer between 1 and 6, p is an integer between 1 and 12; and Z represents one of —(C═O)— OH, —NH$_2$, —CH$_3$, a cholesterol, 7-OH cholesterol, 7,25-dihydroxycholesterol, cholic acid, chenodeoxycholic acid, lithocholic acid, deoxycholic acid, glycocholic acid, glycodeoxycholic acid, glycolithocholic acid, glycochenodeoxycholic acid, α-tocopherol, β-tocopherol, γ-tocopherol, δ-tocopherol, αtocotrienol, β-tocotrienol, γ-tocotrienol, or δ-tocotrienol.

In some embodiments, the residue at position B29 of the B-chain of Insulin is a lysine covalently conjugated through an amide bond to the side chain of an L- or D-glutamic acid, and wherein the L- or D-glutamic acid is covalently conjugated through an amide bond to one of acid selected from hexanoic acid, myristic acid, octanoic acid, nonanoic acid, decanoic acid, lauric acid, stearic acid, and palmitic acid.

In some embodiments, the insulin is covalently conjugated as described by Formula I, Z1a comprises a polypeptide with the sequence (XA$_1$X)$_m$, wherein: A$_1$ is an L- or D-amino acid; m is an integer in the range of 1 to 4; and each X is K or KP; and the epsilon amine group of at least one lysine side chain in Z1a is further covalently conjugated as described by Formula I.

In some embodiments, the insulin is covalently conjugated as described by Formula I, Z1a comprises a polypeptide with the sequence (XA$_1$A$_2$X)$_m$ (SEQ ID NO:24021), wherein: A$_1$ and A$_2$ are each independently an L- or D-amino acid; m is an integer in the range of 1 to 4; each X is K or KP; and the epsilon amine group of at least one lysine side chain in Z1a is further covalently conjugated as described by Formula I.

In some embodiments, the insulin is covalently conjugated as described by Formula I, Z1a comprises a polypeptide with the sequence (XA$_1$A$_2$A$_3$X)$_m$(SEQ ID NO:24022), wherein: A$_1$, A$_2$, and A$_3$ are each independently an L- or D-amino acid; m is an integer in the range of 1 to 4; each X is K or KP; and the epsilon amine group of at least one lysine side chain in Z1a is covalently conjugated as described by Formula I.

In some embodiments, the insulin is covalently conjugated as described by Formula I, Z1a comprises a polypeptide with a sequence selected from (XA1X)m(GGGGS)n (SEQ ID NO:24023), (XA1A2X)m(GGGGS)n (SEQ ID NO:24024), (XA1A2A3X)$_m$(GGGGS)$_n$ (SEQ ID NO:24025), (XA1X)m (GGGGS)n (XA2X)o (SEQ ID NO:24026), and XA1A2X)m(GGGGS)n (XA3A4X)o (SEQ ID NO:24027), wherein: A$_1$, A$_2$, A$_3$, and A$_4$ are each independently an L- or D-amino acid; m is an integer in the range of 1 to 4; n is an integer in the range of 1 to 4; o is an integer in the range of 1 to 4; each X is K or KP; and the epsilon amine group of each lysine side chain of at least one lysine side chain in Z1a is further covalently conjugated as described by Formula I.

In some embodiments, the insulin is covalently conjugated as described by Formula I, Z1a comprises a polypeptide with the sequence (GX)$_m$, wherein: X is KV; m is an integer in the range of 1 to 4, and the epsilon amine group of at least one lysine side chain in Z1a is further covalently conjugated, as described by Formula I.

In some embodiments, the insulin is covalently conjugated as described by Formula I, Z1a comprises a polypeptide with a sequence selected from: GXA1KGEA2XT)m (GGSGSSS)n (GXGXA3GSSSGSSSXT)o (SEQ ID NO:24028), (GXA1ESA2LYL)m (SEQ ID NO:24029), (TXEX)m(GPGS)n (SEQ ID NO:24030), (GXESA1VA)m (KA2K)n (SEQ ID NO:24031), (GXEA1A2)m(GGS)n (TYA3XXT)o (SEQ ID NO:24032), and (TXAXYT)m (TSSS)n (SEQ ID NO:24033), wherein: each X is KV or KP; A$_1$, A$_2$, A$_3$ are each independently an L- or D-amino acid; m is an integer in the range of 1 to 4; n is an integer in the range of 1 to 4; and o is an integer in the range of 1 to 4; and the epsilon amine group of at least one lysine side chain in Z1a is further covalently conjugated as described by Formula I.

In some embodiments, the insulin is covalently conjugated as described by Formula I, Z1a comprises a polypeptide with a sequence selected from (TKPYA1KEVETA2GSGS)m (GGGGS)n (SEQ ID NO:24034), (YTPLEA1KPYSTSYKPYSEA1L)m (GKPTSLEA2FLVEA2LYTKP)n (SEQ ID NO:24035), and (GKEALYLTPLESALYKP)m(TKPLEALYLK-PEILSLKPESLA)n(GKPGSSSKPDTSSSGTP KTAAGS)o (SEQ ID NO:24036), wherein: A$_1$ and A$_2$ are each independently an L- or D-amino acid; m is an integer in the range of 1 to 4; n is an integer in the range of 1 to 4; and the epsilon amine group of at least one lysine side chain in Z1a is further covalently conjugated as described by Formula I.

In some embodiments, the compound is conjugated either directly, or via an optional covalent-spacer, to a drug molecule, an imaging agent, a contrast agent, a radioactive isotope, a radiotherapy agent, or a molecule that engages immune cells in the body.

In some embodiments, X1 is human glucagon or an analogue of human glucagon, and optionally covalently conjugated to one or more diol- or sugar-containing molecules, or X1 is an analogue of a human peptide hormone that is modified so that it binds to its cognate receptor but has diminished or null ability to activate the receptor in the body, or X1 is an analogue of a human peptide hormone that is modified so that it selectively binds or activates a subset of its cognate receptors or subsets of receptors of human polypeptide hormones.

In some embodiments, the aromatic boron-containing groups are modified to be MIDA protected, pinacol protected, or in an ester form. In some embodiments, the aromatic boron-containing group is MIDA protected or pinacol protected.

In some embodiments, the modified aromatic boron-containing groups are used as intermediates for the synthesis of a conjugate of Formula I.

In some embodiments, X1 comprises: (i) a human polypeptide hormone or an analogue of a human polypeptide hormone, wherein the covalent linkage to X1 is to an amine or via an optional covalent-spacer to an amine in X1; (ii) an amine configured to be covalently conjugated via an optional covalent-spacer to a human polypeptide hormone or an analogue of a human polypeptide hormone, or (iii) NH$_2$, and wherein the amine in X1 is covalently conjugated twice as described by Formula I, wherein the first covalent conjugation is through an amine bond and the second covalent conjugation is through an amide bond, and wherein each covalent conjugation is the same or different.

In some embodiments, residue B21 of the B-chain of Insulin is K, residue B22 of the B-chain of Insulin is P, and residue B29 of the B-chain of Insulin is R; and the N-terminus of the Insulin B-chain is covalently conjugated as described by Formula I to the C-terminus of Z1a, wherein: n'=0; Z1a has the sequence GKPGHKP; and one Z1c is attached to each lysine side chain in Z1a, wherein each Z1c is independently represented by Formula FF12, and each of B1 and B2 are represented by Formula F2, wherein one R1 at position 5' is the covalent amide bond to Formula FF12, and the amino group of the lysine at B21 (residue 21 of the B-chain of Insulin) is covalently conjugated as described by Formula I, wherein n'=0; m'=0; and Z1c is described by Formula FF12, wherein each of B1 and B2 are represented by formula F2, and wherein one R1 at position 5' is the covalent amide bond to Formula FF12.

In at least one embodiment, the present disclosure is directed to an insulin analog. In some embodiments, the insulin analog is desB30 human insulin; wherein the N-terminus of the Insulin B-chain is covalently conjugated as described by Formula I to the C-terminus of Z1a, wherein: n'=0; Z1a has the sequence KPGSEHESA, and one Z1c is attached to each lysine side chain in Z1a, wherein each Z1c is described byFormula FF1, and each of B1 and B2 are described by Formula F1, wherein one R1 at position 3' is the covalent amide bond to Formula FF1 and wherein one R1 at position 5' is F, and wherein the amino group of the lysine at B29 (residue 29 of the B-chain of Insulin) is covalently conjugated as described by Formula I, wherein n'=0; m'=0; and Z1c is described by Formula FF1, and each of B1 and B2 are described by Formula F1, wherein one R1 at position 3' is the covalent amide bond to Formula FF1 and one R1 at position 5' is F.

In some embodiments, the A- and/or B-chain sequence of the insulin is appended at the N-terminus or C-terminus by KX'K, KX', or X'K wherein X' represents a continuous sequence of 2, 3, 4, or 5 residues selected from within wild-type A-chain (SEQ ID NO:1) and wild-type B-chain (SEQ ID NO:2). In some embodiments, each K residue is optionally and independently covalently conjugated as described by Formula I. In some embodiments, X' is a polypeptide of up to 30 residues with amino acids independently selected from: K, G, S, E, H, E, N, Q, D, A, P, R and C and each K residue is optionally and independently covalently conjugated as described by Formula I.

In some embodiments, the N-terminus of the A-chain and/or B-chain are optionally and independently covalently conjugated as described by Formula I.

In some embodiments, each K residue when present in insulin (insulin analog) is optionally and independently covalently conjugated as described by Formula I, wherein Z1c is any one of formulae FF1-FF231 and the B1 and B2 are each independently selected from F1 and F2.

In some embodiments, each K residue when present in insulin is optionally and independently covalently conjugated as described by Formula I, wherein Z1c is any one of formulae:

Formulae FF1-F22 and the B1 and B2 are each independently selected from F1 and F2;

Formulae FF23-FF48 and the B1 and B2 are each independently selected from F1 and F2;

Formulae FF49-FF88 and the B1 and B2 are each independently selected from F1 and F2;

Formulae FF89-FF112 and the B1 and B2 are each independently selected from F1 and F2;

Formulae FF113-FF136 and the B1 and B2 are each independently selected from F1 and F2;

Formulae FF137-FF160 and the B1 and B2 are each independently selected from F1 and F2;

Formulae FF160-FF166 and the B1 and B2 are each independently selected from F1 and F2;

Formulae FF167-FF224 and the B1 and B2 are each independently selected from F1 and F2; or Formulae FF225-FF231 and the B1 and B2 are each independently selected from Formulae F3-F11.

In some embodiments, Z1b is optionally selected from Formula IIa-Formula IIi; and/or optionally selected from Formula IIIa-Formula IIIi.

In at least some embodiments, the insulin does not comprise Z1a and/or Z1b. In some embodiments, Z1a is not present. In some embodiments, Z1b is not present. In at least some embodiments, Z1a and/or Z1b are not present.

In some embodiments, each K residue when present in insulin is optionally and independently covalently conjugated as described by Formula I, and wherein Z1c is any one of formulae FF1-FF231 and the B1 and B2 are each independently selected from F3 and F4.

In some embodiments, each K residue when present in insulin is optionally and independently covalently conjugated as described by Formula I, wherein Z1c is any one of formulae:

Formulae FF1-F22 and the B1 and B2 are each independently selected from F3 and F4;

Formulae FF23-FF48 and the B1 and B2 are each independently selected from F3 and F4;

Formulae FF49-FF88 and the B1 and B2 are each independently selected from F3 and F4;

Formulae FF89-FF112 and the B1 and B2 are each independently selected from F3 and F4;

Formulae FF113-FF136 and the B1 and B2 are each independently selected from F3 and F4;

Formulae FF137-FF160 and the B1 and B2 are each independently selected from F3 and F4;

Formulae FF160-FF166 and the B1 and B2 are each independently selected from F3 and F4;

Formulae FF167-FF224 and the B1 and B2 are each independently selected from F3 and F4; or Formulae FF225-FF231 and the B1 and B2 are each independently selected from Formulae F3-F11.

In some embodiments, Z1b is optionally selected from Formula IIa-Formula IIi and Formula IIIa-Formula IIIi.

In some embodiments, Z1a and/or Z1b are not present.

In some embodiments, each K residue is optionally and independently covalently conjugated as described by Formula I, wherein Z1c is any one of Formulae FF1-F224 and the B1 and B2 are each independently selected from F5, F6, F7, and F8.

In some embodiments, each K residue when present in insulin is optionally and independently covalently conjugated as described by Formula I, wherein Z1c is any one of formulae:

Formulae FF1-F22 and the B1 and B2 are each independently selected from F5, F6, F7, and F8;

Formulae FF23-FF48 and the B1 and B2 are each independently selected from F5, F6, F7, and F8;

Formulae FF49-FF88 and the B1 and B2 are each independently selected from F5, F6, F7, and F8;

Formulae FF89-FF112 and the B1 and B2 are each independently selected from F5, F6, F7, and F8;

Formulae FF113-FF136 and the B1 and B2 are each independently selected from F5, F6, F7, and F8;

Formulae FF137-FF160 and the B1 and B2 are each independently selected from F5, F6, F7, and F8;

Formulae FF160-FF166 and the B1 and B2 are each independently selected from F5, F6, F7, and F8;

Formulae FF167-FF224 and the B1 and B2 are each independently selected from F5, F6, F7, and F8; or Formulae FF225-FF231 and the B1 and B2 are each independently selected from Formulae F3-F11.

In some embodiments, Z1b is optionally selected from Formula IIa-Formula IIi and Formula IIIa-Formula IIIi.

In some embodiments, Z1a and/or Z1b are not present.

In some embodiments, each K residue when present in insulin is optionally and independently covalently conjugated as described by Formula I, wherein Z1c is any one of 643 644 formulae FF1-F224and the B1 and B2 are each independently selected from F9 and F10.

In some embodiments, each K residue when present in insulin is optionally and independently covalently conjugated as described by Formula I, wherein Z1c is any one of formulae:

Formulae FF1-F22 and the B1 and B2 are each independently selected from F9 and F10;

Formulae FF23-FF48 and the B1 and B2 are each independently selected from F9 and F10;

Formulae FF49-FF88 and the B1 and B2 are each independently selected from F9 and F10;

Formulae FF89-FF112 and the B1 and B2 are each independently selected from F9 and F10;

Formulae FF113-FF136 and the B1 and B2 are each independently selected from F9 and F10;

Formulae FF137-FF166 and the B1 and B2 are each independently selected from F9 and F10;

Formulae FF167-FF224 and the B1 and B2 are each independently selected from F9 and F10; or Formulae FF225-FF231 and the B1 and B2 are each independently selected from Formulae F3-F11.

In some embodiments, $B_1$ and $B_2$ in Formulae FF225-FF231 are not a boronic acid, or an F2 or F6 aromatic boron-containing group, wherein Formulae F2 and F6 are:

(F2)

(F6)

$R_1$ at position 4' or position 5' represents (C=O)—*, wherein —* represents the attachment point to the rest of Z1c;

zero, one, or two $R_1$ represents F, Cl, $CF_2$, $CF_3$, $SF_5$, $OCF_3$, $SO_2CH_3$, and/or $SO_2CF_3$, and each remaining $R_1$ represents H;

Y8 is O; and i is 1.

In some embodiments, B1, B2, B3 are each independently Formula F7A, (F7A)

wherein:

$R_1$ at position 5' represents (C=O)—*, wherein —* represents the attachment point to the rest of Z1c or a compound; and each remaining $R_1$ is selected from H, F and $CF_3$. In some embodiments, each remaining $R_1$ is H.

In some embodiments, Z1b is not present in insulin (i.e., insulin analog) and wherein Z1a is a polypeptide that is covalently linked by a peptide bond to the N-terminus of the B-chain of insulin and/or Z1a is a polypeptide that is covalently linked by a peptide bond to the N-terminus of the B-chain of insulin C-terminus of A-chain of insulin.

In some embodiments, Z1b may be present in insulin. If present in insulin, Z1b is optionally selected from Formula IIa-Formula IIi and Formula IIIa-Formula IIIi.

In some embodiments, Z1b is not present in insulin. In some embodiments, Z1a is not present. In at least some embodiments, Z1b and/or Z1a are not present.

In some embodiments, a therapeutically-effective amount of a pharmaceutical composition of the present disclosure may be administered to a subject. In some embodiments, the pharmaceutical composition comprises at least one compound disclosed herein (e.g., Formula I, Formula IB, Formula IF) and a pharmaceutically acceptable carrier.

In some embodiments, a compound disclosed herein is used as a medicament.

In some embodiments, the disclosure provides a method of treatment or prevention of diabetes, impaired glucose tolerance, hyperglycemia or metabolic syndrome, comprises administering to a subject in need thereof a therapeutically effective amount of a compound disclosed herein or a pharmaceutical composition disclosed herein.

In some embodiments, the pharmaceutical composition comprises one or more polyalcohols. In some embodiments, the polyalcohols are selected from mannitol, sorbitol, erythritol, isomalt, lactitol, glucose, and maltitol.

In some embodiments, the pharmaceutical composition comprises at least one compound disclosed herein for use as a medicament for the treatment of diabetes or obesity, for control of blood sugar levels, or for control of release of a drug.

In some embodiments, the present disclosure provides a method of administering the compounds disclosed herein or a pharmaceutical composition disclosed herein to a subject as a therapeutic or prophylactic agent.

In some embodiments, the disclosure provides a method of making a compound as disclosed herein comprising at least one alkylation and/or amidation step.

In some embodiments, the disclosure provides a method of treating a subject by administering a device or formulation comprising a compound as disclosed herein, such as Examples 1A-82A. For example, the device can be a fixed dose injector, microdosing injector, an internal or external patch.

In some embodiments, the compound of the present disclosure may be used, as an intermediate in the manufacture/synthesis of a drug substance or a therapeutic of a prophylactic compound.

In another aspect, the disclosure provides a polypeptide comprising an A-chain and a B-chain, wherein the A-chain comprises a sequence selected from 1, 24051, and 24052; and wherein the B-chain comprises a sequence selected from 25000-25397. In some embodiments, the A-chain comprises a sequence selected from 1, 24051, and 24052, and the B-chain comprises a sequence selected from 24063, 25228, 25229, 25000, 25001, 25006-25009, 25076, 25077, 25082-25085, 25228, 25229, 25232, 25234-25237, 25304, 25305, 25308, and 25310-25313. In some embodiments, the A-chain comprises a sequence selected from 1 and 24051, and wherein the B-chain comprises a sequence selected from 24063, 25228, 25229, 25011, 25012, 25017-25020, 25087, 25088, 25093-25096, 25229, 25239, 25232, 25240, 25245-25248, 25305, 25308, 25315, 25316, and 25321-25324.

In some embodiments, the A-chain comprises a sequence selected from 1 and 24051, and the B-chain comprises a sequence selected from 24063, 25228, 25229, 25232, 25234-25237, 25304, 25305, 25308, and 25310-25313,.

In some embodiments, the agonist potency of a compound disclosed herein is determined by measuring the compound's potency for activation of a receptor (e.g., insulin receptor). In some embodiments, the present disclosure provides a compound having agonist potency for an insulin receptor comprising at least one aromatic boron-containing group, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 16.7 mM the compound has an insulin receptor agonist potency ratio of the first EC50 to the second EC50 of about 1.2 to about 20, about 1.5 to about 15, about 2 to about 14, about 2.5 to about 13, about 2.5 to about 12, about 2.5 to about 11, about 2.5 to about 10, about 2.5 to about 9, about 2.5 to about 8, about 2.5 to about 7, about 2.5 to about 6, about 2.5 to about 5, or about 2:5 to about 4.5 In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 16.7 mM the compound has an insulin receptor agonist potency ratio of the first EC50 to the second EC50 of about 1 to about 15, about 1 to about 10, about 2 to about 9, about 2 to about 8, about 3 to about 7, or about 3 to about 6. In some embodiments, when the first glucose concentration is 5.6 mM and the second glucose concentration is 16.7 mM the compound has an insulin receptor agonist potency ratio of the first EC50 to the second EC50 of at least or up to about 1, 2, 3, 4, 5, 6, 7, 8, 9, 10, 11, 12, 13, 14, or 15. In some embodiments, the compound has an insulin receptor agonist potency ratio of the first EC50 to the second EC50 of about 2, 3, 4, 5, 6, 7, 8, 9, 10, 11, 12, 13, or 14.

In some embodiments, the present disclosure provides a compound comprising at least one aromatic boron-containing group having agonist potency for an insulin receptor, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 16.7 mM the compound has an insulin receptor agonist potency ratio of the first EC50 to the second EC50 of about 1.2 to about 14, about 1.3 to about 13, about 1.4 to about 12, about 1.5 to about 11, about 2 to about 10, about 3 to about 9, or about 3 to about 5. In some embodiments, when the first glucose concentration is 5.6 mM and the second glucose concentration is 16.7 mM the compound has an insulin receptor agonist potency ratio of the first EC50 to the second EC50 of at least or up to about 1.2, 1.3, 1.4, 1.5, 2, 3, 4, or 5.

In some embodiments, the present disclosure provides a compound comprising at least one diboronate sensor having binding affinity to glucose.

In some embodiments, the present disclosure provides a compound comprising at least one aromatic boron-containing group having binding affinity for glucose, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of 1 to about 2500, about 1 to about 2000, about 1 to about 1500, about 100 to about 1500, and about 1000 to about 1500, and a relative glucose infusion rate ratio of about 0.1 to about 5, about 0.2 to about 4.5, about 0.5 to about 4, about 0.5 to about 3.5, about 1 to about 3.5, about 1.5 to about 3.5, or about 2 to about 3.

In some embodiments, the compound provides a relative glucose infusion rate difference (mg/kg/min·min) of at least about 50, 100, 200, 300, 400, 500, 1000, 1500, or 2000 and/or a relative glucose infusion rate ratio of at least about 1.5, 2, 2.5, 3, 3.5, 4, or 4.5.

In some embodiments, the present disclosure is directed to a compound comprising at least one aromatic boron-containing group having agonist potency for an insulin receptor, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL, the compound has a relative glucose infusion rate difference (mg/kg/min·min) of about 700 to about 2500, about 750 to about 2500, about 800 to about 2500, about 850 to about 2500, about 900 to about 2500, and a relative glucose infusion rate ratio of about 2 to about 4, about 2 to about 3, or about 3 to about 4.

In some embodiments, the present disclosure provides a compound having agonist potency for glucose comprising at least one aromatic boron-containing group having binding affinity for glucose, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of about 1 to about 2000, about 1 to about 1500, about 100 to about 1500, and about 1000 to about 1500, and a relative glucose infusion rate ratio of about 0.1 to about 5, about 0.2 to about 4.5, about 0.5 to about 4, about 0.5 to about 3.5, or about 1 to about 3. In some embodiments, the compound provides a relative glucose infusion rate difference (mg/kg/min·min) of at least about 50, 100, 200, 300, 400, 500, 600, 700, 800, 900, 1000, 1100, 1200, 1300, 1400, 1500, or 2000, and/or a relative glucose infusion rate ratio of at least or up to about 1.5, 2, 2.5, 3, 3.5, 4, or 4.5.

In some embodiments, at least one aromatic boron-containing group is attached to an FF scaffold, wherein the FF scaffold is selected from Formulae FF1-FF231 (e.g., FF1-FF12, FF12A, FF12B, FF12C, FF12D, FF13-FF116, FF116A, FF116B, FF116C, FF116D, and FF117-FF231).

In some embodiments, the present disclosure provides a compound comprising at least one aromatic boron-containing group having binding affinity for glucose, wherein when administered at a dose of 10 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of 150 to 1500 and a relative glucose infusion rate ratio of about 1 to about 3. In some embodiments, the compound provides a relative glucose infusion rate difference (mg/kg/min·min) of at least about 150, 200, 250, 300, 450, 500, 600, 700, 800, 900, 1000, 1100, 1200, 1300, 1400, or 1500, and/or a relative glucose infusion rate ratio of at least or up to about 1, 1.5, 2, 2.5, 3, 3.5, or 4.

In some embodiments, the present disclosure provides a compound having agonist potency for glucose comprising at least one aromatic boron-containing group, wherein when administered at a dose of 60 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of about 100 to about 2500, about 100 to about 2000, about 100 to about 1700, about 200 to about 1500, about 300 to about 1000, about 400 to about 800, and about 400 to about 700, and a relative glucose infusion rate ratio of about 1 to about 3.5, about 1 to about 3, about 1 to about 2.5, about 0.5 to about 2, or about 1 to about 1.5.

In some embodiments, the least one aromatic boron-containing group is attached to an FF scaffold, wherein the FF scaffold is selected from Formulae FF12A, FF12B, FF12C, FF12D, FF116A, FF116B, FF116C, FF116D, FF225, and FF227.

In some embodiments, at least one aromatic boron-containing group comprises at least one $B_1$ and $B_2$, which may be identical or different. In some embodiments, the at least one of the $B_1$ and the $B_2$ is Formula F2 or Formula F7.

In some embodiments, the present disclosure provides a compound (e.g., Formula I or Formula IB) comprising a diboronate covalently conjugated to an amine in X1, and a diol or polyol containing moiety conjugated to an amine in X1. In some embodiments, X1 is an insulin or analog thereof comprising an A-chain and a B-chain. In some embodiments, the amine to which the diboronate is covalently conjugated is at or near the C-terminus of the B-chain, preferably to an amine of a B29 lysine or a B21 lysine, and the amine to which the polyol is conjugated is at or near the N-terminus of the A-chain or B chain. In some embodiments, the amine to which the polyol is covalently conjugated is at or near the C-terminus of the B-chain, preferably to an amine of a B29 lysine or a B21 lysine, and the amine to which the diboronate is conjugated is at or near the N-terminus of the A-chain or B chain.

In some embodiments, the present disclosure provides a compound having binding affinity for glucose comprising at least one aromatic boron-containing group comprising at least one diboronate sensor having affinity to glucose.

In some embodiments, the present disclosure is directed to a compound having agonist potency for an insulin receptor comprising at least one aromatic boron-containing group comprising at least one diboronate sensor having affinity to glucose (e.g., diboronate sensor, such as DSL-1 to DSL-172). In some embodiments, the compound is selected from Examples 1A-82A. In some embodiments, at least one aromatic boron-containing group comprising at least one diboronate sensor has binding affinity to glucose. In some embodiments, a compound comprising two or more diboronate sensors has higher affinity to glucose. In some embodiments, a compound comprising three or more diboronate sensors has higher affinity to glucose.

In some embodiments, the binding constants of DSL compounds, such as DSL-1A to DSL-172A, to glucose, fructose, and/or lactate can be tested and calculated.

Methods of Preparation

In some embodiments, the present disclosure provides a method to prepare a compound comprising an aromatic boron-containing compound and/or an aromatic boron-containing group (e.g., Z1c, Z1c-Linker) or a pharmaceutical preparation comprising one or more compounds of the present disclosure.

In some embodiments, the disclosure provides a method for preparing rotationally constrained tether boron conjugates that contain scaffolds (Z1c, Z1c-Linker) that are rotationally hindered by disfavored steric interactions (e.g. gauche vs anti interactions of substituents), hindered rotation due to bond hybridization (e.g., cis- vs trans-amide rotations), or through rigid covalent bonds (e.g., (E) vs (Z) configurations for alkene moieties). For example, Formulae FF50-FF62, FF116, FF116, FF116A, FF116B, FF116C, FF116D, and FF121-FF134 contain alkyl functionalities geminal (e.g., attached to the same atom) to the amine groups that are covalently conjugated to the boronic acid functionalized moieties. As another example, one or more of Formulae FF50-FF62, FF116, FF116, FF116A, FF116B, FF116C, FF116D, and, and FF121-FF134 contain geminal alkyl substituents which may limit the accessible dihedral angles that the boron conjugated amines adopt, influencing adopted dihedral angles and placing the boronic functionalized groups closer together and allowing for increased binding of the conjugates to target molecules such as proteins or sugars.

In some embodiments, a compound as disclosed herein is further modified through connection (e.g., conjugation, fusion, etc.) to a second agent or therapy to form a fusion protein. In some embodiments, the second agent or therapy is a protein or peptide as herein described. In some embodiments, the second agent is a drug substance, wherein the drug substance is a polypeptide human hormone, an endocrine hormone, insulin, human insulin, glucagon or a glucagon analog, amylin, relaxin, GLP-1, oxyntomodulin, somatostatin, gastric inhibitory polypeptide, glucose-dependent insulinotropic polypeptide, a hybrid peptide comprising sequences from two or more human polypeptide hormones, or an analogue thereof. In some embodiments, the fusion protein comprises one or more diboronate sensor(s) as described herein. In some embodiments, two or more agents are connected (e.g., conjugation, fusion, etc.) to produce a fusion protein comprising one or more diboronate sensor(s). In some embodiments, the two or more agents are proteins or peptides as herein described. The biological activity (e.g., agonist potency, bioavailability, etc.) of the compounds and compositions or methods of treatment described herein may be evaluated according to methods known by those skilled in the art. In some embodiments, the biological activity of a compound is determined by evaluating the EC50 of a compound. In some embodiments, the biological activity of a compound is determined using an insulin receptor phosphorylation (IR Phosphorylation) assay disclosed herein. In some embodiments, the biological activity of a compound is determined by evaluating the binding affinity (Kd) of a compound for its target. In some embodiments, the biological activity of a compound is determined by assessing the relative glucose rate difference. In some embodiments, the biological activity of a compound is determined by assessing the relative glucose rate ratio.

Methods of Treatment

In some embodiments, the disclosure provides a method of treating a subject suffering from, or susceptible to, a disease that is beneficially treated by a compound disclosed herein or a pharmaceutical preparation comprising one or more of the compounds disclosed herein. In some embodiments, the method comprises the step of administering to a subject in need thereof an effective amount of a pharmaceutical preparation/composition of the present disclosure. In at least one embodiment, the compound(s) and/or pharmaceutical preparations of the present disclosure may be for use in (or in the manufacture of medicaments for) the treatment or prevention of disorders, including hyperglycemia, type 2 diabetes, impaired glucose tolerance, type 1 diabetes, obesity, metabolic syndrome X, or dyslipidemia, diabetes during pregnancy, pre-diabetes, Alzheimer's disease, MODY 1, MODY 2 or MODY 3 diabetes, neurological diseases, mood disorders, and psychiatric disorders. In at least one embodiment, a therapeutically-effective amount of a compound and/or pharmaceutical preparation of the present disclosure is administered to a subject suffering from diabetes. In some embodiments, the diabetes is type 1 diabetes or type 2 diabetes. In some embodiments, the diabetes is type 1 diabetes. In some embodiments, the diabetes is type 2 diabetes.

In some embodiments, when a first active agent is administered with a second (another) active agent the dose may be adjusted so that the activity of the two treatments combined is sufficient to regulate blood glucose levels in a patient. Thus, the amount of a first active agent or second active agent that can be administered to regulate blood glucose levels in such combinations may be less than would be required if the first active agent or second active agent were administered as a monotherapy.

Exemplary Compounds

The following are non-limiting Examples of compounds that can be prepared according to the methods described herein. In some embodiments, the compound of the present disclosure is selected from:

Example 1A 651 652

-continued

Example 2A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

Example 3A

H—G—I—V—E—Q—C—C—T—S—I—C—S—L—Y—Q—L—E—N—Y—C—N—OH

653

654

-continued

H—G—K—G—S—H—K—F—V—N—Q—H—L—C—G—S—H—L—V—E—A—L—Y—L—V—C—G—K—R—G—F—F—Y—T—P—R—OH

Example 4A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

-continued

Example 5A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

Example 6A

H—G—I—V—E—Q—C—C—T—S—I—C—S—L—Y—Q—L—E—N—Y—C—N—OH

657                                                    658

-continued

H—G—K—G—S—H—K—F—V—N—Q—H—L—C—G—S—H—L—V—E—A—L—Y—L—V—C—K—R—G—F—F—Y—T—P—R—OH

Example 7A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—K—R—G—F—F—Y—T—P—R—OH

Example 8A

H—G—I—V—E—Q—C—C—T—S—I—C—S—L—Y—Q—L—E—N—Y—C—N—OH

659

660

-continued

H—G—K—G—S—H—K—F—V—N—Q—H—L—C—G—S—H—L—V—E—A—L—Y—L—V—C—G—K—R—G—F—F—Y—T—P—R—OH

Example 9A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

-continued

Example 10A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

Example 11A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

-continued

Example 12A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH

Example 13A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

665                                                666

-continued

Example 14A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-R-G-F-F-Y-T-P-R—OH

667

668

-continued

Example 15A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 16A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 17A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

Example 18A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

673

674

-continued

Example 19A 675 676

-continued

Example 20A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

Example 21A

H–G–I–V–E–Q–C–C–T–S–I–C–S–L–Y–Q–L–E–N–Y–C–N–OH

H–G–K–G–S–H–K–F–V–N–Q–H–L–C–G–S–H–L–V–E–A–L–Y–L–V–C–G–K–R–G–F–F–Y–T–P–R–OH

-continued

Example 22A

-continued

Example 23A

-continued

Example 24A

-continued

Example 25A

-continued

Example 26A

-continued

Example 27A

-continued

Example 28A

-continued

Example 29A

-continued

Example 30A

697

698

Example 31A

-continued

Example 32A 701                                                                 702

Example 33A

H–G–I–V–E–Q–C–C–T–S–I–C–S–L–—–Y–Q–L–E–N–Y–C–N–OH

H–G–K–G–S–H–K–F–V–N–Q–H–L–C–G–S–H–L–V–E–A–—–L–Y–L–V–C–G–K–R–G–F–F–Y–T–P–R–OH

-continued

Example 34A

Example 35A

-continued

-continued

Example 36A

-continued

Example 37A

H-G-I-V-E-Q-C-C-T-S-I-C-S-L——Y-Q-L-E-N-Y-C-N-OH
|                                                      |
H-G-K-G-S-H-K-F-V-N-Q-H-L-C-G-S-H-L-V-E-A——L-Y-L-V-C-G-K-R-G-F-F-Y-T-P-R-OH

Example 38A

-continued

Example 39A 715 716

Example 40A

-continued

Example 41A

-continued

Example 42A

-continued

Example 43A

-continued

Example 44A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—R—G—F—F—Y—T—P—R—OH

Example 45A

-continued

H—G—I—V—E—Q—C—C—T—S—I—C—S—L—Y—Q—L—E—N—Y—C—N—OH

H—G—S—H—L—V—E—A—L—Y—L—V—C—G—K—R—G—F—F—Y—T—P—R—OH

H—G—K—G—S—H—K—F—V—N—Q—H—L—C—G—S—

-continued

Example 46A

-continued

Example 47A

-continued

Example 48A

-continued

Example 49A

H—G—I—V—E—Q—C—C—T—S—I—C—S—L—Y—Q—L—E—N—Y—C—N—OH

H—G—K—S—H—K—F—V—N—Q—H—L—C—G—S—H—L—V—E—A—L—Y—L—V—C—G—K—R—G—F—F—Y—T—P—R—OH

Example 50A

-continued

Example 51A

-continued

Example 52A

Example 53A

-continued

-continued

Example 54A 745            746

Example 55A

-continued

-continued

Example 56A

-continued

Example 57A

Example 58A

-continued

Example 59A

H—G—I—V—E—Q—C—C—T—S—I—C—S—L—Y—Q—L—E—N—Y—C—N—OH

H—G—S—H—K—F—V—N—Q—H—L—C—G—S—H—L—V—E—A—L—Y—L—V—C—G—K—R—G—F—F—Y—T—P—R—OH

Example 60A

-continued

US 12,655,188 B2

757 758

-continued

Example 61A

Example 62A

-continued

-continued

Example 63A 763 764

Example 64A

Example 65A

-continued

Example 66A

-continued

H—G—I—V—E—Q—C—C—T—S—I—C—S—L—Y—Q—L—E—N—Y—C—N—OH

H—G—S—H—K—F—V—N—Q—H—L—C—G—S—H—L—V—E—A—L—Y—L—V—C—G—K—R—G—F—F—Y—T—P—K—A

-continued

Example 67A

Example 68A

-continued

Example 69A

Example 70A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

Example 71A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

777                                                                 778

-continued

Example 72A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 73A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

Example 74A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

781                                                                                                    782

Example 75A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

783

784

Example 76A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 77A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH

787

788

-continued

Example 78A

H-G-I-V-E-Q-C-C-T-S-I——C-S-L-Y-Q-L-E-N-Y-C—N—OH

H-G-K-G-S-H-K-F-V-N-Q——H-L-C-G-S-H-L-V-E-A——L-Y-L-V-C-G-K-R-G-F—F-Y-T-P-R—OH

789

790

Example 79A

H-G-I-V-E-Q-C-C-T-S-I——C-S-L-Y-Q-L-E-N-Y-C—N—OH

H-G-K-G-S-H-K-F-V-N-Q——H-L-C-G-S-H-L-V-E-A——L-Y-L-V-C-G-K-R-G-F—F-Y-T-P-R—OH

-continued

Example 80A

H-G-I-V-E-Q-C-C-T-S-I——C-S-L-Y-Q-L-E-N-Y-C—N—OH

H-G-K-G-S-H-K-F-V-N-Q——H-L-C-G-S-H-L-V-E-A——L-Y-L-V-C-G-K-R-G-F—F-Y-T-P-R—OH

Example 81A

H-G-I-V-E-Q-C-C-T-S-I——C-S-L-Y-Q-L-E-N-Y-C—N—OH

793

794

-continued

H-G-K-G-S-H-K-F-V-N-Q——H-L-C-G-S-H-L-V-E-A——L-Y-L-V-C-G-K-R-G-F——F-Y-T-P-R—OH

H-G-K-G-S-H-K-F-V-N-Q——H-L-C-G-S-H-L-V-E-A——L-Y-L-V-C-G-K-R-G-F——F-Y-T-P-R—OH

Example 82A

H-G-I-V-E-Q-C-C-T-S-I——C-S-L-Y-Q-L-E-N-Y-C—N—OH

H-G-K-G-S-H-K-F-V-N-Q——H-L-C-G-S-H-L-V-E-A——L-Y-L-V-C-G-K-R-G-F——F-Y-T-P-R—OH

795

796

-continued

Example 83A

H-G-I-V-E-Q-C-C-T-S-I———————C-S-L-Y-Q-L-E-N-Y-C—N—OH

H-G-K-G-S-H-K-F-V-N-Q——H-L-C-G-S-H-L-V-E-A———L-Y-L-V-C-G-K-R-G-F—F-Y-T-P-R—OH

-continued

Example 84A

H-G-I-V-E-Q-C-C-T-S-I—C-S-L-Y-Q-L-E-N-Y-C—N—OH

H-G-K-G-S-H-K-F-V-N-Q—H-L-C-G-S-H-L-V-E-A—L-Y-L-V-C-G-K-R-G-F—F-Y-T-P-R—OH

-continued

Example 85A

H-G-I-V-E-Q-C-C-T-S-I——C-S-L-Y-Q-L-E-N-Y-C—N—OH

H-G-K-G-S-H-K-F-V-N-Q——H-L-C-G-S-H-L-V-E-A——L-Y-L-V-C-G-K-R-G-F—F-Y-T-P-R—OH

40

801                                                                                            802

Example 1

Example 2

-continued

Example 3

-continued

H—G—I—V—E—Q—C—C—T—S—I—C—S—L—Y—Q—L—E—N—Y—C—N—OH

H—G—K—P—G—S—H—K—P—F—V—N—Q—H—L—C—G—S—H—L—V—E—A—L—Y—L—V—C—G—K—R—G—F—F—Y—T—P—K—T—OH 807          808

-continued

Example 4

-continued

Example 5

811

812

Example 6

Example 7

-continued

813 814

Example 8

-continued

Example 9

-continued

817          818

Example 10

-continued

H-G-I-V-E-Q-C-C-T-S-I-C-S-L-Y-G-L-E-N-Y-C-N-OH

H-K-P-G-G-G-E-A-E-G-E-S-A-K-P-G-S-E-G-E-S-V-N-Q-H-L-C-G-S-H-L-V-E-A-L-Y-L-V-C-G-K-R-G-F-F-Y-T-P-K-T-OH

-continued

Example 11

821                                                                 822

Example 12:

H—K—G—R—E—D—E—A—Y—G—N—I—K—P—G—W—E—G—E—S—K—P—

H—G—I—V—E—Q—C—C—T—S—I—C—S—L—V—Q—L—E—N—Y—C—N—K—P—S—E—S—G—OH

—F—V—N—Q—H—L—C—G—S—H—L—V—E—A—L—Y—L—V—C—G—K—P—G—R—P—Y—T—P—K—T—OH

-continued

Example 13:

H—G—S—E—K—P—L—K—P—T—K—S—Q—E—T—A—Q—T—A—D—T—

—P—L—E—A—W—N—I—K—R—A—G—W—E—G—E—S—F—V—N—

H—G—I—V—E—C—C—C—T—S—I—C—S—L—V—G—L—E—N—Y—C—N—K—P—E—A—E—F—OH

—Q—H—L—C—G—S—H—L—V—E—A—L—Y—L—V—C—G—K—R—G—F—F—Y—T—P—K—T—OH 825 826

Example 14:

H—G—S—K—P—E—L—P—K—P—E—A—K—L—P—T—A—Q—W—N—I—K—P—A—G—W—E—G—E—

H—G—I—V—E—Q—C—C—T—S—I—C—S—L—Y—Q—L—G—N—Y—C—N—G—S—E—K—P—E—S—G—OH

—S—F—V—N—Q—H—L—C—G—S—H—L—V—E—A—L—Y—L—V—C—G—K—R—G—F—F—Y—T—P—K—T—OH

-continued

Example 15:

H—G—I—V—E—Q—C—C—T—S—I—G—

H—K—P—V—E—A—P—K—P—G—E—S—H—R—F—G—N—F—V—N—Q—H—L—C—G—S—H—L—

—S—L—Y—Q—L—E—N—Y—C—N—K—P—G—S—E—K—P—E—S—G—OH

—V—E—A—L—Y—L—V—C—G—R—G—F—F—Y—T—P—K—T—OH 829 830

-continued

Example 16:

H—G—I—V—E—Q—C—C—T—S—I—C—

H—G—V—E—A—A—I—P—A—G—K—P—E—G—K—S—A—G—E—T—F—G—E—S—F—V—N—Q—H—L—C—G—S—H—

—S—L—Y—Q—L—E—N—Y—C—N—G—S—K—G—E—K—E—S—G—OH

—L—V—E—A——L—Y—L—V—C—G—K—R—G—F—F—Y—T—P—K—T—OH

-continued

Example 17:

H—G—I—V—K—Q—C—C—T—S—I——C—

H—G—V—A—A—P—P—G—A—G—K—S—A—G—S—R—T—D—F—G—E—G—E—S—F—V—N—Q—H—L—C—G—S—H—

833                                                                                          834

-continued

Example 18:

835 836

-continued

—S—L—Y—Q—L—E—N—Y—C—N—OH

—L—V—E—A—L—Y—L—V—C—G—K—R—G—F—F—Y—T—P—K—T—OH

Example 19:

H—G—I—V—E—Q—C—C—T—S—I—C—

H—K—P—G—S—E—G—E—S—A—K—P—G—S—E—G—E—S—V—N—Q—H—L—C—G—S—H—L—

—S—L—Y—Q—L—E—N—Y—C—N—OH

—V—E—A—L—Y—L—V—C—G—K—R—G—F—F—Y—T—P—K—T—OH

Example 20:

H—G—I—V—E—Q—C—C—T—S—I—C—

H—K—P—G—S—E—V—G—E—S—A—I—K—P—G—S—E—G—E—S—V—N—Q—H—L—C—G—S—H—L—

-continued

—G—L—Y—O—L—E—N—Y—C—N—OH

—V—E—A—L—Y—L—V—C—G—K—R—G—F—F—Y—T—P—K—T—OH

Example 21:

H—K—P—S—G—E—R—S—E—G—A—I—K—P—G—S—E—G—E—S—K—

H—G—I—V—E—Q—C—C—T—S—I—C—S—L—Y—Q—L—E—N—Y—C—N—OH

—F—V—N—Q—H—L—C—G—S—H—L—V—E—A—L—Y—L—V—C—G—K—R—G—F—R—Y—T—R—K—T—OH

-continued

Example 22:

H—G—I—V—E—O—C—C—T—S—I—C—

H—K—P—S—G—R—S—E—G—A—N—I—K—P—G—W—E—G—E—S—K—P—F—V—N—Q—H—L—C—G—S—H—L—V—

—S—L—Y—Q—L—E—N—Y—C—N—OH

—E—A—L—Y—L—V—C—G—K—R—G—P—F—Y—T—R—K—T—OH

Example 23:

H—S—G—R—S—E—G—A—Q—W—N—I—K—P—G—W—E—G—E—S—K—P—F—V—N—Q—H—L—

-continued

H—G—I—V—E—Q—C—C—T—S—I—C—S—L—Y—Q—L—E—N—Y—C—N—OH

—C—Q—S—H—L—V—E—A—L—Y—L—V—C—G—K—R—G—F—F—Y—T—P—K—T—OH

Example 24:

H—G—I—V—E—Q—C—C—T—S—I—C—S—

H—S—G—R—E—T—A—O—W—N—I—K—P—A—G—W—E—G—E—S—P—V—N—Q—H—L—C—G—S—H—

—L—V—O—L—E—N—Y—C—N—OH

—L—V—E—A—L—Y—L—V—C—G—K—R—G—F—F—Y—T—P—K—T—OH 843                                                                                      844

-continued

Example 25:

H—G—S—E—K—P—S—E—L—K—P—T—K—S—G—R—E—T—A—Q—W—N—I—K—P—A—G—W—E—O—E—S—

H—G—I—V—E—Q—C—C—T—S—I—C—S—L—Y—Q—L—E—N—Y—C—N—OH

—F—V—N—Q—H—L—C—G—S—H——L—V—E—A—L—Y—L—V—C—G—K—R—G—F—F—Y—T—P—K—T—OH

Example 26:

H—G—I—V—E—Q—C—C—T—S—I—C—

H—S—G—R—S—E—G—A—Q—W—N—I—K—P—G—W—E—G—E—S—K—P—F—V—N—Q—H—L—C—G—S—H—L—V—

845                                                                                      846

-continued

35

847

848

Example 27

H-G-I-V-K-C-C-T-S-I-C-S-L-Y-Q-L-E-N-Y-C-N-G-S-E-K-P-E-S-G-OH

H-G-I-V-K-C-C-T-S-I-C-S-L-Y-Q-L-E-N-Y-C-N-G-S-E-K-P-E-S-G-OH

H-G-S-E-K-P-S-E-L-K-P-T-K-S-G-R-E-T-A-Q-W-N-I-K-P-A-G-W-E-G-G-S-F-V-N-Q-H-L-C-G-S-H-L-V-E-A-L-Y-L-V-C-G-K-R-G-F-F-Y-T-P-K-T-OH 849 850

-continued

Example 28

H-G-I-V-K-Q-C-C-T-S-I-C-S-L-Y-Q-L-E-N-Y-C-N-K-P-G-S-E-K-P-E-S-G-OH

H-D-G-S-H-L-V-E-A-L-Y-L-V-C-G-K-R-G-F-F-Y-T-P-K-T-OH

H-K-G-E-V-E-S-A-I-P-G-K-S-E-G-E-S-F-V-N-Q-H-L-C-G-S-H-L-V-E-A-L-Y-L-V-C-G-K-R-G-F-F-Y-T-P-K-T-OH 851                                                                                                        852

-continued

Example 29

H-G-I-V-E-Q-C-C-T-S-I-C-S-L-Y-Q-L-E-N-Y-C-N-K-P-G-S-E-K-P-E-S-G-OH

H-G-V-E-A-I-P-K-P-E-A-G-K-S-E-G-E-S-F-V-N-Q-H-L-C-G-S-H-L-V-E-A-L-Y-L-V-C-G-K-R-G-F-F-Y-T-P-K-T-OH

-continued

Example 30

H-G-I-V-E-Q-C-C-T-S-I-C-S-L-Y-Q-L-E-N-Y-C-N-K-P-A-S-G-E-K-P-E-S-G-OH

H-G-V-E-A-E-I-P-K-P-G-E-A-G-K-S-A-G-E-G-E-S-F-V-N-Q-H-L-C-G-S-H-L-V-E-A-L-Y-L-V-C-G-K-R-G-F-F-Y-T-P-K-T-OH

Example 31

-continued

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-K-R-G-F-F-Y-T-P-K-T-OH 857    858

-continued

Example 32

H-G-I-V-E-Q-C-C-T-S-I-C-S-L-Y-Q-L-E-N-Y-C-N-OH

H-G-K-P-G-H-K-P-F-V-N-Q-H-L-C-G-S-H-L-V-E-A-L-Y-L-V-C-G-K-R-G-F-F-Y-T-P-K-T-OH

Example 33

H-G-I-V-E-Q-C-C-T-S-I-C-S-L-Y-Q-L-E-N-Y-C-N-K-OH

H-G-K-P-G-S-H-K-P-F-V-N-Q-H-L-C-G-S-H-L-V-E-A-L-Y-L-V-C-G-K-R-G-F-F-Y-T-P-K-T-OH

Example 34

-continued

H-G-I-V-K-Q-C-C-T-S-I-C-S-L-Y-Q-L-E-N-Y — C-N-K-OH

H-G-K-G-E-H-K-F-V-N-Q-H-L-C-G-S-H-L-V-E-A-L-Y-L-V-C-G-K-R-G-F-F-Y-T-P-K-T-OH

861

862

Example 35

G—I—V—E—Q—C—C—T—S—I—C

F—V—N—C—H—L—C—G—S—H——L—V—

Dap—A—G—K—K

—S—L—Y—O—L—E—N—Y—C—N—OH

—E—A—L—Y—L—V—C—G——E—R—G—F—F—Y—T—P—K—T—OH

-continued

Example 36

865                                                                866

Example 37

-continued

Example 38

-continued

Example 39

871 872

-continued

Example 40

-continued

Example 41

875                                                                                             876

Example 42

H—G—I—V—E—Q—C—C—T—S—I—C—

HN—F—V—N—Q—H—L—C—G—S—H—

—S—L—Y—Q—L—E—N—Y—C—N—OH

—L—V—E—A—L—Y—L—V—C—G—K—P—G—F—F—Y—T—P—R—T—OH

-continued

Example 43

H—G—I—V—E—Q—C—C—T—S—I—C

H—G—K—P—G—H—K—P—F—V—N—Q—H—L—C—G—S—H—

—S—L—Y—Q—L—E—N—Y—C—N—OH

—L—V—E—A—L—Y—L—V—C—G—K—P—G—F—F—Y—T—P—R—T—OH

-continued

Example 44

H—G—I—V—K—Q—C—C—T—S—I————C—

H—G—K—G—E—H—K—F—V—N—Q—H—L—C—G—S—H—L—

881                                                                                    882

-continued

Example 45

883 884

-continued

Example 46

889                                                                 890

Example 47

H—G-I-V-K-Q-C-C-T-S-I———C-S-L-Y-Q-L-E-N-Y-C—N-K—OH

H—G-K-S-A-E-K-F-V-N-Q—H-L-C-G-S-H-L-V-E-A—L-Y-L-V-C-G-K-P-G-F—F-Y-T-P-R-T—OH

Example 48

891                                                                                    892

H—G-I-V-E-Q-C-C-T-S-I⎯C-S-L-Y-Q-L-E-N-Y-C⎯N-K⎯OH

H⎯G-K-P-A-S-E-K-P-F-V⎯N-Q-H-L-C-G-S-H-L-V⎯⎯E-A-L-Y-L-V-C-G-K-P⎯G-F-F-Y-T-P-R-T⎯OH

Example 49

H⎯G-I-V-E-Q-C-C-T-S-I⎯C-S-L-Y-Q-L-E-N-Y-C⎯N⎯OH

H⎯K-P-G-S-E-H-E-S-A-F⎯V-N-Q-H-L-C-G-S-H-L⎯V-E-A-L-Y-L-V-C-G-E⎯R-G-F-F-Y-T-P-K⎯OH

-continued

Example 50

H—G-I-V-E-Q-C-C-T-S-I—C-S-L-Y-Q-L-E-N-Y-C—N-A-E-G-S-K—OH

H—K-P-G-S-E-H-E-S-A-F—V-N-Q-H-L-C-G-S-H-L—V-E-A-L-Y-L-V-C-G-E—R-G-F-F-Y-T-P-K—OH

Example 51

H—K-P-G-I-V-E-Q-C-C-T—S-I-C-S-L-Y-Q-L-E-N—Y-C-N—OH

H—K-P-G-S-E-H-E-S-A-F—V-N-Q-H-L-C-G-S-H-L—V-E-A-L-Y-L-V-C-G-E—R-G-F-F-Y-T-P-K—OH

895

896

-continued

Example 52

H—G-I-V-E-Q-C-C-T-S-I—C-S-L-Y-Q-L-E-N-Y-C—N-A-E-G-S-K—OH

H—K-P-G-S-E-H-E-S-A-F—V-N-Q-H-L-C-G-S-H-L—V-E-A-L-Y-L-V-C-G-E—R-G-F-F-Y-T-P-K—OH 897 898

-continued

Example 53

H—G-I-V-K-P-Q-C-C-T-S—I-C-S-L-Y-Q-L-E-N-Y—C-N—OH

H—K-P-G-S-E-H-E-S-A-F—V-N-Q-H-L-C-G-S-H-L—V-E-A-L-Y-L-V-C-G-E—R-G-F-F-Y-T-P-K—OH

Example 54

H—G-I-V-E-Q-C-C-T-S-I—C-S-L-Y-Q-L-E-N-Y-C—N—OH

H—K-P-G-S-E-H-E-S-A-F—V-N-Q-H-L-C-G-S-H-L—V-E-A-L-Y-L-V-C-G-E—R-G-F-F-Y-T-P-K—OH

899

900

901

902

Example 55

H—G-I-V-E-Q-C- C-T-S-I-C-S-L-Y-Q-L-E-N-Y-C-N-A-E-G-S-K—OH

H—K-P-G-S-E-H-E-S-A-F-V-N-Q-H-L-C-G-S-H-L-V-E-A-L-Y-L-V-C-G-E-R-G-F-F-Y-T-P-R-T—OH

903

904

Example 56

-continued

H—K-P-G-I-V-E-Q-C-C-T-S-I-C-S-L-Y-Q-L-E-N-Y-C-N—OH

H—K-P-G-S-E-H-E-S-A-F-V-N-Q-H-L-C-G-S-H-L-V-E-A-L-Y-L-V-C-G-E-R-G-F-F-Y-T-P-K—OH 905          906

Example 57

-continued

H—G-I-V-E-Q-C-C-T-S-I-C-S-L-Y-Q-L-E-N-Y-C-N-A-E-G-S-K—OH

H—K-P-G-S-E-H-E-S-A-F-V-N-Q-H-L-C-G-S-H-L-V-E-A-L-Y-L-V-C-G-E-R-G-F-F-Y-T-P-K—OH

-continued

Example 58

H—G-I-V-K-P-Q-C- C-T-S-I-C-S-L-Y-Q-L-E-N-Y-C-N—OH

H—K-P-G-S-E-H-E-S-A-F-V-N-Q-H-L-C-G-S-H-L-V-E-A-L-Y-L-V-C-G-E-R-G-F-F-Y-T-P-K—OH

Example 59

-continued

H—G-I-V-E-Q-C-C-T-S-I-C-S-L-Y-Q-L-E-N-Y-C-N—OH

H—K-P-G-S-E-H-E-S-A-F-V-N-Q-H-L-C-G-S-H-L-V-E-A-L-Y-L-V-C-G-E-R-G-F-F-Y-T-P-K—OH

-continued

Example 60

913                                          914

Example 61

Example 62

-continued

H—G-I-V-E-Q-C-C-T-S-I-C-S-L-Y-Q-L-E-N-Y-C-N-A-E-G-S-K—OH

H—K-P-G-S-E-H-E-S-A-F-V-N-Q-H-L-C-G-S-H-L-V-E-A-L-Y-L-V-C-G-E-R-G-F-F-Y-T-P-K—OH

-continued

Example 63

H—K-P-G-S-E-H-E-S-A-F-V-N-Q-H-L-C-G-S-H-L-V-E-A-L-Y-L-V-C-G-E-R-G-F-F-Y-T-P-K—OH

H—G-I-V-K-P-Q-C-C-T-S-I-C-S-L-Y-Q-L-E-N-Y-C-N—OH

Example 64
-continued
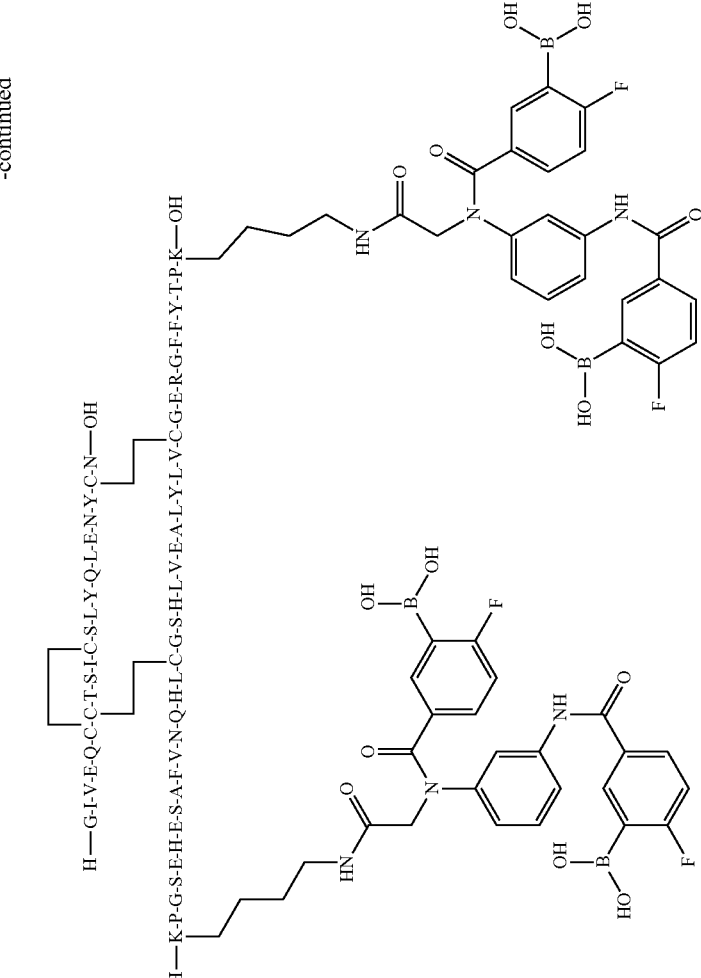

921                                                                 922

Example 65

H—G-I-V-E-Q-C-C-T-S-I-C-S-L-Y-Q-L-E-N-Y-C-N-A-E-G-S-K—OH

H—K-P-G-S-E-H-E-S-A-F-V-N-Q-H-L-C-G-S-H-L-V-E-A-L-Y-L-V-C-G-E-R-G-F-F-Y-T-P-R-T—OH 923 924

Example 66:

H—K—P—G—I—V—E—Q—C—C—T—S—I—C—

H—K—P—G—S—E—H—E—S—A—F—V—N—Q—H—L—C—G—S—H—L—V—

—S—L—Y—Q—L—E—N—Y—C—N—OH

—E—A—L—Y—L—V—C—G—E—R—G—F—F—Y—T—P—K—OH

-continued

Example 67:

H—K—P—G—I—V—E—Q—C—C—T—S—I—C—

H—K—P—G—S—E—H—E—S—A—F—V—N—Q—H—L—C—G—S—H—L—V—

—S—L—Y—Q—L—E—N—Y—C—N—OH

—E—A—L—Y—L—V—C—G—E—R—G—F—F—Y—T—P—K—OH

-continued

Example 68:

H—K—P—G—I—V—E—Q—C—C—T—S—I—C

H—K—P—G—S—E—H—E—S—A—F—V—N—Q—H—L—C—G—S—H—L—V

—S—L—Y—Q—L—E—N—Y—C—N—OH

—E—A—L—Y—L—V—C—G—E—R—G—F—F—Y—T—P—K—OH

929

930

Example 69:

-continued

Example 70:

-continued

Example 71:

-continued

Example 72:

H—G—I—V—E—Q—C—C—T—S—I—C—

H—K—P—G—S—E—H—E—S—A—F—V—N—Q—H—L—C—G—S—H

S—L—Y—Q—L—E—N—Y—C—N—A—E—G—S—K—OH

L—V—E—A—L—Y—L—V—C—G—E—R—G—F—F—Y—T—P—R—T—OH 937                                                             938

Example 73:

939

940

-continued

—S—L—Y—Q—L—E—N——V—C—N——OH

—E—A—L—Y—L—V—C—G—E——R—G—F—F—Y—T—P—K—OH 941                                                                                    942

Example 74

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-K-OH 943 944

Example 75

-continued

H-G-I-V-K-P-Q-C-C-T-S-I-C-S-L-Y-Q-L-E-N-Y-C-N-OH

H-G-I-V-K-P-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 76

-continued

H-K-P-G-S-E-H-E-S-A-F-V-N-Q-H-L-C-G-S-H-L-V-E-A-L-Y-L-V-C-G-E-R-G-F-F-Y-T-P-K-OH

H-G-I-V-E-Q-C-C-T-S-I-C-S-L-Y-Q-L-E-N-Y-C-N-OH

Example 77

-continued

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH

-continued

Example 78

H-K-P-G-I-V-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

951

952

Example 79

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 80

-continued

Example 81

-continued

H-G-I-V-K-P-Q-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

957 958

Example 82

-continued

H-G-I-V-K-P-Q-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH

Example 83

-continued

H-K-P-G-S-E-H-E-S-A-F-V-N-Q-H-L-C-G-S-H-L-V-E-A-L-Y-L-V-C-G-E-R-G-F-F-Y-T-P-K-OH

H-K-P-G-I-V-E-Q-C-C-T-S-I-C-S-L-Y-Q-L-E-N-Y-C-N-A-E-G-S-K-OH

Example 84

-continued

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 85

-continued

Example 86

H-G-I-V-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 87

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH

-continued

Example88

H-K-P-G-I-V-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 89

H-G-I-V-E-Q-C-C-T-S-I-C-S-L-Y-Q-L-E-N-Y-C-N-A-E-G-S-K-OH

969

970

-continued

H-K-P-G-S-E-H-E-S-A-F-V-N-Q-H-L-C-G-S-H-L-V-E-A-L-Y-L-V-C-G-E-R-G-F-F-Y-T-P-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 90

H-G-I-V-K-P-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH 971 972

-continued

Example 91

H-G-I-V-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 92

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH
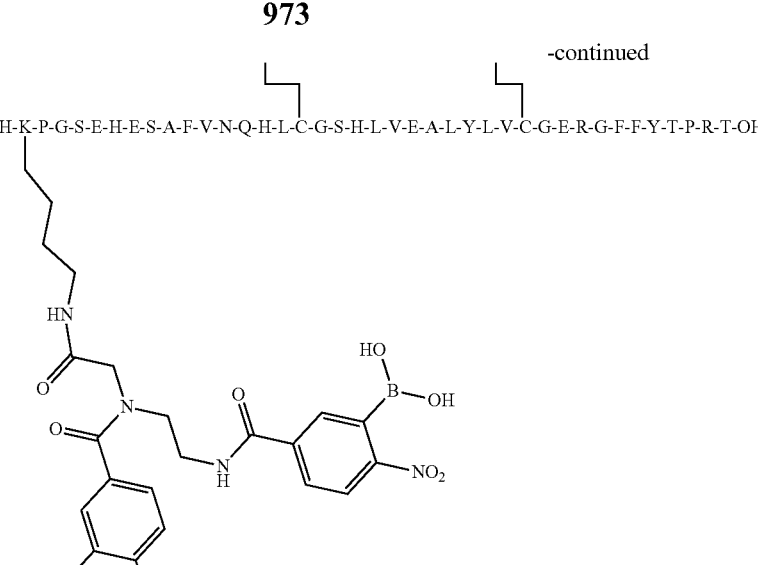

Example 93

Example 94

-continued

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 95

-continued

H-G-I-V-K-P-Q-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 96

-continued

H-G-I-V-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

-continued

Example 97

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH

985

986

Example 98

H-K-P-G-I-V-E-Q-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

987

988

-continued

Example 99

H-G-I-V-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-K-OH

-continued

Example 100

H-G-I-V-K-P-E-Q-C-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

991

992

Example 101

H-G-I-V-K-P-E-Q-C-T-S-I-C-S-L-Y-Q-L-E-N-Y-C-N-OH

H-K-P-G-S-E-H-E-S-A-F-V-N-Q-H-L-C-G-S-H-L-V-E-A-L-Y-L-V-C-G-E-R-G-F-F-Y-T-P-K-OH

Example 102

-continued

H-G-I-V-K-P-E-Q-C-C-T-S-I-C-S-L-Y-Q-L-E-N-Y-C-N-A-E-G-S-K-OH

H-K-P-G-S-E-H-E-S-A-F-V-N-Q-H-L-C-G-S-H-L-V-E-A-L-Y-L-V-C-G-E-R-G-F-F-Y-T-P-R-T-OH

Example 103

H–G–I–V–K–P–Q–C–C–T–S–I–C–S–L–Y–Q–L–E–N–Y–C–N–OH

H–K–P–G–S–E–H–E–S–A–F–V–N–Q–H–L–C–G–S–H–L–V–E–A–L–Y–L–V–C–G–E–R–G–F–F–Y–T–P–K–OH

-continued

Example 104

-continued

Example 105

1001

1002

Example 106

-continued

Example 107

-continued

-continued

Example 108

H—K—P—G—S—E—H—E—S—A—F—V—N—Q—H—L—C—G—S—H—L—V—E—A—L—Y—L—V—C—G—E—R—G—F—F—Y—T—P—K—OH
|
H—G—I—V—K—P—Q—C—C—T—S—I—C—S—L—Y—Q—L—E—N—Y—C—N—OH

1007　　　　　　　　　　　　　　　　1008

Example 109

-continued

-continued

Example 110

Example 111

-continued

Example 112

-continued

H–G–I–V–E–Q–C–C–T–S–I–C–S–L–Y–Q–L–E–N–Y–C–N–A–E–G–S–K–OH

H–K–P–G–S–E–H–E–S–A–F–V–N–Q–H–L–C–G–S–H–L–V–E–A–L–Y–L–V–C–G–E–R–G–F–F–Y–T–P–K–OH

Example 113

Exmaple 114

-continued

-continued

Exmaple 115

-continued

Example 116

Example 117

-continued

Exmaple 118

-continued

H—G—I—V—K—P—Q

H—K—P—G—S—E—H—E—S—A—F—V—N—Q—H—L—C—G—S—H—L—V—E—A—L—Y—L—C—G—E—R—G—F—F—V—T—P—K—OH

Q—C—C—T—S—I—C—S—L—Y—Q—L—E—N—Y—C—N—OH

Example 119

-continued

Exmaple 120

-continued

Example121

-continued

-continued

Example 122

-continued

Example 123

-continued

Example 124

Example 125

-continued

Example 126

Example 127

-continued

Example 128

-continued

-continued

Example 129

Example 130

-continued

-continued

Example 131

Example 132

-continued

Example 133

-continued

Example 134

-continued

-continued

Example 135

-continued

Example 136

1065                                                                                     1066

Example 137

-continued

1067                                                                 1068

Example 138

-continued

-continued
Example 139
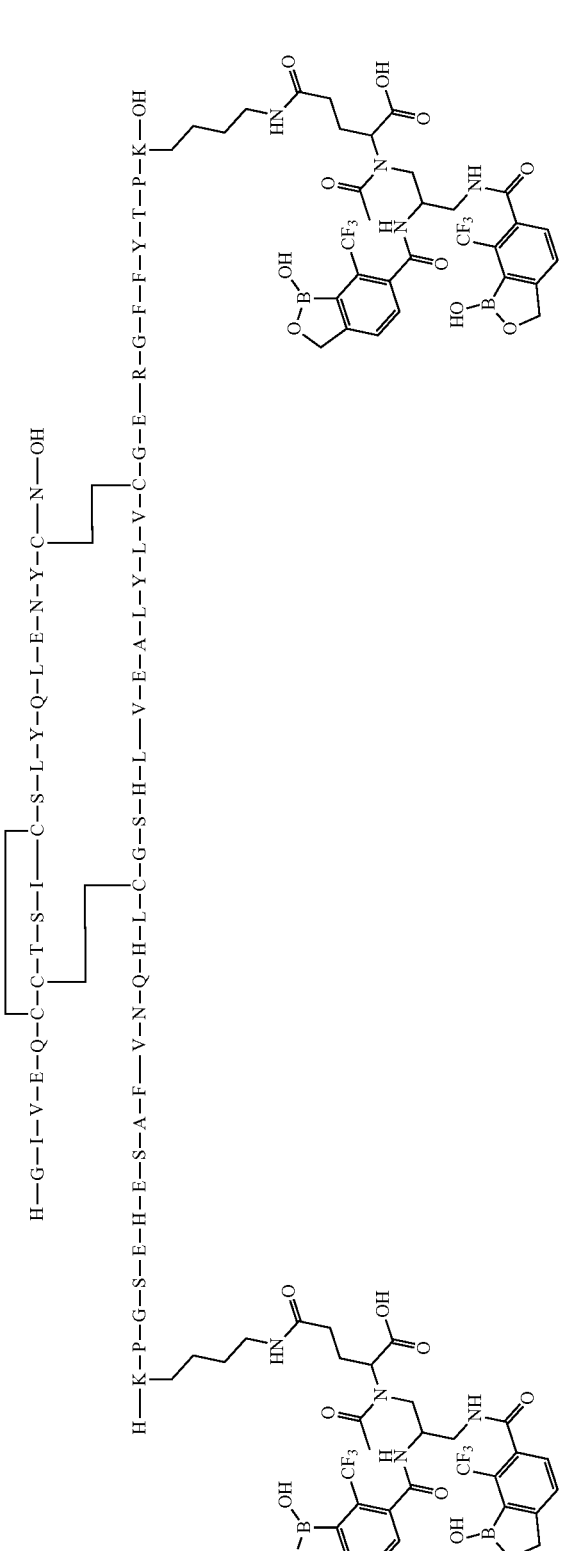

-continued

Example 140

H—G—I—V—E—Q—C—C—T—S—I—C—S—L—Y—Q—L—E—N—Y—C—N—A—E—G—S—K—OH

H—K—P—G—S—E—H—E—S—A—F—V—N—Q—H—L—C—G—S—H—L—V—E—A—L—Y—L—V—C—G—E—R—G—F—F—Y—T—P—R—T—OH

-continued

Example 141

-continued

Example 142

Example 143

-continued

-continued

Example 144

-continued

Example 145

Example 146

G—I-V-E-Q-C-C-T-S-I—C-S-L-Y-Q-

K—N—N—F-V-N-Q-H-L-C-G-S-H—

L-E-N-Y-C—N—OH

—L-V-E-A-L-Y-L-V-C-G—E-R-G-F-F-V-T-P-K-T—OH

Example 147

G—I-V-E-Q-C-C-T-S-I—C-S-L-Y-Q-L-E-N-Y-C—N—OH

—F-V-N-C-H-L-C-G-S-H—L-V-E-A-L-Y-L-V-C-G—E-R-G-F-F-Y-T-P-K-T—OH

-continued

Example 148

G—I-V-E-Q-C-C-T-S-I—C-S-L-Y-Q-L-E-N-Y-C—N—OH

—F-V-N-C-H-L-C-G-S-H—L-V-E-A-L-Y-L-V-C-G—E-R-G-F-F-Y-T-P-K-T—OH

Example 149

H—K-P-G-S-E-H-E-S-A-F—

G—I-V-E-Q-C-C-T-S-I—C-S-L-Y-Q-L-E-N-Y-C—N—OH

—V-N-Q-H-L-C-G-S-H-L—V-E-A-L-Y-L-V-C-G-E—R-G-F-F-Y-T-P-K—OH

1087

1088

-continued

Example 150

H—K-P-G-S-E-H-E-S-A-F——

H—G-I-V-E-Q-C-C-T-S-I—C-S-L-Y-Q-L-E-N-Y-C—N-A-E-G-S-K—OH

——V-N-Q-H-L-C-G-S-H-L—V-E-A-L-Y-L-V-C-G-E—R-G-F-F-Y-T-P-K—OH

-continued

Example 151

H—K-P-G-S-E-H-E-S-A-F——

H—K-P-G-I-V-E-Q-C-C-T—S-I-C-E-L-Y-Q-L-E-N—Y-C-N—OH

—V-N-Q-H-L-C-G-S-H-L—V-E-A-L-Y-L-V-C-G-E—R-G-F-F-Y-T-P-K—OH

1091                                                                1092

-continued

Example 152

H—K-P-G-S-E-H-E-S-A-F——

1093                                    1094

-continued

Example 153

H—K-P-G-S-E-H-E-S-A-F——

H—GI-V-K-P-Q-C-C-T-S—I-C—S-L-Y-Q-L-E-N-Y—C-N—OH

——V-N-Q-H-L-C-G-S-H-L—V-E-A-L-Y-L-V-C-G-E—R-G-F-F-Y-T-P-K—OH

1095

1096

-continued

Example 154

1097

1098

-continued

G—I-V-E-Q-C-C-T-S-I—C-S-L-Y-Q-L-E-N-Y-C—N—OH

—F-V-N-Q-H-L-C-G-S-H—L-V-E-A-L-Y-LV-C-G—E-R-G-F-F-Y-T-P-K-T—OH

Example 155

Dap—G-A-K—K

1099                                                    1100

-continued

G—I-V-E-Q-C-C-T-S-I—C-S-L-Y-Q-L-E-N-Y-C—N

—F-V-N-Q-H-L-C-G-S-H—L-V-E-A-L-Y-L-V-C-G—E-R-G-F-F-Y-T-P-K-T—OH

Example 156

Dap—K-A-G-K—K

1101

-continued

1102

G—I-V-E-Q-C-C-T-S-I—C-S-L-Y-C-L-E-N-Y-C—N—OH

—F-V-N-Q-H-L-C-G-S-H—L-V-E-A-L-Y-L-V-C-G—E-R-G-F-F-Y-T-P-K-T—OH

Example 157

Example 158

-continued

G—I—V—E—Q—C—C—T—G—I—C—S—L—Y—Q—L—E—N—Y—C—N—OH

H—F—V—N—Q—H—L—C—G—S—H—L—V—E—A—L—Y—L—V—C—G—E—R—G—F—F—Y—T—P—K—T—OH

NO₂

HN

AcHN

OH

H₂N—Dap—A—G—K—K

-continued

Example 159

Example 160

-continued

G—I—V—E—C—C—T—S—I—C—S—L—Y—Q—L—E—N—Y—C—N—OH

H—F—V—N—Q—H—L—C—G—S—H—L—V—E—A—L—Y—L—V—C—G—E—R—G—F—F—Y—T—P—K—T—OH

HN

Dap—A—G—K—K

HN

HN

OH

B—OH

HO—B

OH

F

B—OH

O

F

F

O

F

F

HO—B—OH

O

HN

NH

O

B—OH

O

OH

B

HN

HN

O

NH

B

O

HO

NH

O

B

HO

-continued

Example 161

-continued

Example 162

Example 163

-continued

Example 164

-continued

-continued

Example 165

1121                                          1122

Example 166

-continued

1123                                                                                    1124

Example 167

-continued

Example 168

Example 169

-continued

H-G-I-V-E-Q-C-C-T-S-I—C-S-L-Y-Q-L-E-N-Y-C—N-OH

HN-K-P-G-S-E-H-E-S-A-F-V-N-Q-H-L-C-G-S-H-L-V-E-A-L-Y-L-V-C-G-E-R-G-F-F-Y-T-P-K-OH

-continued

Example 170

Example 171

1133          1134

Example 172

1135                                                        1136

Example 173

-continued

-continued

Example 174

-continued

Example 175

-continued

Example 176

Example 177

-continued

-continued

Example 178

1147          1148

Example 179

-continued

—E—R—G—F—F—Y—T—P—K—OH

-continued

Example 180

Example 181

-continued

-continued

Example 182

1157 1158

Example 183

-continued

Example 184

-continued

Example 185

-continued

Example 186

Example 187

-continued

Example 188

-continued

-continued

Example 189

-continued

Example 190

1173 1174

-continued

Example 191

Example 192

Example 193

-continued

-continued

Example 194

-continued

Example 195

-continued

Example 196

-continued

Example 197

Example 198

-continued

Example 199

-continued

Example 200

H—G—I—V—E—Q—C—C—T—S—I—C—S—L—Y—Q—L—E—N—Y—C—N—A—E—G—S—K—OH

H—N—Q—L—C—G—S—H—L—V—E—A—L—Y—L—V—C—G—E—R—G—F—F—Y—T—P—R—T—OH

HN—K—P—G—S—E—H—E—S—A—F—V—N—Q—H—L—C—G—S—H—L—V—E—A—L—Y—L—V—C 1193                                                    1194

Example 201

-continued

Example 202

-continued

-continued

Example 203

-continued
Example 204
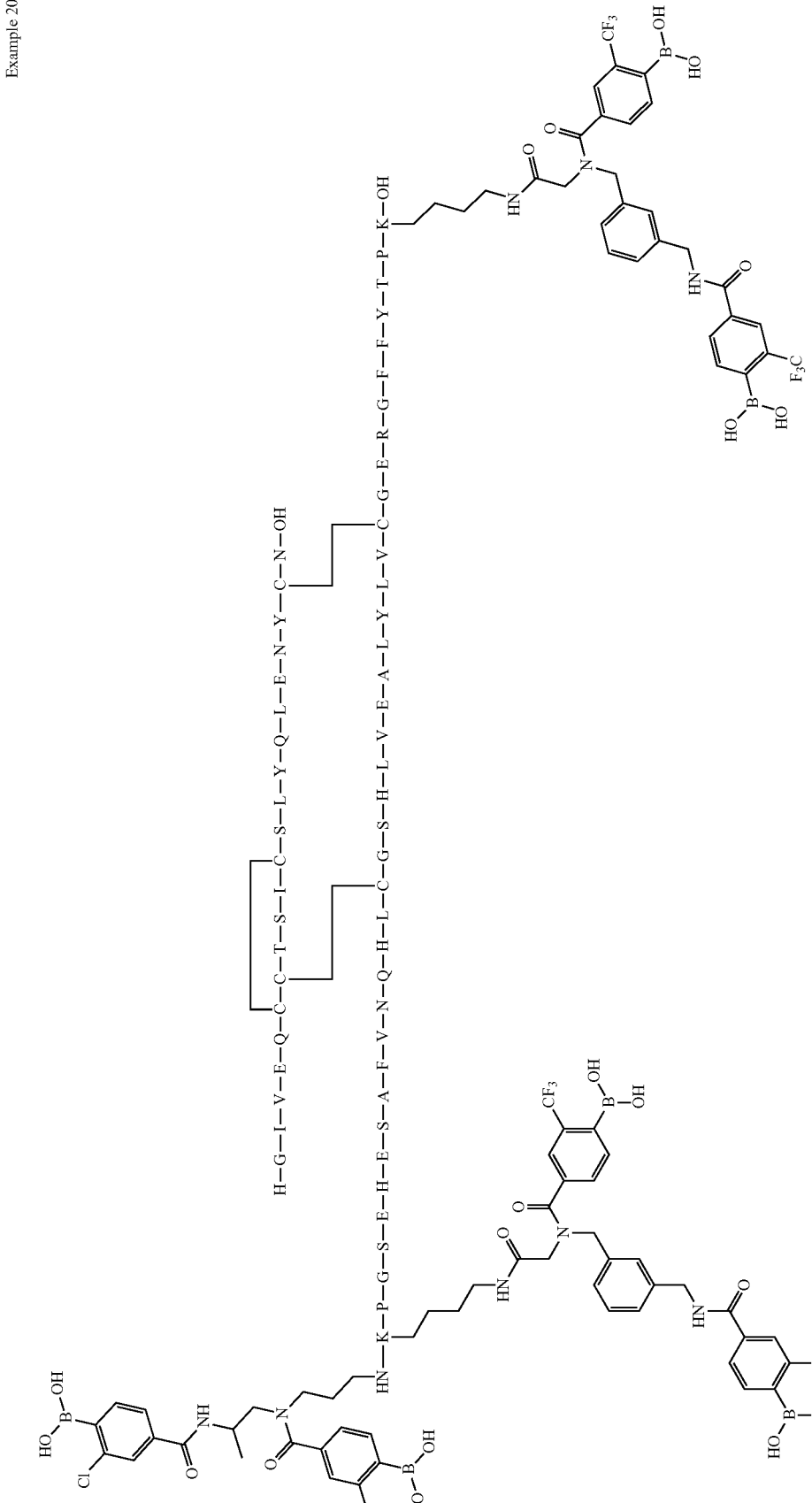

1201            1202

-continued

Example 205

1203

1204

Example 206

-continued

1205  1206

Example 207

-continued

1207

1208

Example 208

-continued

Example 209

-continued

H—G—I—V—E—Q—C—C—T—S—I—C—S—L—Y—Q—L—E—N—Y—C—N—OH

K—P—G—S—E—H—E—S—A—F—V—N—Q—H—L—C—G—S—H—L—V—E—A—L—Y—L—V—C—G—E—R—G—F—F—Y—T—P—K—OH

1211

1212

-continued

Example 210

1213　　　　　　　　　　　　　　　　1214

Example 211

-continued

1215  1216

Example 212

Example 213

-continued

Example 214

1221                                    1222

-continued

Example 215

-continued

Example 216

-continued

Example 217

-continued

Example 218

-continued

Example 219

-continued

Example 220

-continued

Example 221

-continued

Example 222

-continued

Example 223

1239          1240

-continued

Example 224

-continued

Example 225

1243                            1244

Example 226

Example 227

-continued

Example 228

-continued

H-G-I-V-K-P-Q-C-C-T-S-I-C-S-L-Y-Q-L-E-N-Y-C-N—OH

N—K-P-G-S-E-H-E-S-A-F-V-N-Q-H-L-C-G-S-H-L-V-E-A-L-Y-L-V-C-G-E-R-G-F-F-Y-T-P-K—OH
H

Example 229

-continued 1251                                                                    1252

-continued

Example 230

G-I-V-E-Q-C-C-T-S-I-C-S-L-Y-Q-L-E-N-Y-C-N—OH

H—F-V-N-Q-H-L-C-G-S-H-L-V-E-A-L-Y-L-V-C-G-E-R-G-F-F-Y-T-P-K-T—OH

Example 231

-continued

G-I-V-E-Q-C-C-T-S-I-C-S-L-Y-Q-L-E-N-Y-C-N—OH

HN—F-V-N-Q-H-L-C-G-S-H-L-V-E-A-L-Y-L-V-C-G-E-R-G-F-F-Y-T-P-K-T—OH

Example 232

Example 233

G-I-V-E-Q-C-C-T-S-I-C-S-L-Y-Q-L-E-N-Y-C-N-OH

N-F-V-N-Q-H-L-C-G-S-H-L-V-E-A-L-Y-L-V-C-G-E-R-G-F-F-Y-T-P-K-T-OH

G-I-V-E-Q-C-C-T-S-I-C-S-L-Y-Q-L-E-N-Y-C-N-OH

N-F-V-N-Q-H-L-C-S-G-H-L-V-E-A-L-Y-L-V-C-G-E-R-G-F-F-Y-T-P-K-T-OH

-continued

Example 234

-continued

Example 235

G-I-V-E-Q-C-C-T-S-I-C-S-L-Y-Q-L-E-N-Y-C-N-OH

N-F-V-N-Q-H-L-C-G-S-H-L-V-E-A-L-Y-L-V-C-G-E-R-G-F-F-Y-T-P-K-T-OH
H

Example 236

G-I-V-E-Q-C-C-T-S-I-C-S-L-Y-Q-L-E-N-Y-C-N-OH

N-F-V-N-Q-H-L-C-G-S-H-L-V-E-A-L-Y-L-V-C-G-E-R-G-F-F-Y-T-P-K-T-OH
H

-continued

Example 237

G-I-V-E-Q-C-C-T-S-I-C-S-L-Y-Q-L-E-N-Y-C-N-OH

N-F-V-N-Q-H-L-C-G-S-H-L-V-E-A-L-Y-L-V-C-G-E-R-G-F-F-Y-T-P-K-T-OH

Example 238

-continued

Example 239

-continued

Example 240

-continued

Example 241

-continued

Example 242

-continued

Example 243

1275                                  1276

Example 244

H·G-I-V-E-Q-C-C-T-S-I—C-S-L-Y-Q-L-E-N-Y-C-N—OH

HN-K-P-G-S-E-H-E-S-A-F—V-N-Q-H-L-C-G-S-H-L-·V-E-A-L-Y-L-·V-G-C-E·R-G-F-F-Y-T-P-K-OH

Example 245

H—G-I-V-E-Q-C-C-T-S-I—C-S-L-Y-Q-L-E-N-Y-C—N-A-E-G-S-K—OH

HN—K-P-G-S-E-H-E-S-A-F—V-N-Q-H-L-C-G-S-H-L—V-E-A-L-Y-L-V-C-G-E—R-G-F-F-Y-T-P-R-T—OH

1277                                                                      1278

Example 246

H—K-P-G-I-V-E-Q-C-C-T—S-I-C-S-L-V-Q-L-E-N—Y-C-N—OH

HN—K-P-G-S-E-H-E-S-A-F—V-N-Q-H-L-C-G-S-H-L—V-E-A-L-Y-L-V-C-G-E—R-G-F-F-Y-T-P-K—OH 1279 1280

Example 247

H—G-I-V-E-C-C-T-S-I—C-S-L-Y-Q-L-E-N-Y-C—N-A-E-G-S-K—OH

HN—K-P-G-S-E-H-E-S-A-F—V-N-Q-H-L-C-G-S-H-L—V-E-A-L-Y-L-V-C-G-E—R-G-F-F-Y-T-P-K—OH

1281

1282

Example 248

H—G-I-V-K-P-Q-C-C-T-S—I-C—S-L-Y-Q-L-E-N-Y—C-N—OH

NH—K-P-G-S-E-H-E-S-A-F—V-N-Q-H-L-C-G-S-H-L—V-E-A-L-Y-L-V-C-G-E—R-G-F-F-Y-T-P-K—OH

1283                                                    1284

-continued

Example 249

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 250

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 251

Example 252

1287

1288

Example 253

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH 1289            1290

Example 254

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 255

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

1291                                                                 1292

Example 256

H–G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T-OH

Example 257

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 258

Example 259

-continued

Example 260

Example 261

-continued

Example 262

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 263

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 264

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 265

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 266

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 267

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

1303

1304

-continued

Example 268

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 269

H—G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 270

Example 271

-continued

Example 272

Example 273

1309  1310

Example 274

-continued

Example 275

H—G—I—V—E—Q—C—C—T—S—I—C—S—L—Y—Q—L—E—N—Y—C—N—OH

—C—G—S—H—L—V—E—A——L—Y—L—V—C—G—E—R—G—F—F—Y—T—P—K—T—OH

Example 276

-continued

H—G—I—V—E—Q—C—C—T—S—I—C—S—L—Y—Q—L—E—N—Y—C—N—OH

—C—G—S—H—L—V—E—A—L—Y—L—V—C—G—E—R—G—F—F—Y—T—P—K—T—OH

Example 277

—F—Y—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—E—R—G—F—F—Y—T—P—K—T—OH

-continued

Example 278

H—G—I—V—E—Q—C—C—T—S—I—C—S—L—Y—Q—L—E—N—Y—C—N—OH

—C—G—S—H—L—V—E—A—L—Y—L—V—C—G—E—R—G—F—F—Y—T—P—K—T—OH

-continued

Example 279

H—G—I—V—E—Q—C—C—T—S—I—C—S—L—Y—Q—L—E—N—Y—C—N—OH

—C—G—S—H—L—V—E—A——L—Y—L—V—C—G—E—R—G—F—F—Y—T—P—K—T—OH

Example 280

1319 1320

-continued

H—G—I—V—E—Q—C—C—T—S—I—C—S—L—Y—Q—L—E—N—Y—C—N—OH

—C—G—S—H—L—V—E—A——L—Y—L—V—C—G—E—R—G—F—F—Y—T—P—K—T—OH

Example 281

F—Y—N—Q—H—L—

-continued

H—G—I—V—E—Q—C—C—T—S—I—C—S—L—Y—Q—L—E—N—Y—C—N—OH

—C—G—S—H—L—V—E—A——L—Y—L—V—C—G—E—R—G—F—F—Y—T—P—K—T—OH

Example 282

H—G—I—V—E—Q—C—C—T—S—I—C—S—L—Y—

F—Y—N—Q—H—L—C—G—S—H—L—V—E—

-continued

Example 283

1325
1326
-continued
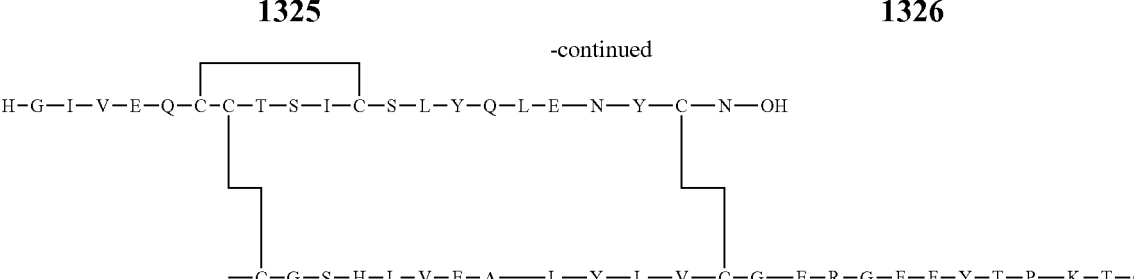

Example 284

1329                    1330
-continued
Example 285
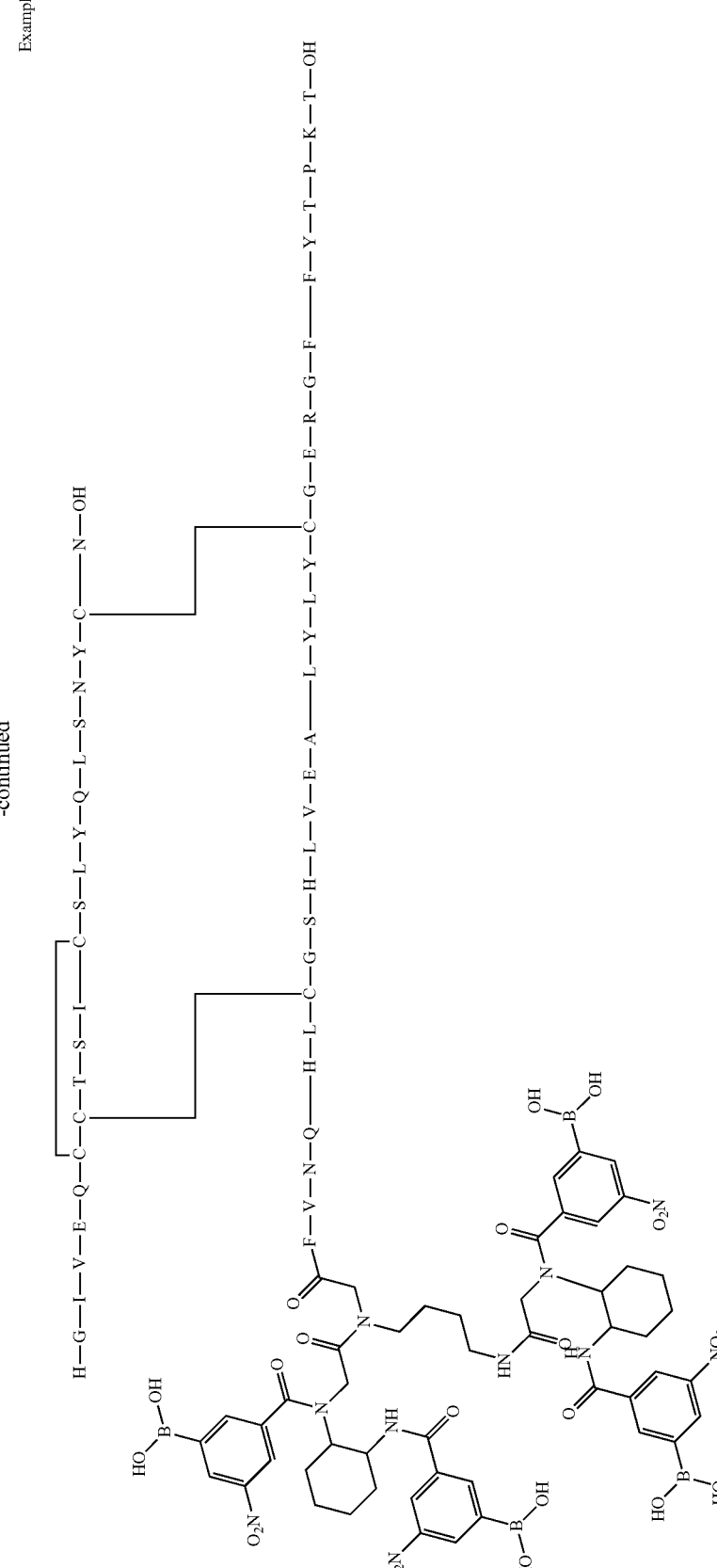

1331                                                                    1332
-continued
Example 286
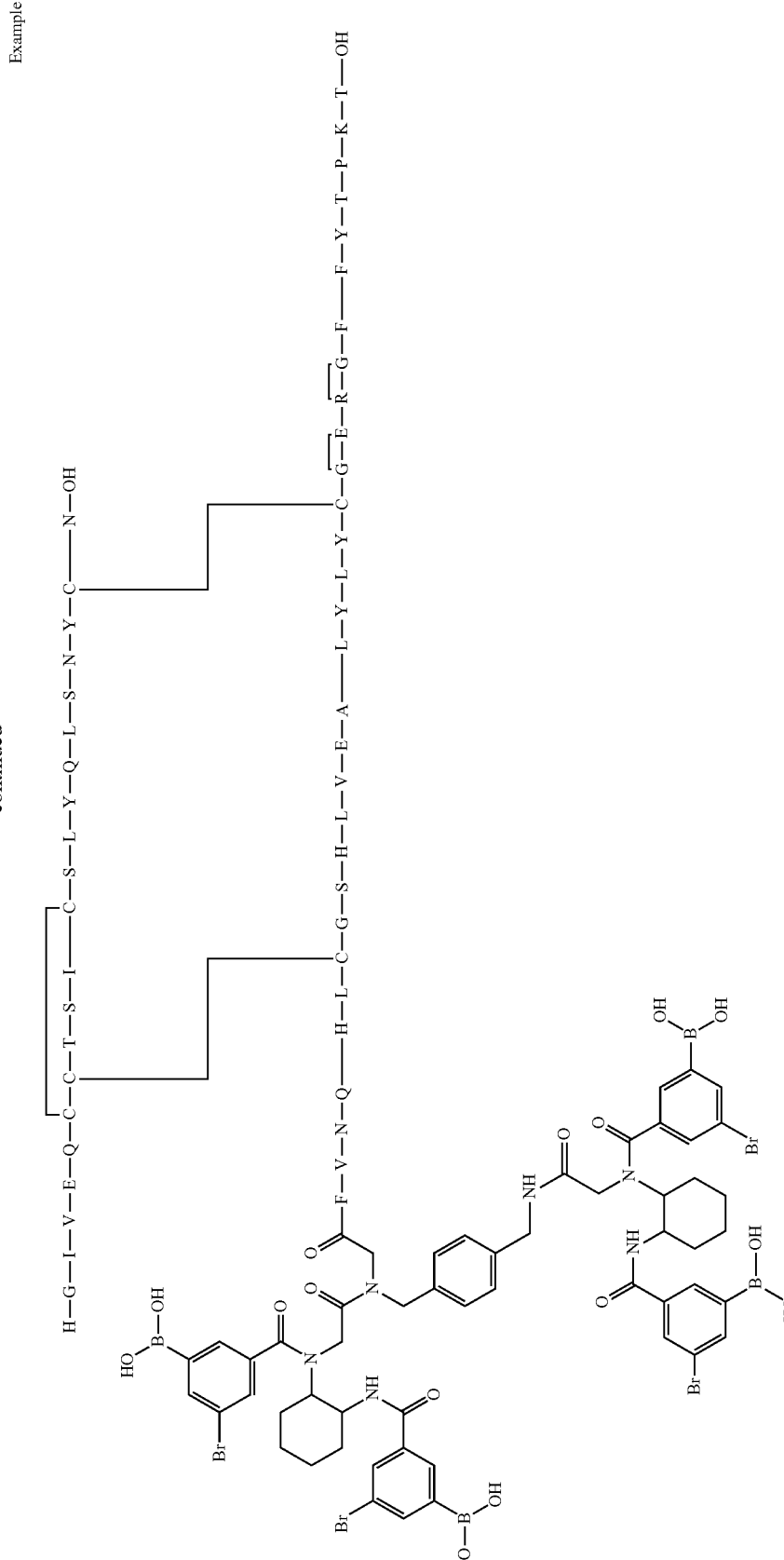

Example 287
-continued
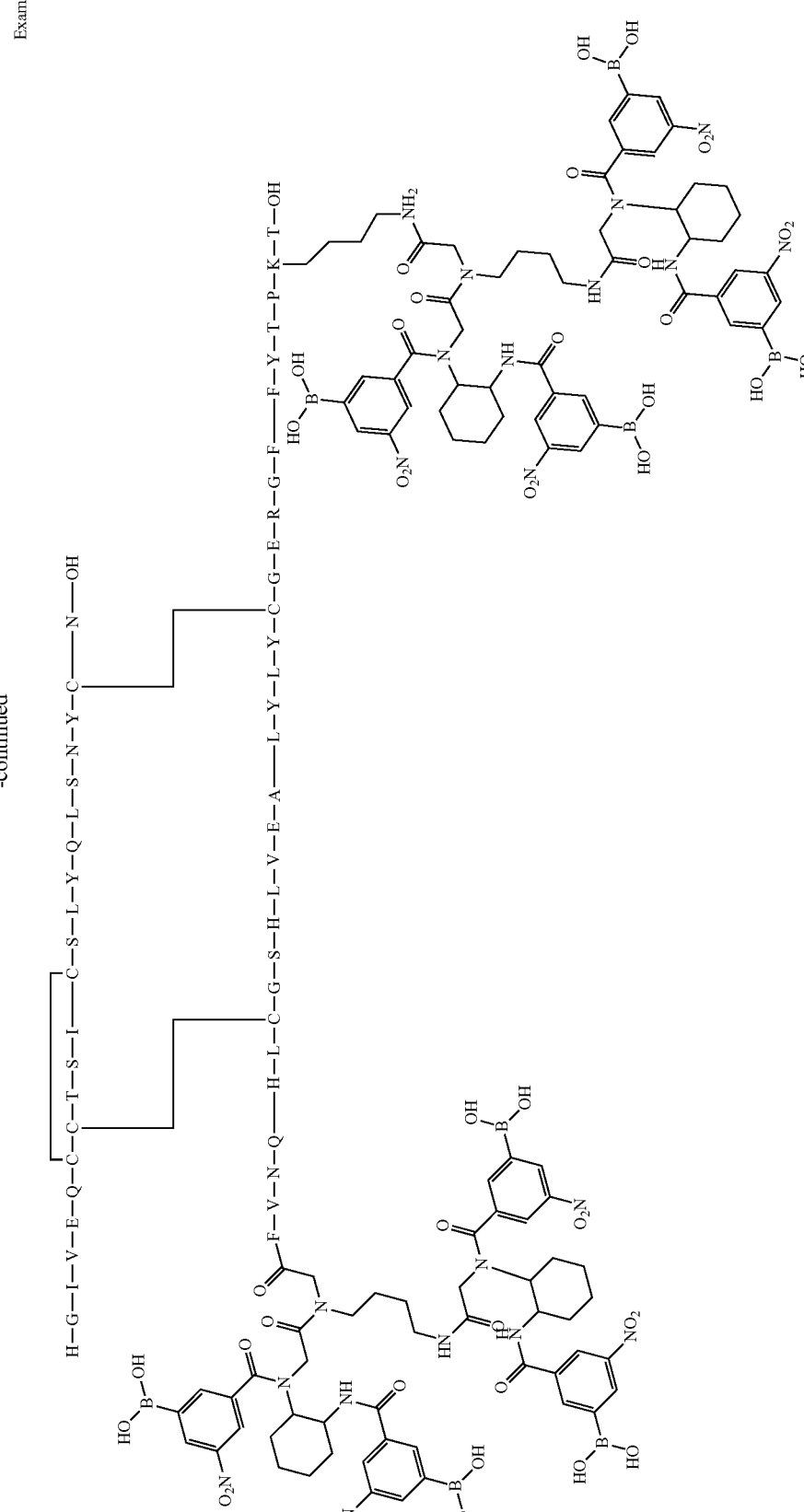

-continued

Example 288

1337                    1338
-continued
Example 289
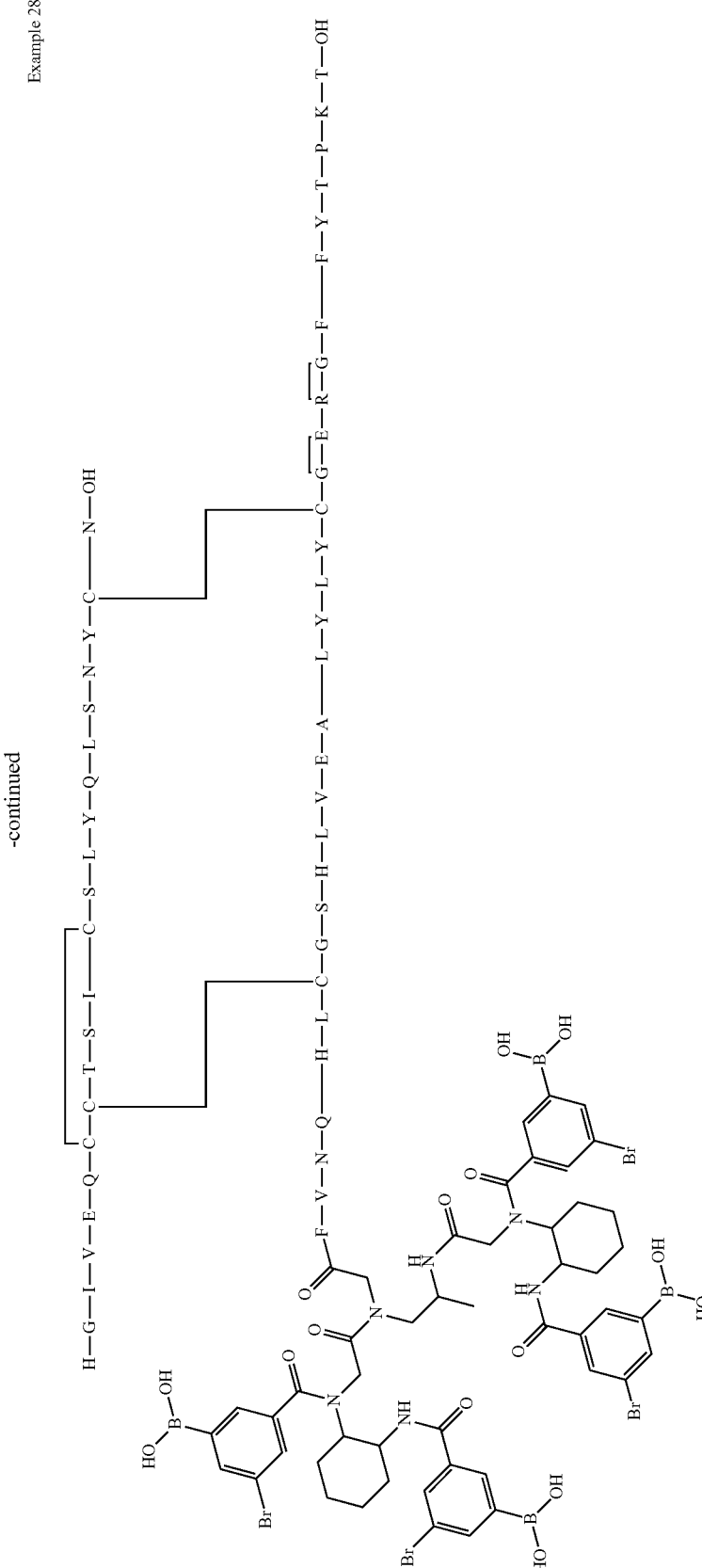

Example 290

-continued

H—G—I—V—E—Q—C—C—T—S—I—C—S—L—Y—Q—L—S—N—Y—C—N—OH

F—V—N—Q—H—L—C—G—S—H—L—V—E—A—L—Y—L—Y—C—G—E—R—G—F—F—Y—T—P—K—T—OH

1341                                                                                     1342
Example 291
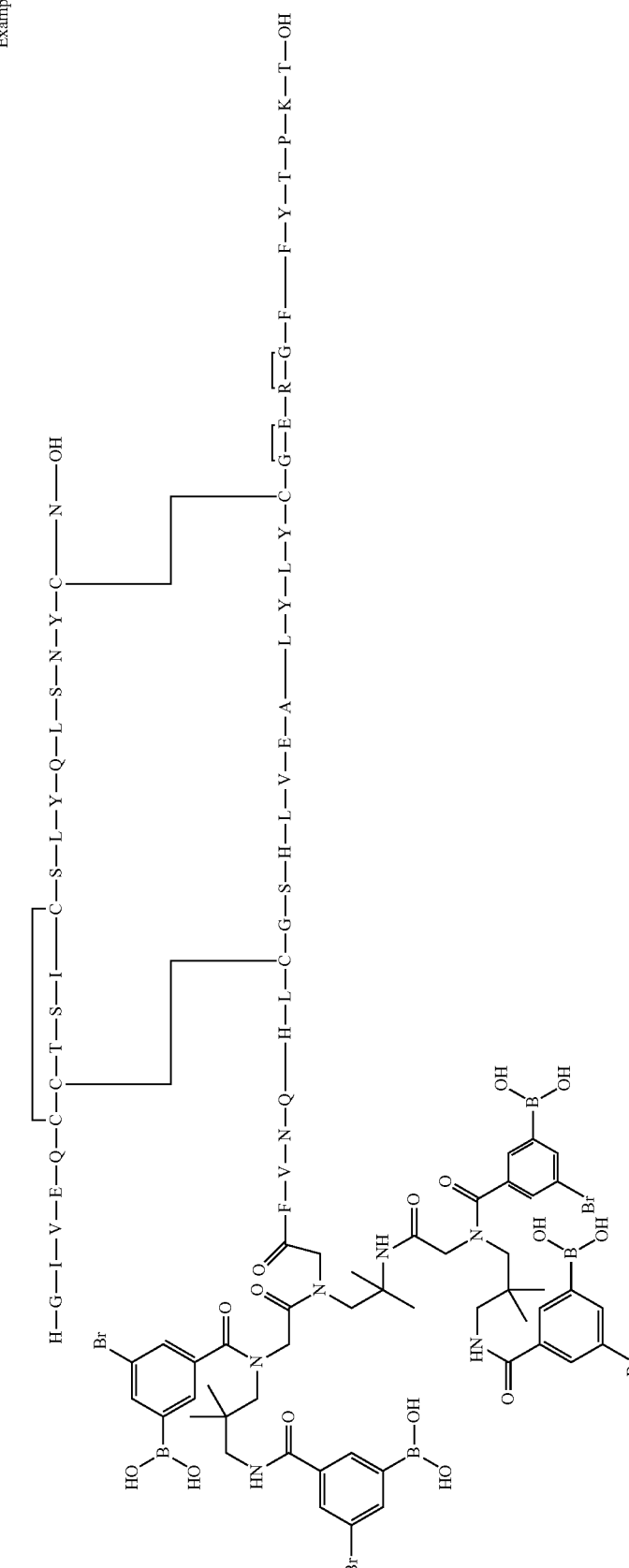

-continued

Example 292

Example 293
-continued
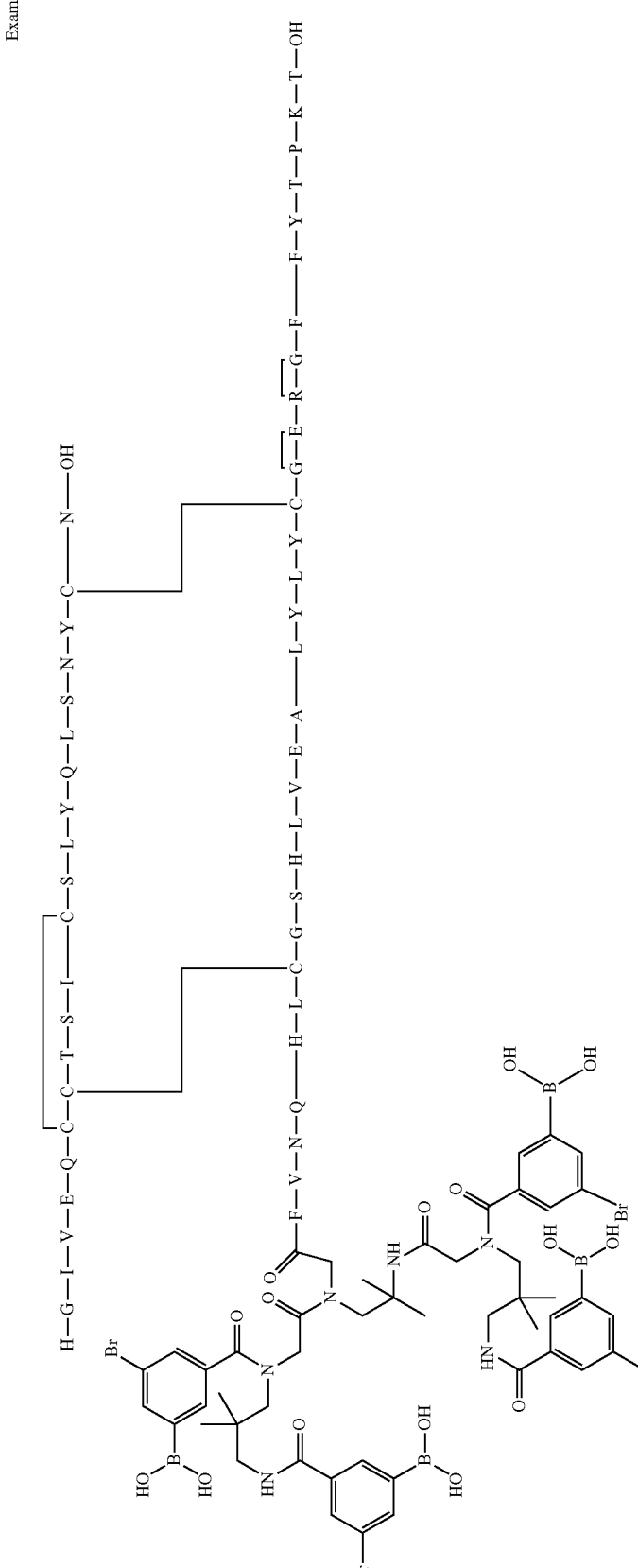

Example 294

-continued

-continued
Example 295
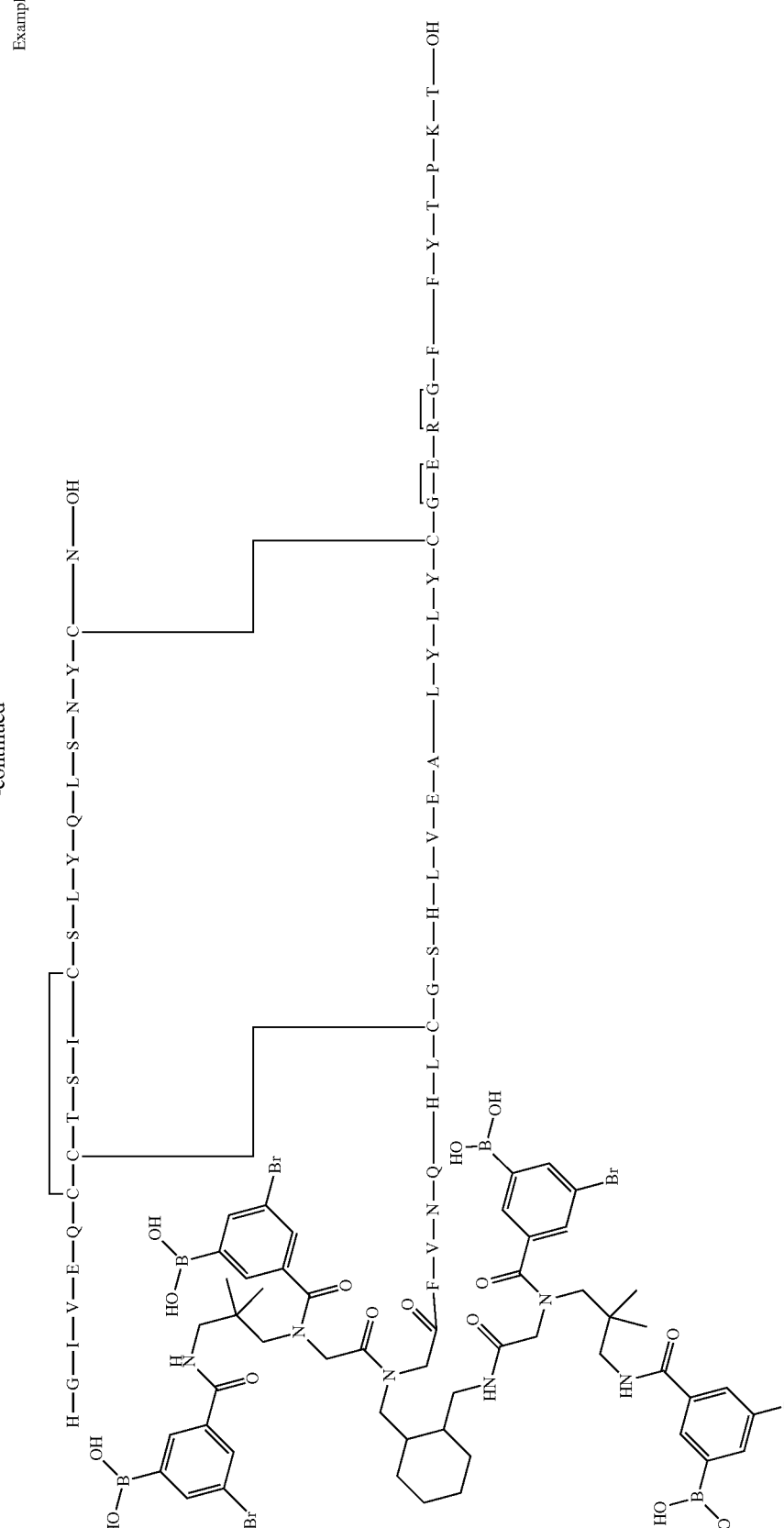

-continued

Example 296

-continued

Example 297

Example 298

-continued

1357

1358

Example 299

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

-continued

Example 300

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

-continued

Example 301

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

-continued

Example 302

Example 303

-continued

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

Example 304

-continued

Example 305

-continued

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

-continued

Example 306

Example 307

-continued

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

1375

1376

Example 308

-continued

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH 1377          1378

Example 309

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 310

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

-continued

Example 311

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 312

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

-continued

Example 313

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 314

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

-continued

Example 315

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 316

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 317

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

-continued

Example 318

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 319

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

-continued

Example 320

Example 321

Example 322

-continued

Example 323

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 324

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 325

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-K-T-OH

Example 326

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 328

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 328

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

-continued

Example 329

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 330

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 331

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 332

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 333

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

-continued

Example 334

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 335

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-T—OH

Example 336

H—G—I—V—E—Q—C—C—T—S—I—C-S-L-Y-Q-L-E-N-Y-C—N-OH

F-V-N-Q-H-L-C-G-S-H-L-V-E-A—L-Y-L-V-C-G-E-R-G-F-F-Y-T-P-K-OH

-continued

Example 337

H-G-I-V-E-Q-C-C-T-S-I—C-S-L-Y-Q-L-E-N-Y-C—N—OH

F-V-N-Q—H-L-C-G-S-H-L-V-E-A—L-Y-L-V-C-G-E-R-G-F—F-Y-T-P-K-OH

Example 338

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 339

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

1401

1402

-continued

Example 340

H—G-I-V-E-Q-C-C-T-S-I-C-S-L-Y-Q-L-E-N-Y-C-N—OH

F-V-N-Q-H-L-C-G-S-H-L-V-E-A-L-Y-L-V-C-G-E-R-G-F-F-Y-T-P-KOH

Example 341

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

-continued

Example 342

H—G-I-V-E-Q-C-C-T-S-I-C-S-L-Y-Q-L-E-N-Y-C N—OH

F-V-N-Q-H-L-C-G-S-H-L-V-E-A-L-Y-L-V-C-G-E-R-G-F-F-Y-T-P-K—OH

Example 343

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

-continued

Example 344

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 345

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

-continued

Example 346

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-OH

Example 347

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 348

1409                                                                                        1410

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 349

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

-continued

Example 350

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 351

H-G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

-continued

Example 352

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

Example 353

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

1415　　　　　　　　　　　　　　　　　1416

-continued

Example 354

H—G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K—OH

1417                                                                 1418

Example 355

1419                                                                      1420

Example 356

1421                                                1422

Example 357

-continued

-continued

Example 358

G-I-V-E-Q-C-C-T-S-I-C-S-L-Y-Q-L-E-N-Y-C—N

F-V-N-Q-H-L-C-G-S-H-L-V-E-A-L-Y-L-V-C-G-E-R-G-F-F-Y-T-P-K-T—OH

K-G-A-K

-continued

Example 359

-continued

Example 360

Example 361

-continued

Example 362

-continued 1433      1434

Example 363

-continued

-continued

Example 364

-continued

Example 365

-continued

Example 366

-continued

Example 367

Example 368

-continued

Example 369

-continued

Example 370

-continued

Example 371

1451                                                                                          1452

-continued

Example 372

-continued

Example 373

-continued

Example 374

-continued

Example 375

-continued

Example 376

1461

1462

Example 377

Example 378

-continued

-continued

Example 379

-continued

Example 380

Example 381

-continued

-continued

Example 382

-continued

Example 383

-continued

Example 384

-continued

Example 385

Example 386

K-G-A-K-S

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

1481 1482

Example 387

K-G-A-K-S

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 388

K-G-A-K-S

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 389

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 390

HO—S-K-A-G-K-K

AcHN

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 391

1491                                                              1492

Example 392

-continued

Example 393

HO—S-K-A-G-K-K

AcHN

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 394

1497                                                                 1498

Example 395

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

-continued

Example 396

1501                                                         1502

-continued

Example 397

Example 398

1503

1504

G—I-V-E-Q-C-C-T-S-I—C-S-L-Y-Q-L-E-N-Y-C—N—OH

—F-V-N-Q-H-L-C-G-S-H—L-V-E-A-L-Y-L-V-C-G—E-R-G-F-F-Y-T-P-K-T—OH

Example 399

G-I-V-E-Q-C-C-T-S-I-C-S-L-Y-Q-L-E-N-Y-C-N—OH

HN—F-V-N-Q-H-L-C-G-S-H-L-V-E-A-L-Y-L-V-C-G-E-R-G-F-F-Y-T-P-K-T—OH

-continued

Example 400

H—F-V-N-Q-H-L-C-G-S-H-L-V-E-A-L-Y-L-V-C-G-E-R-G-F-F-Y-T-P-K-T—OH

G-I-V-E-Q-C-T-S-I-C-S-L-Y-Q-L-E-N-Y-C-N—OH

HO—S-K-A-G-K-K

-continued

Example 401

-continued

Example 402

-continued

Example 403

-continued

Example 404

-continued

Example 405

1519                                                                                   1520

-continued

Example 406

1521                                                     1522

Example 407

-continued

Example 408

Example 409

-continued

1527

1528

-continued

Example 410

Example 411

-continued 1531 1532

-continued

Example 412

1533                                    1534

-continued

Example 413

-continued

Example 414

Example 415

-continued

G-I-V-E-Q-C-C-T-S-I-C-S-L-Y-Q-L-E-N-Y-C-N-OH

H₂N—F-V-N-Q-H-L-C-G-S-H-L-V-E-A-L-Y-L-V-C-G-E-R-G-F-F-Y-T-P-K-T-OH

H₂N—S-K-A-G-K-K

Example 416

-continued

-continued

Example 417

Example 418

-continued

Example 419

-continued

Example 420

G-I-V-E-Q-C-C-T-S-I—C-S-L-Y-Q-L-E-N-Y-C—N—OH

H | N—F—V-N-Q-H-L-C-G-S-H—L-V-E-A-L-Y-L-V-C-G—E-R-G-F-F-Y-T-P-K-T—OH

-continued

Example 421

-continued

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 422

1553                                                                1554

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 423

1555

1556

-continued

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 424

H₂N—S-K-A-G-K-K

1557 · 1558

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 425

H₂N—S-K-A-G-K-K

-continued

G-I-V-E-Q-C-C-T-S-I-C-S-L-Y-Q-L-E-N-Y-C—N—OH

H
N—F—V-N-Q-H-L-C-G-S-H—L-V-E-A-L-Y-L-V-C-G————E-R-G-F-F-Y-T-P-K-T—OH

Example 426

H₂N—S-K-A-G-K-K

1561　　　　　　　　　　　　　　　　　　　　　　　　1562

G-I-V-E-Q-C-C-T-S-I-C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

H

Example 427

H₂N—S-K-A-G-K-K

-continued

G-I-V-E-Q-C-C-T-S-I—C-S-L-Y-Q-L-E-N-Y-C—N—OH

N
H—F—V-N-Q-H-L-C-G-S-H—L-V-E-A-L-Y-L-V-C-G—E-R-G-F-F-Y-T-P-K-T—OH

Example 428

H₂N—S-K-A-G-K-K

-continued

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 429

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

1567

1568

Example 430

-continued

G-I-V-E-Q-C-C-T-S-I—C-S-L-Y-Q-L-E-N-Y-C—N—OH

N—F—V-N-Q-H-L-C-G-S-H—L-V-E-A-L-Y-L-V-C-G—E-R-G-F-F-Y-T-P-K-T—OH

Example 431

H₂N—S-K-A-G-K-K

-continued

G-I-V-E-Q-C-C-T-S-I—C-S-L-Y-Q-L-E-N-Y-C—N—OH

HN—F—V-N-Q-H-L-C-G-S-H—L-V-E-A-L-Y-L-V-C-G—E-R-G-F-F-Y-T-P-K-T—OH

Example 432

-continued

Example 433

-continued

Example 434

-continued

Example 435

-continued

Example 436

G-I-V-E-G-C-C-T-S-I—C-S-L-Y-Q-L-E-N-Y-C—N

N-F-V-N-Q-H-L-C-G-S-H-L—V-E-A-L-Y-V-C-G-E— R-G-F-F-Y-T-P-K-T—OH

-continued

Example 437

-continued

Example 438

-continued

Example 439

-continued

Example 440

-continued

Example 441

-continued

Example 442

G-I-V-E-G-C-C-T-S-I—C-S-L-Y-Q-L-E-N-Y-C—N—OH

N—F-V-N-Q-H-L-C-G-S-H—L-V-E-A-L-Y-V-C-G—E-R-G-F-F-Y-T-P-K-T—OH

-continued

Example 443

G-I-V-E-G-C-C-T-S-I——C-S-L-Y-Q-L-E-N-Y-C—N—OH

F-V-N-Q-H-L-C-G-S-H——L-V-E-A-L-Y-V-C-G——E-R-G-F-F-Y-T-P-K-T—OH

-continued

Example 444

-continued

Example 445

G-I-V-E-G-C-C-T-S-I—C-S-L-Y-Q-L-E-N-Y-C—N—OH

N—F-V-N-Q-H-L-C-G-S-H—L-V-E-A-L-Y-V-C-G—E-R-G-F-F-Y-T-P-K-T—OH
H 1601                                                                    1602

Example 446

G-I-V-E-G-C-C-T-S-I—C-S-L-Y-Q-L-E-N-Y-C—N—OH

N—F-V-N-Q-H-L-C-G-S-H—L-V-E-A-L-Y-V-C-G—E-R-G-F-F-Y-T-P-K-T-OH

-continued

Example 447

Example 448

-continued

Example 449

G-I-V-E-G-C-C-T-S-I—C-S-L-Y-Q-L-E-N-Y-C—N

N-F-V-N-Q-H-L-C-G-S-H—L-V-E-A-L-Y-V-C-G—E-R-G-F-F-Y-T-P-K-T—OH

-continued

Example 450

-continued
Example 451
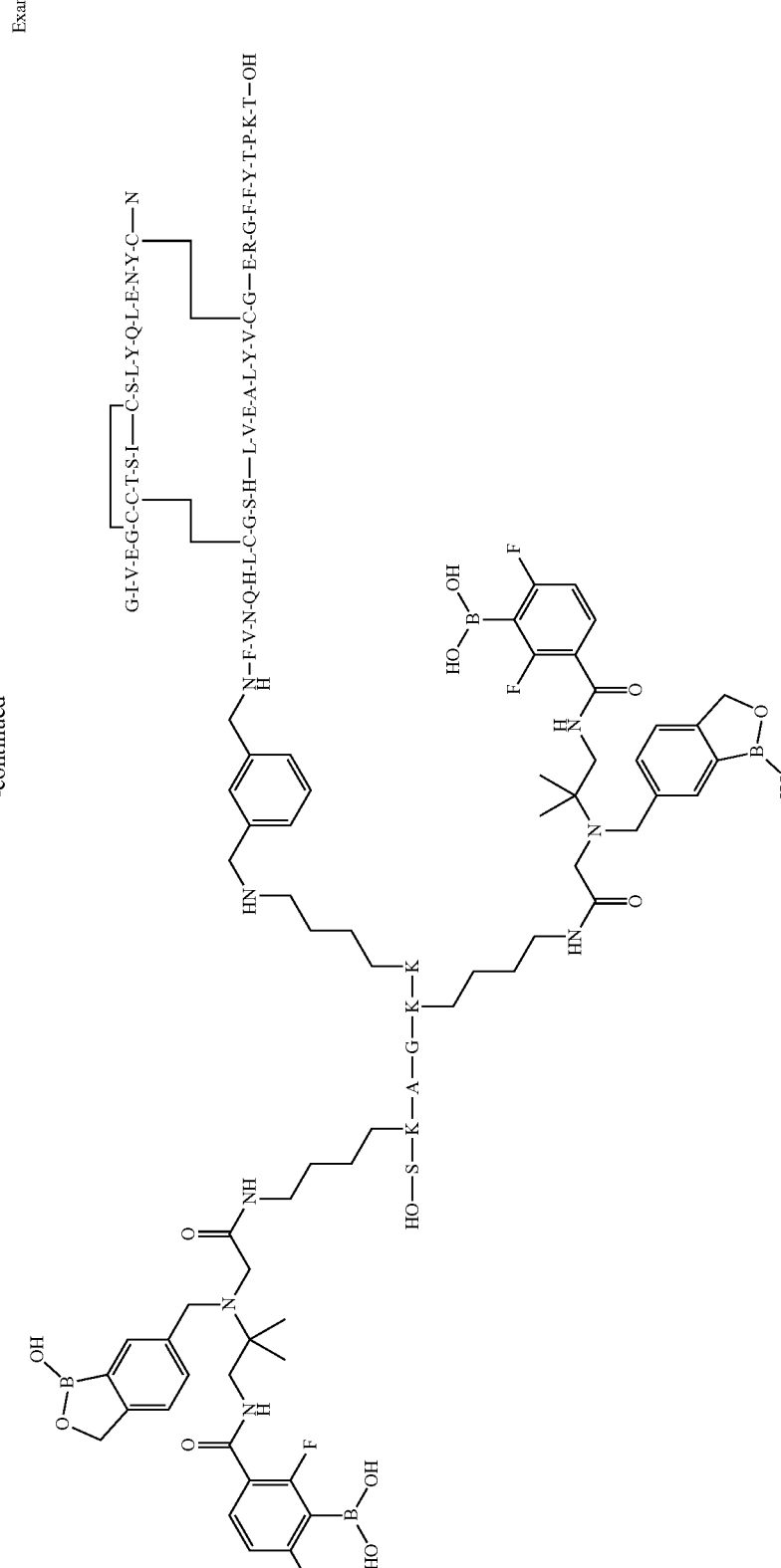

1611                                                                      1612

-continued

Example 452

-continued

Example 453

G-I-V-E-G-C-C-T-S-I—C-S-L-Y-Q-L-E-N-Y-C—N

H—F-V-N-Q-H-L-C-G-S-H—L-V-E-A-L-Y-V-C-G-E-R-G-F-F-Y-T-P-K-T-OH

1615

1616

Example 454

-continued

Example 455

G—I—V—E—Q—C—T—S—I—C—S—L—Y—Q—L—E—N—Y—C—N—OH

H—F—V—N—Q—H—L—C—G—S—H—L—V—E—A—L—Y—L—V—C—G—E—R—G—F—F—Y—T—P—K—T—OH

-continued
Example 456
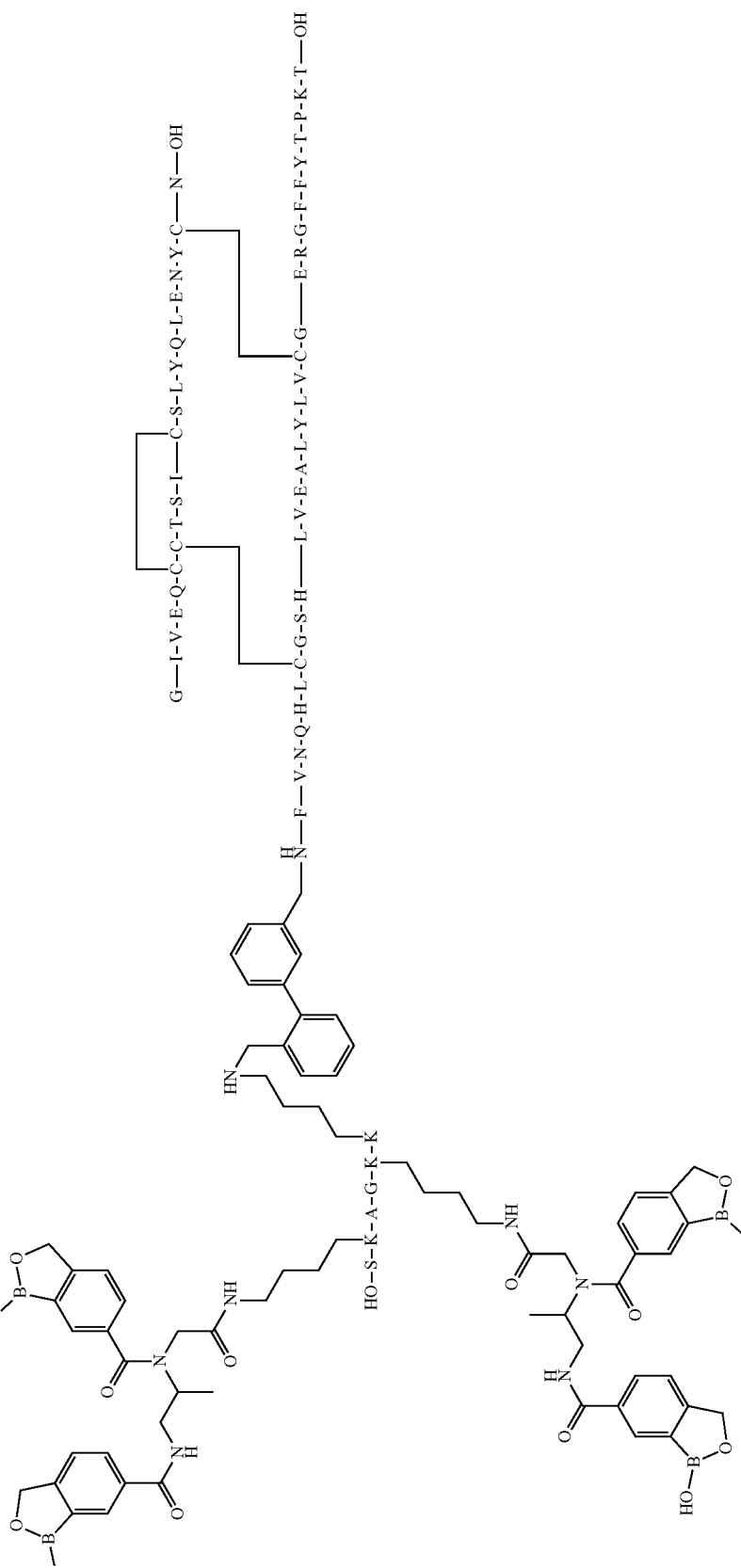

-continued

Example 457

Example 458

-continued

G—I—V—E—Q—C—C—T—S—I—C—S—L—Y—Q—L—E—N—Y—C—N—OH

H—F—V—N—Q—H—L—C—G—S—H—L—V—E—A—L—Y—L—V—C—G—E—R—G—F—F—Y—T—P—K—T—OH 1625                                                                                          1626

Example 459

-continued

Example 460

-continued

Example 461

-continued

Example 462

G-I-V-E-Q-C-C-T-S-I—C-S-L-Y-Q-L-E-N-Y-C—N—OH

H-F-V-N-Q-H-L-C-G-S-H—L-V-E-A-L-Y-L-V-C-G—E-R-G-F-F-Y-T-P-K-T—OH

-continued
Example 463
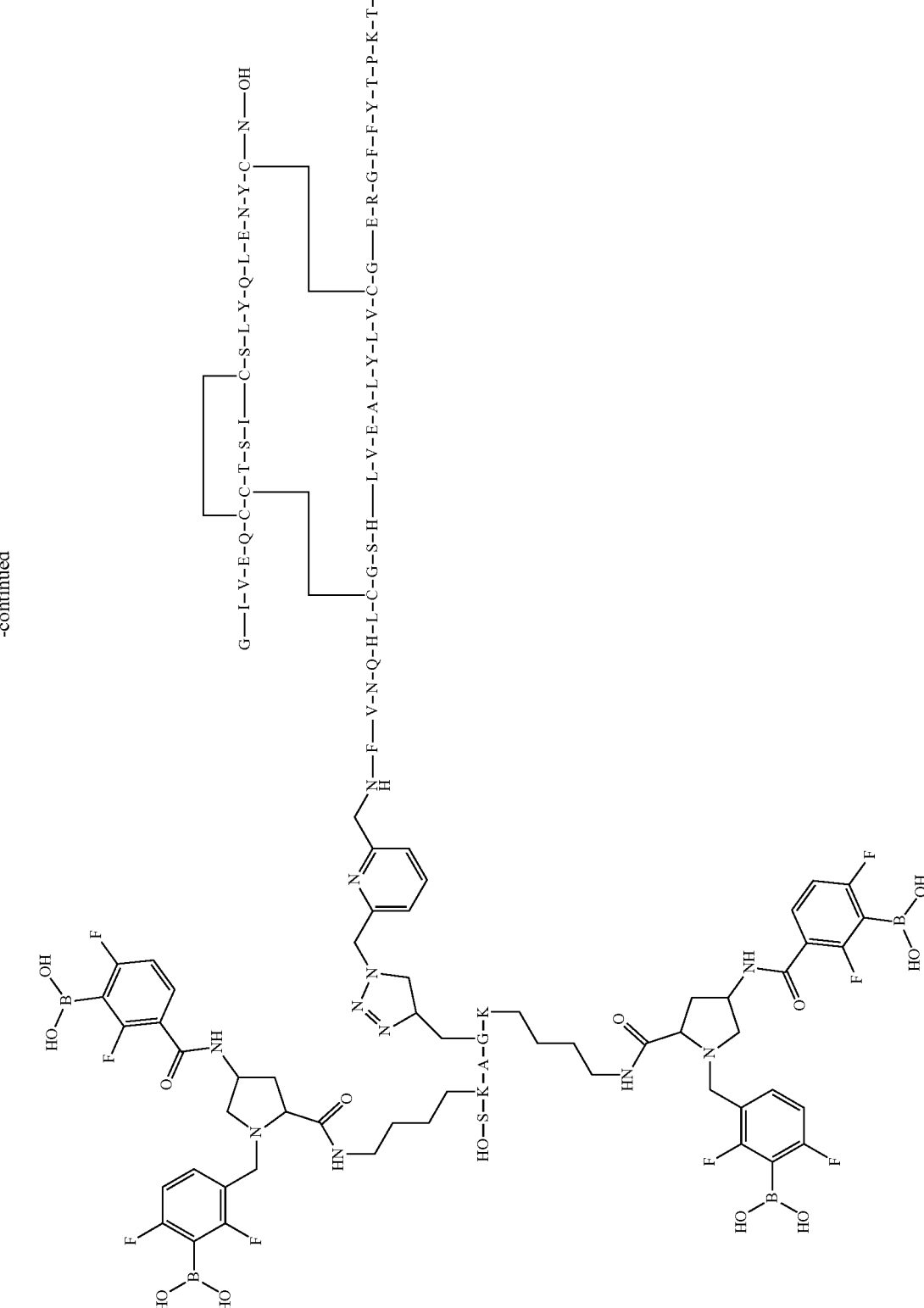

-continued

Example 464

-continued

Example 465

Example 466

-continued
Example 467
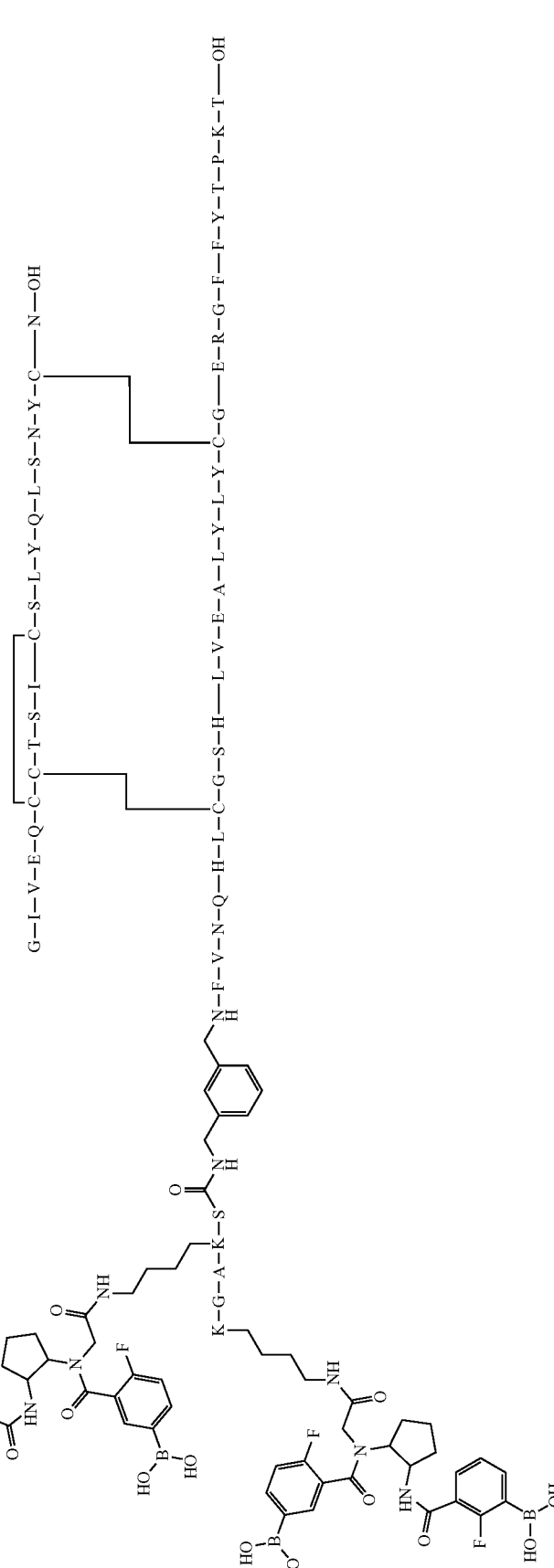

-continued
Example 468
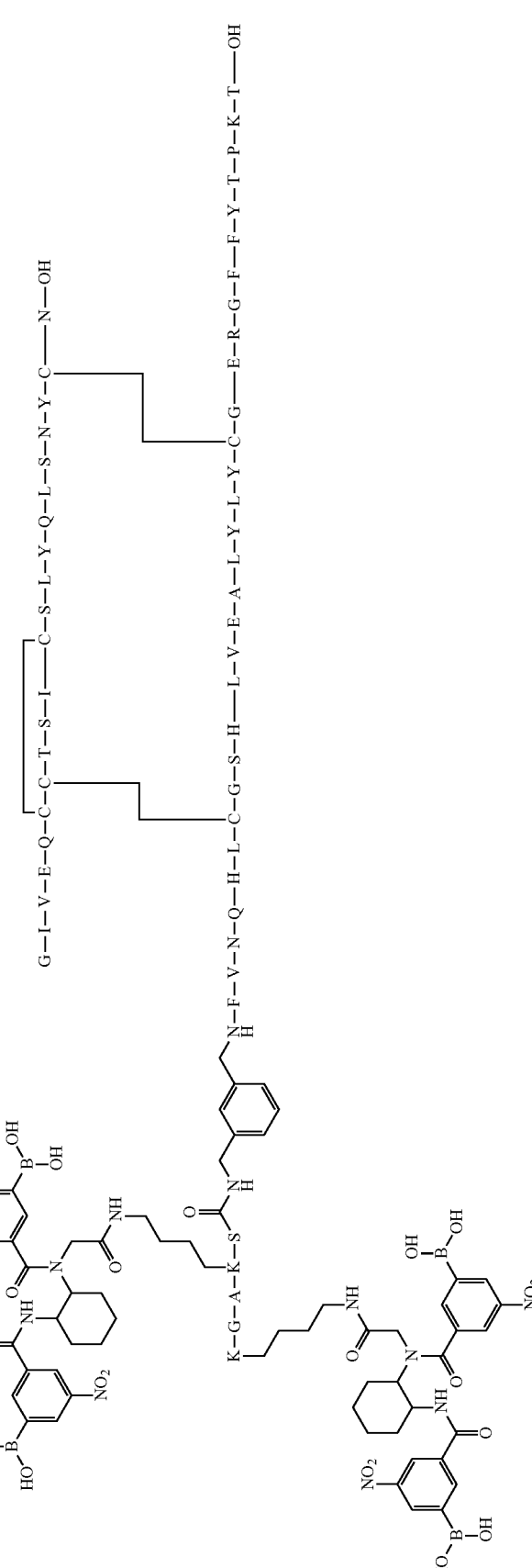

-continued
Example 469
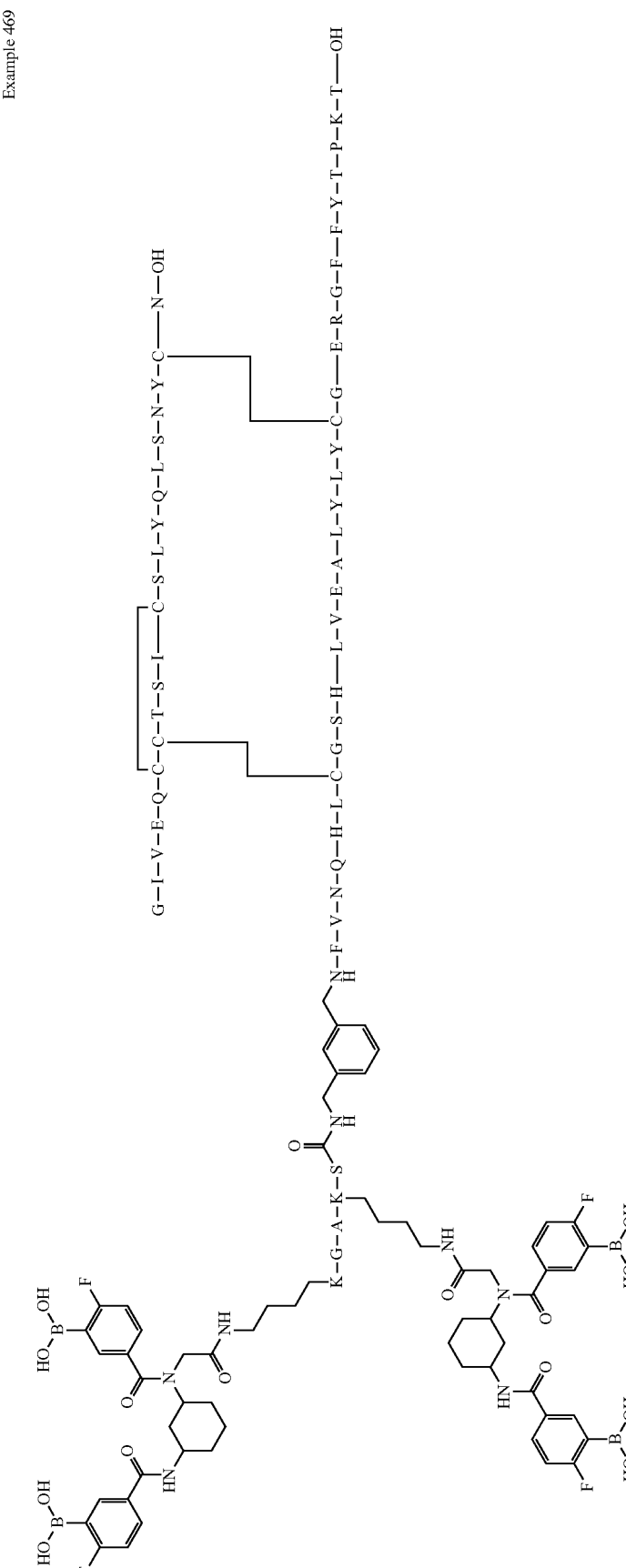

-continued

Example 470

G—I—V—E—Q—C—C—T—S—I—C—S—L—Y—Q—L—S—N—Y—C—N—OH

H—F—V—N—Q—H—L—C—G—S—H—L—V—E—A—L—Y—L—Y—C—G—E—R—G—F—F—Y—T—P—K—T—OH

HO—S—K—A—G—K—K

Example 471

-continued

-continued
Example 472
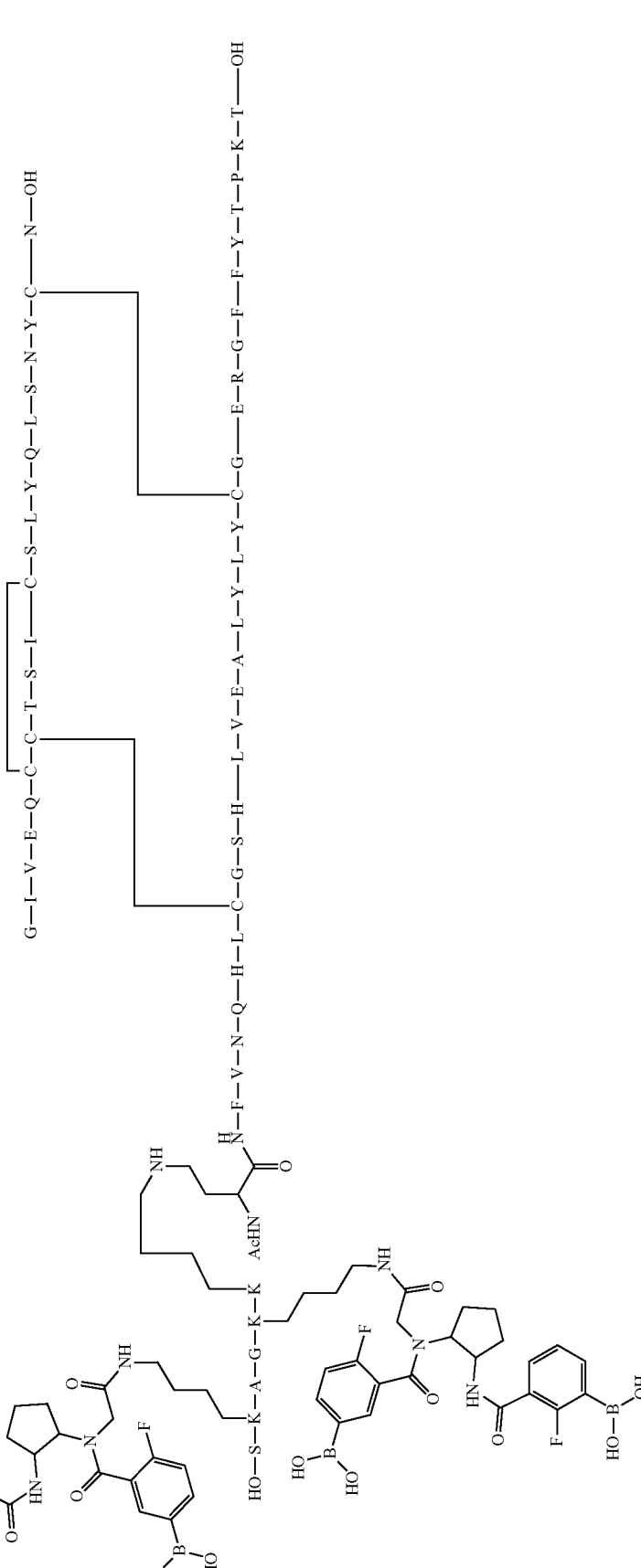

-continued
Example 473
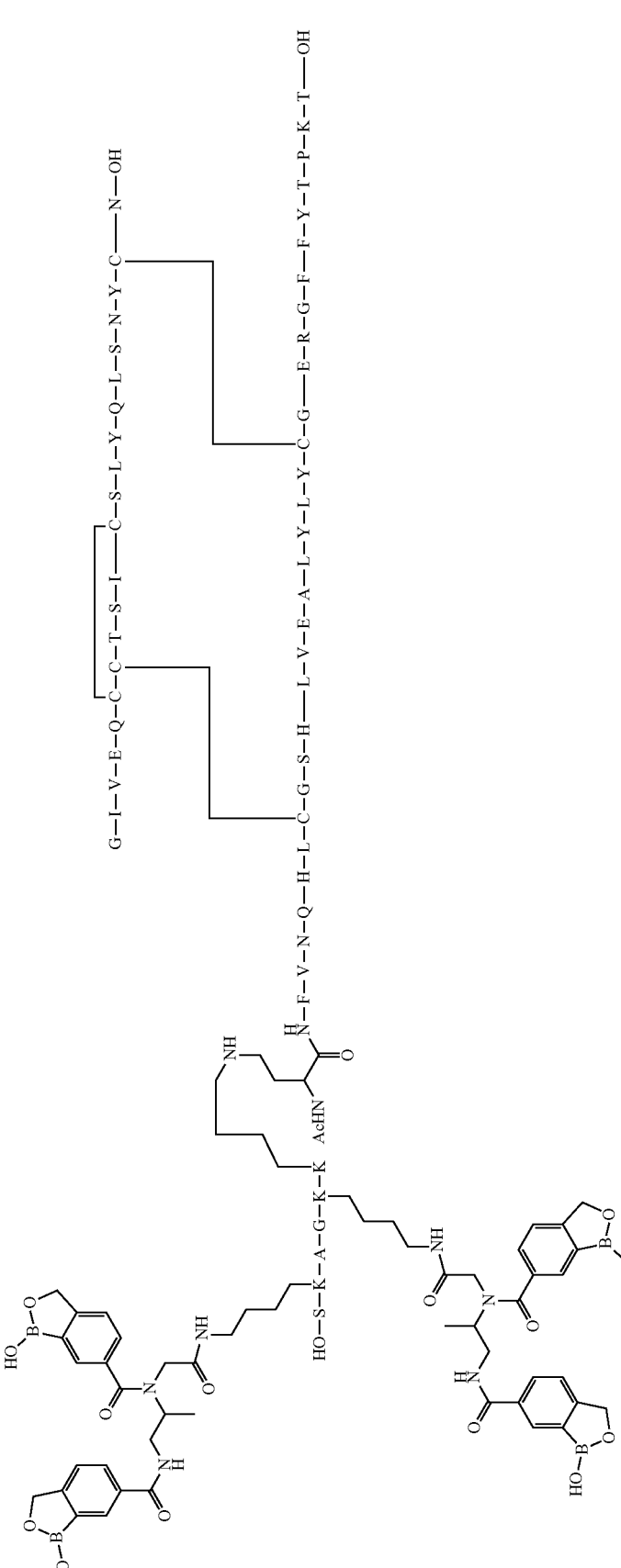

1655                                                                                     1656

-continued

Example 474

-continued
Example 475
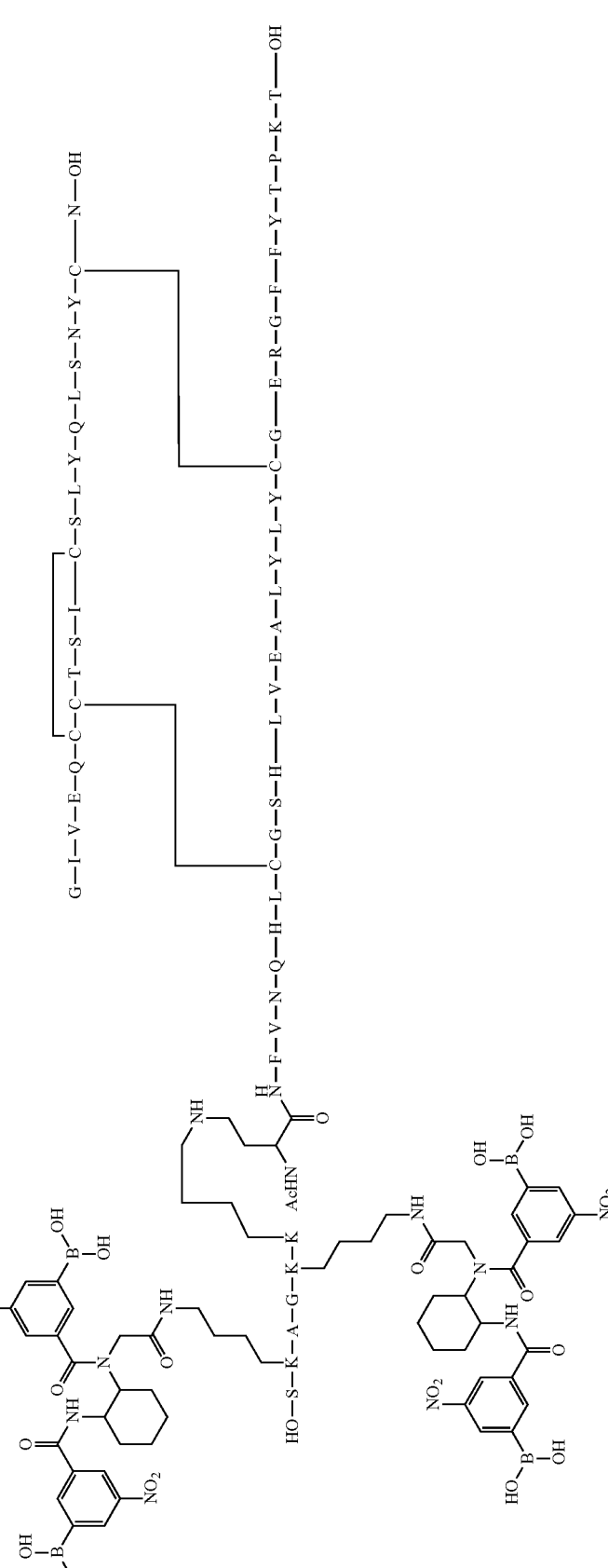

-continued
Example 476
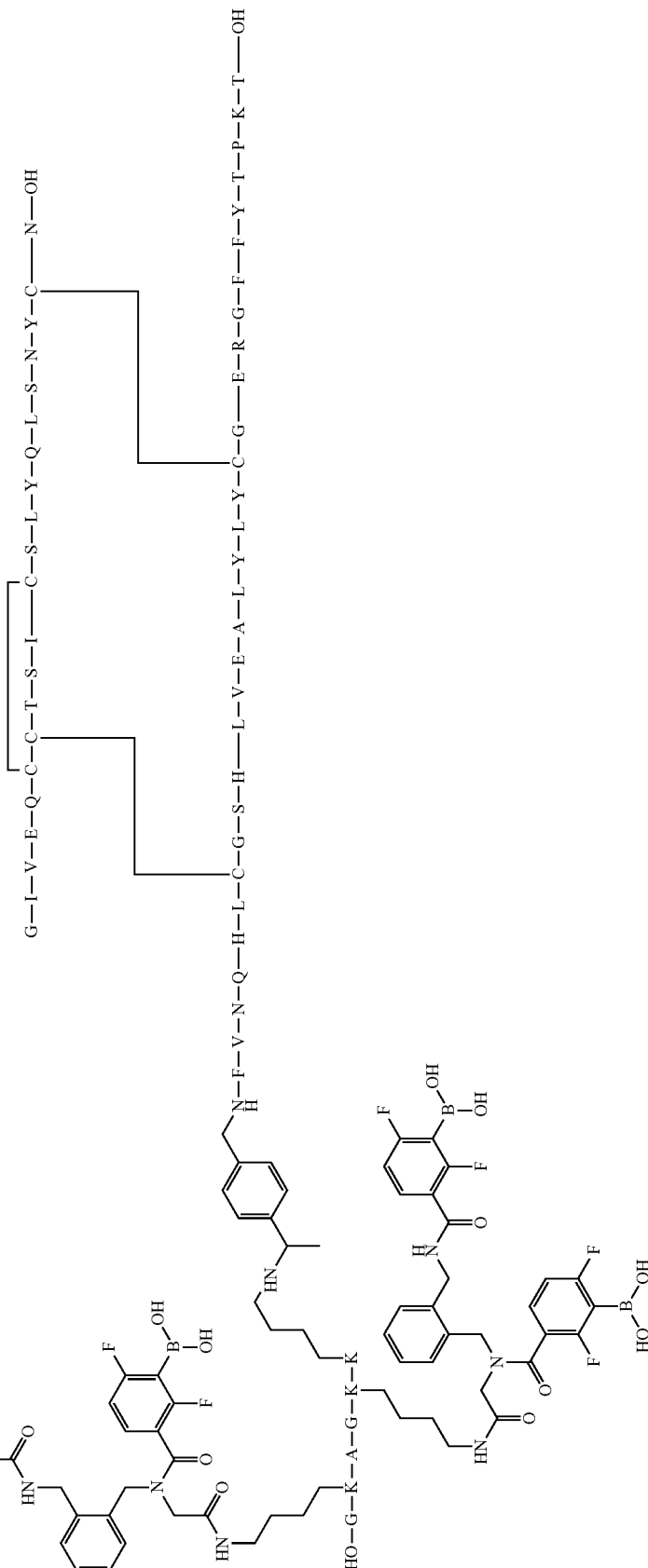

1661    1662
-continued
Example 477
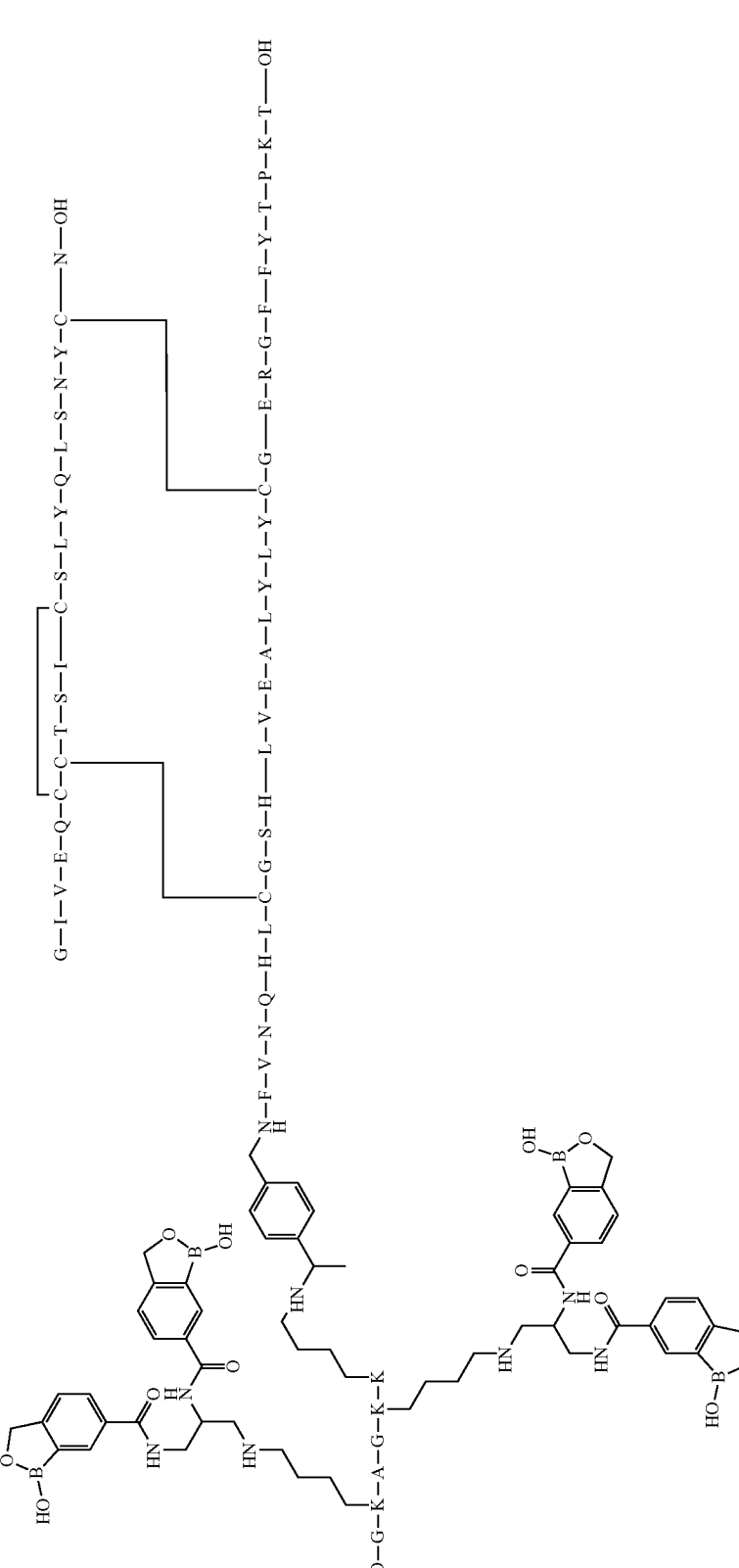

-continued

Example 478

-continued

Example 479

-continued

Example 480

-continued

Example 481

1671 1672

Example 482

-continued
Example 483
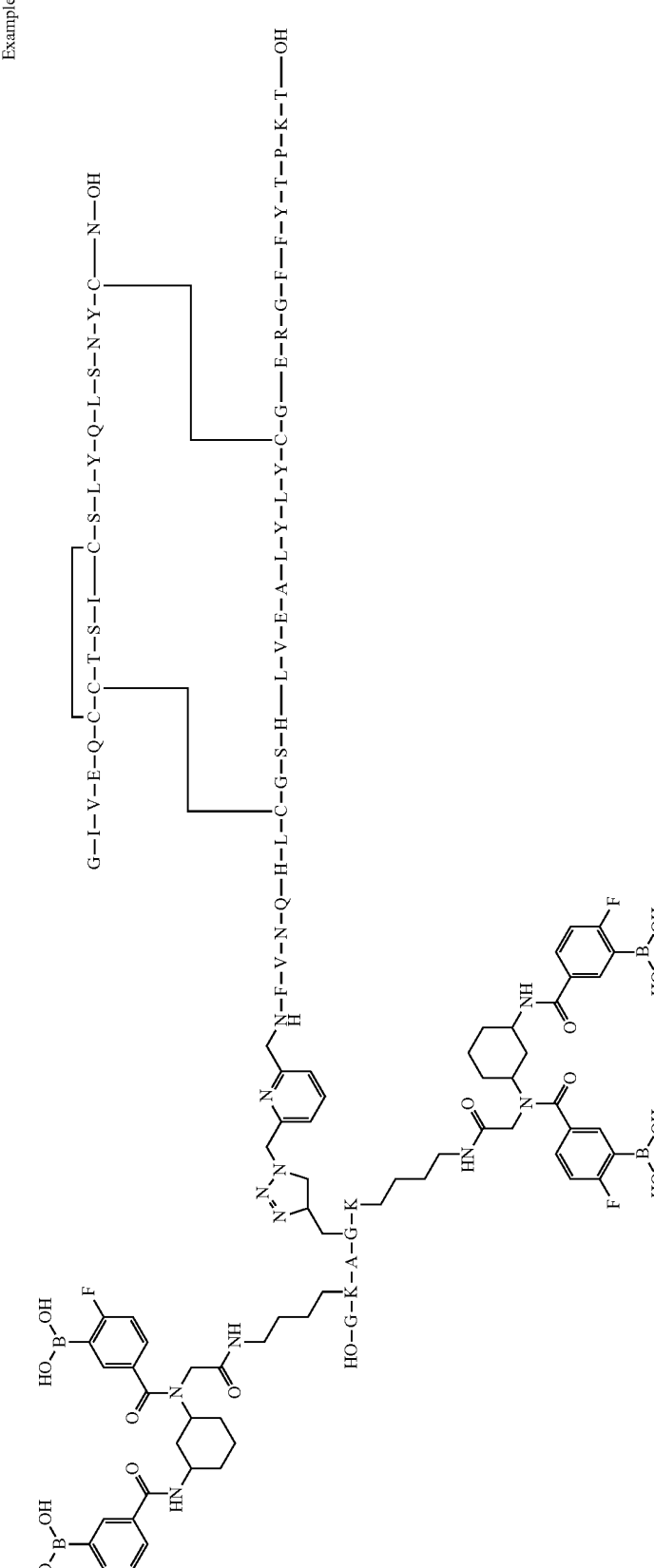

-continued

Example 484

Example 485

-continued

Example 486

G-I-V-E-Q-C-C-T-S-I-C-S-L-Y-Q-L-E-N-Y-C-N—OH

F-V-N-Q-H-L-C-G-S-H-L-V-E-A-L-Y-L-V-C-G-E-R-G-F-F-Y-T-P-K-T—OH

-continued

Example 487

-continued

Example 488

G-I-V-E-Q-C-C-T-S-I-C-S-L-Y-Q-L-E-N-Y-C-N—OH

H—F-V-N-Q-H-L-C-G-S-H-L-V-E-A-L-Y-L-V-C-G-E-R-G-F-F-Y-T-P-K-T—OH

Example 489
-continued
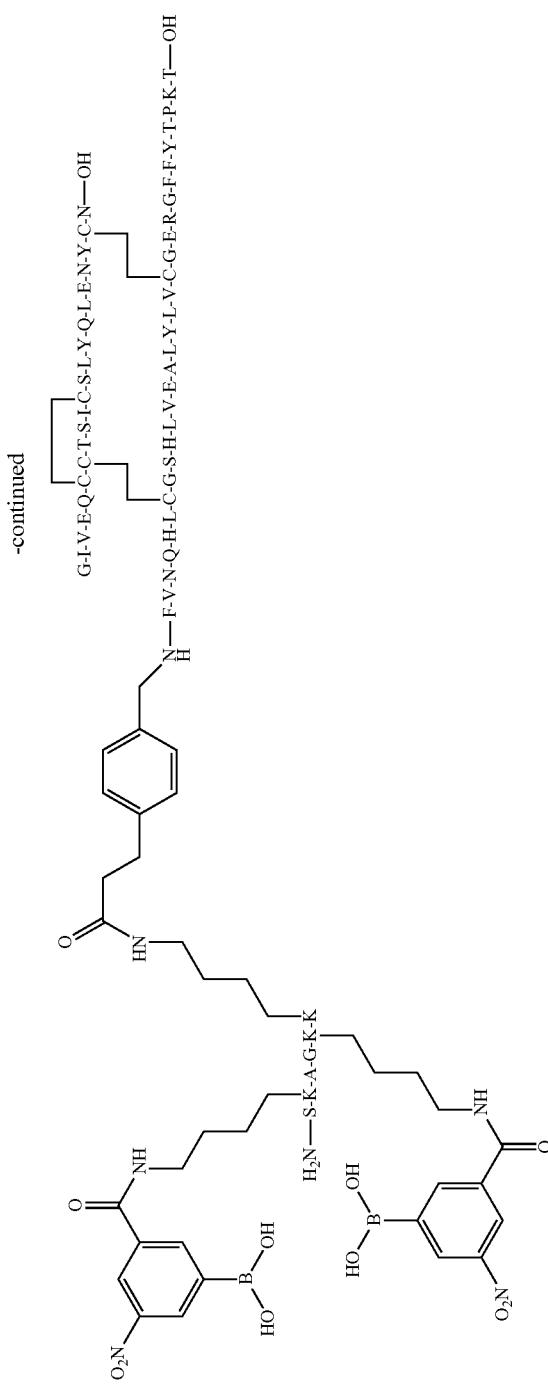

1687                                      1688

Example 490

1689

1690

Example 491

Example 492

-continued

G-I-V-E-Q-C-C-T-S-I-C-S-L-Y-Q-L-E-N-Y-C-N—OH

N—F-V-N-Q-H-L-C-G-S-H-L-V-E-A-L-Y-L-V-C-G-E-R-G-F-F-Y-T-P-K-T—OH

H₂N—S-K-A-G-K-K

HO—B, O, N, NH, HN, OH

Example 493

-continued

G-I-V-E-Q-C-C-T-S-I-C-S-L-Y-Q-L-E-N-Y-C-N—OH

F-V-N-Q-H-L-C-G-S-H-L-V-E-A-L-Y-L-V-C-G-E-R-G-F-F-Y-T-P-K-T—OH

H
N

H₂N—S-K-A-G-K-K

-continued

Example 494

G-I-V-E-Q-C-C-T-S-I-C-S-L-Y-Q-L-E-N-Y-C-N—OH

F-V-N-Q-H-L-C-G-S-H-L-V-E-A-L-Y-L-V-C-G-E-R-G-F-F-Y-T-P-K-T—OH

H₂N—S-K-A-G-K-K

Example 495

-continued

G-I-V-E-Q-C-C-T-S-I-C-S-L-Y-Q-L-E-N-Y-C-N—OH

F-V-N-Q-H-L-C-G-S-H-L-V-E-A-L-Y-L-V-C-G-E-R-G-F-F-Y-T-P-K-T—OH

Example 496

-continued

1701                    1702

Example 497

G-I-V-E-Q-C-C-T-S-I-C-S-L-Y-Q-L-E-N-Y-C—N—OH

N—F-V-N-Q-H-L-C-G-S-H-L-V-E-A-L-Y-L-V-C-G-E-R-G-F-F-Y-T-P-K-T—OH

K-G-A-K-S

-continued

Example 498

G-I-V-E-Q-C-C-T-S-I-C-S-L-Y-Q-L-E-N-Y-C-N—OH

H—F-V-N-Q-H-L-C-G-S-H-L-V-E-A-L-Y-L-V-C-G-E-R-G-F-F-Y-T-P-K-T—OH

Example 499

-continued

G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P-K-T—OH

1707                                                                 1708

Example 500

-continued

G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P-K-T—OH

-continued

Example 501

1711

1712

Example 502

-continued

G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P-K-T—OH $H_2N$—S-K-A-G-K-K

1713  1714

Example 503

-continued

G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P-K-T—OH

H₂N—S-K-A-G-K-K

Example 504

-continued

G-I-V-E-Q-C-C-T-S-I-C-S-L-Y-Q-L-E-N-Y-C-N—OH

N—F-V-N-Q-H-L-C-G-S-H-L-V-E-A-L-Y-L-V-C-G-E-R-G-F-F-Y-T-P-K-T—OH

HO-S-K-A-G-K-K

-continued

Example 505

G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

Example 506

-continued

G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

S-K-A-G-K-K 1721                                                                                    1722

Example 507

1723 1724
Example 508
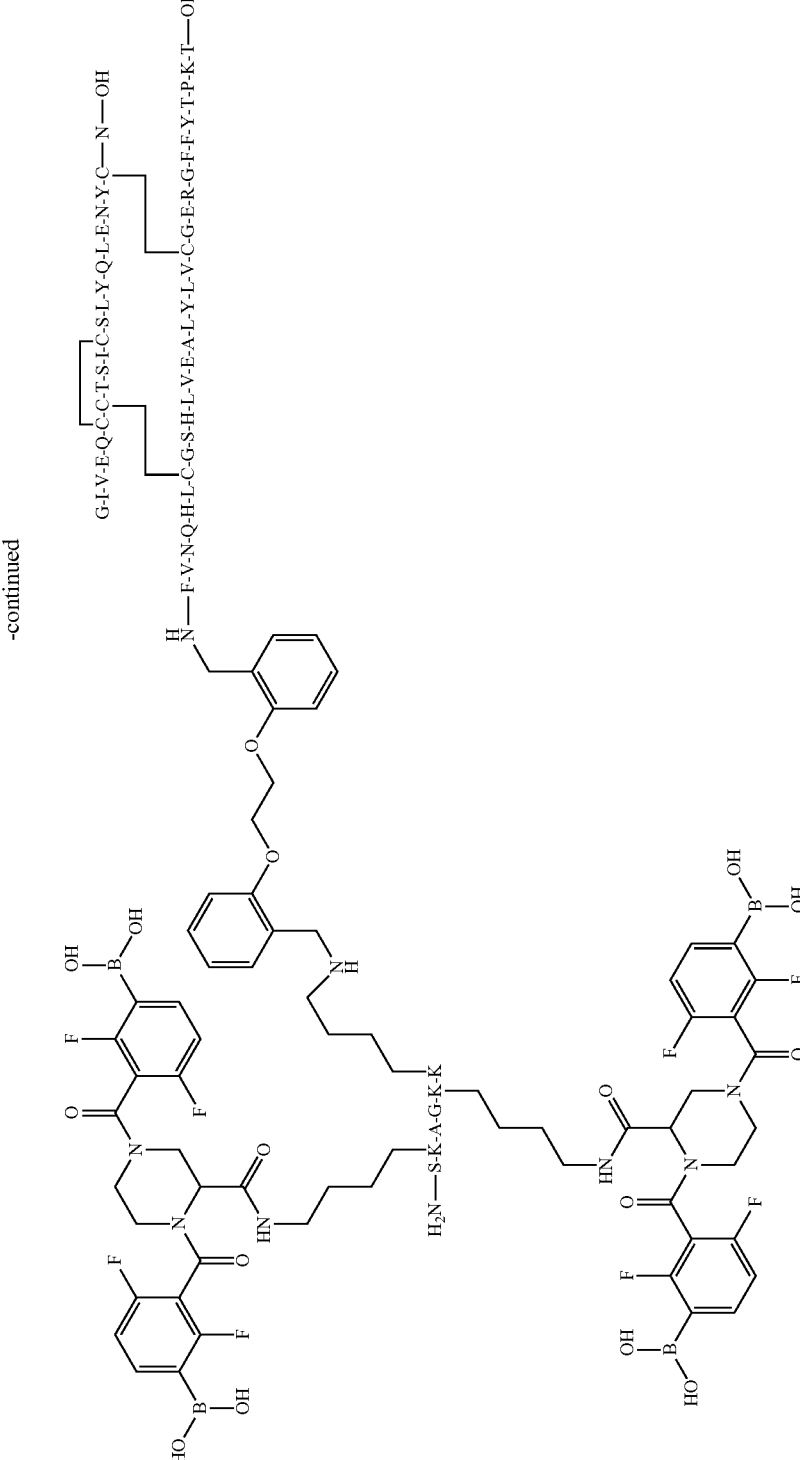

Example 509

-continued

G-I-V-E-Q-C-C-T-S-I-C-S-L-Y-Q-L-E-N-Y-C-N—OH
F-V-N-Q-H-L-C-G-S-H-L-V-E-A-L-Y-L-V-C-G-E-R-G-F-F-Y-T-P-K-T—OH

-continued
Example 510
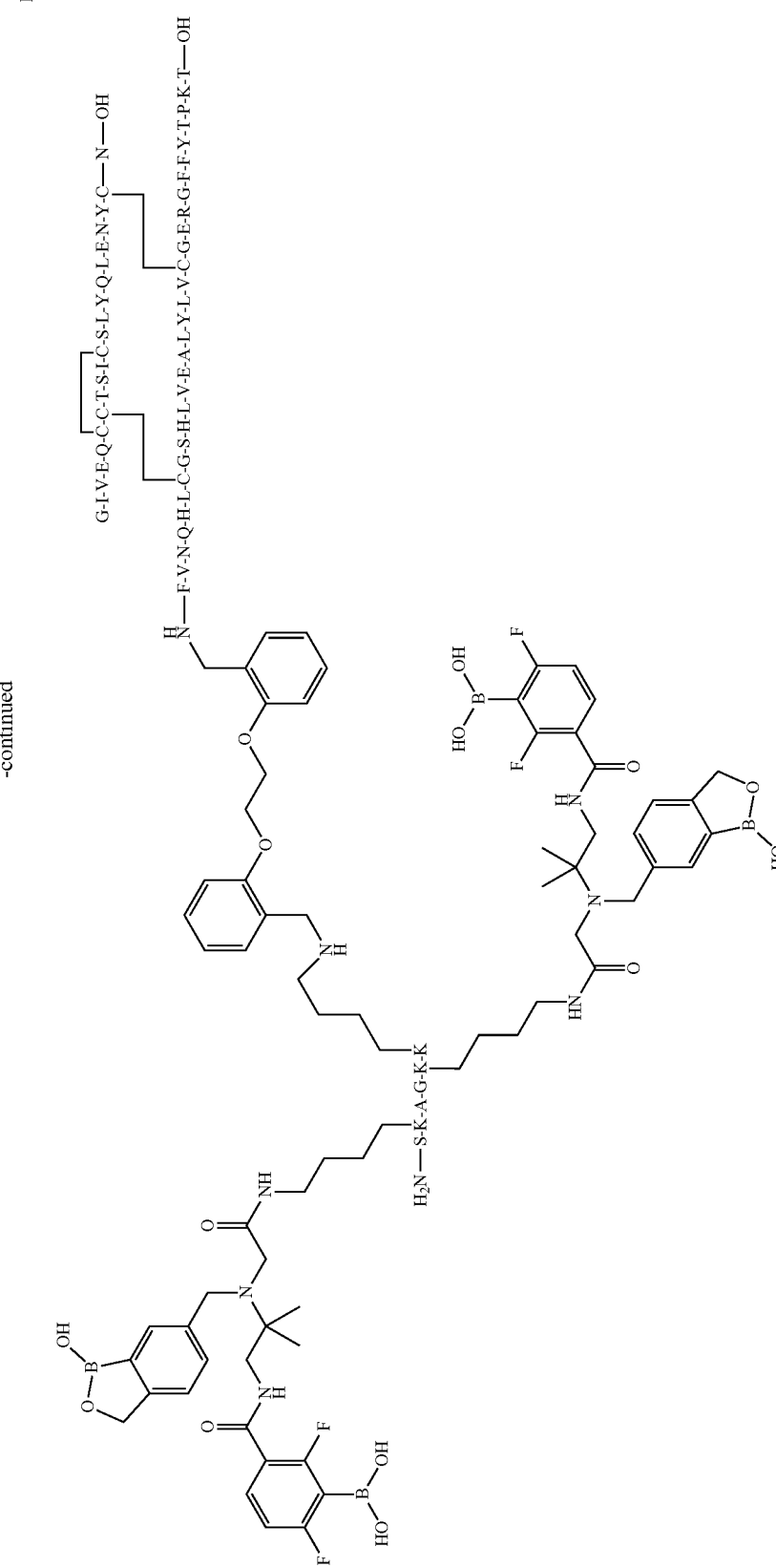

Example 511

-continued

G-I-V-E-Q-C-C-T-S-I-C-S-L-Y-Q-L-E-N-Y-C—N—OH

HN—F-V-N-Q-H-L-C-G-S-H-L-V-E-A-L-Y-L-V-C-G-E-R-G-F-F-Y-T-P-K-T—OH

1731    1732

-continued

Example 512

G-I-V-E-Q-C-C-T-S-I-C-S-L-Y-Q-L-E-N-Y-C—N—OH

N—F-V-N-Q-H-L-C-G-S-H-L-V-E-A-L-Y-L-V-C-G-E-R-G-F-F-Y-T-P-K-T—OH

-continued

Example 513

G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P-K-T—OH

Example 514

-continued

G-I-V-E-Q-C-C-T-S-I-C-S-L-Y-Q-L-E-N-Y-C—N—OH

F-V-N-Q-H-L-C-G-S-H-L-V-E-A-L-Y-L-V-C-G-E-R-G-F-F-Y-T-P-K-T—OH

K-G-A-K-S

1737

1738

1739

1740

Example 515

Example 516

1741

1742

-continued

Example 517

Example 518

1743

1744

Example 519

Example 520

-continued

-continued

Example 521

Example 522

-continued

Example 523

-continued

Example 524

-continued

Example 525

-continued

Example 526

-continued

Example 527

-continued

Example 528

1759

1760

Example 529

Example 530

-continued

G—I—V—E—Q—C—C—T—S—I—C—S—L—Y—Q—L—E—N—Y—C—N

N—F—V—N—Q—H—L—C—G—S—H—L—C—G—E—R—G—F—F—Y—T—P—K—T—OH

G—I—V—E—Q—C—C—T—S—I—C—S—L—Y—Q—L—E—N—Y—C—N

N—F—V—N—Q—H—L—C—G—S—H—L—V—E—A—L—Y—L—V—C—G—E—R—G—F—F—Y—T—P—K—T—OH

-continued

Example 531

Example 532

-continued

Example 533

-continued

Example 534

-continued

Example 535

-continued

Example 536

-continued

Example 537

G-I-V-E-Q-C-C-T-S-I-C-S-L-Y-C-L-E-N-Y-C-N—OH

N—F-V-N-Q-H-L-C-G-S-H-L-V-E-A-L-Y-L-V-C-G-E-R-G-F-F-Y-T-P-K-T—OH

1775

1776

Example 538

Example 539

1777

1778

-continued

Example 540

Example 541

-continued

Example 542

Example 543

-continued

-continued

Example 544

-continued

Example 545

-continued

Example 546

-continued

Example 547

-continued

Example 548

1793                                                                    1794

-continued

Example 549

-continued

Example 550

1797                                    1798

Example 551

-continued

Example 552

-continued

1801

1802

Example 553

1803            1804

Example 554

-continued

Example 555

Example 556

-continued

1809                                        1810

Example 557

-continued

Example 558

-continued

1813           1814

-continued

Example 559

-continued

Example 560

Example 561

-continued

Example 562

H—G—I—V—E—Q—C—C—T—S—I—C—S—

F—V—N—Q—H—L—C—G—S—

—L—Y—Q—L—E—N—Y—C—N—OH

—H—L—V—E—A—L—Y—L—V—C—G

R—G—F—F—Y—T—P—R—T—OH

1821                                                                    1822

-continued

Example 563

H—G—I—V—E—Q—C—C—T—S—I—C—S—

H—G—N—G—S—H—F—V—N—Q—H—L—C—G—S—

—L—Y—Q—L—E—N—Y—C—N—OH

—H—L—V—E—A—L—Y—L—V—C—G—R—G—F—F—Y—T—P—R—T—OH

-continued

Example 564

1825                                                                                     1826

Example 565

1827 1828

Example 566

-continued

Example 567

-continued

Example 568

-continued

Example 569

H–G–I–V–E–Q–C–C–T–S–I–C–S—

F–V–N–Q–H–L–C–G–S—

—L–Y–Q–L–E–N–Y–C–N–OH

—H–L–V–E–A–L–Y–L–V–C–G

R–G–F–F–Y–T–P–K–T–OH

-continued

Example 570

-continued

Example 571

-continued

Example 572

45

Example 573

1843
1844

-continued

Example 574

H—G-I-V-E-Q-C-C-T-S-I—C-S-L-Y-Q-L-E-N-Y-C—N—OH

F-V-N-Q-H-L—C-G-S-H-L-V-E-A-L-Y—L-V-C-G-E-R-G-F-F-Y—T-P—

H—G—

1845

1846

Example 575

-continued

Example 576

1849                                                    1850

Example 577

-continued

Example 578

-continued 1853                                    1854

-continued

Example 579

H—F-V-N-Q-H-L-C-G-S-H—L-V-E-A-L-Y-L-V-C-G—E-R-G-F-F-Y-T-P

G-I-V-E-Q-C-C-T-S-I—C-S-L-Y-Q-L-E-N-Y-C—N—OH

L-W-A-V

Example 580

-continued

G-I-V-E-Q-C-C-T-S-I-C-S-L-Y-Q-L-E-N-Y-C-N—OH

H—F-V-N-Q-H-L-C-G-S-H—L-V-E-A-L-Y-L-V-C-G—E-R-G-F-F-Y-T-P-

L-W-A-V-

1857                                          1858

Example 581

Example 582

1861

1862

Example 583

Example 584

-continued

-continued

Example 585

-continued

Example 586

-continued

Example 587

H—G-I-V-E-Q-C-C-T-S-I—C-S-L-Y-Q-L-E-N-Y-C—N—OH

F-V-N-Q-H-L-C-G-S-H—L-V-E-A-L-Y-L-V-C-G—E-R-G-F-F-Y-T-P—T-OH

G-A-R-L

-continued

Example 588

Example 589

-continued

Example 590

-continued

1877

1878

-continued

Example 591

Example 592

-continued

-continued

Example 593

1883

1884

Example 594

H—G-I-V-E-Q-C-C-T-S-I—C-S-L-Y-Q-L-E-N-Y-C-N—OH

F-V-N-Q-H-L-C-G-S-H-L-V-E-A-L-Y-L-V-C-G-E-R-G-F-F-Y-T-P 1885                                                1886

Example 595

-continued

1887          1888

Example 596

1889                                                                1890

Example 597

-continued

1891                                                1892

Example 598

-continued 1893                                                                1894

Example 599

-continued

1895                                                                                    1896

Example 600

-continued

1897

1898

Example 601

H—G—I—V—E—Q—C—C—T—S—I—C—S—L—Y—Q—L—E—N—Y—C—N—OH

H—F—V—N—Q—H—L—C—G—S—H—L—V—E—A—L—Y—L—V—C—G—E—R—G—F—F—Y—T—P

T—L—N—OH

1899

1900

Example 602

-continued

1901                                                        1902

Example 603

H—G-I-V-E-Q-C-C-T-S-I—C-S-L-Y-Q-L-E-N-Y-C—N—OH

H—A-D             T-L-N—F-V-N-Q-H-L-C-G-S-H—L-V-E-A-L-Y-L-V-C-G——

1903                     1904

-continued

Example 604

-continued

Example 605

-continued

Example 606

H—G-I-V-E-Q-C-C-T-S-I—C-S-L-Y-Q-L-E-N-Y-C—N—OH

—C-G-S-H-L-V-E-A-L-Y—L-V-C-G

R-G-F-F-Y—T-P-K-T—OH

-continued

Example 607

1911      1912

-continued

Example 608

Peptide sequences shown in structure 1911:

F-V-N-Q-H-L

N-S-T

Peptide sequences shown in structure 1912:

H—G-I-V-E-Q-C-C-T-S-I—C-S-L-Y-Q-L-E-N-Y-C—N—OH

—C-G-S-H-L-V-E-A-L-Y—L-V-C-G—N

R-G-F-F-Y—T-P-R-T—OH

-continued

Example 609

-continued

Example 610

1917

1918

Eample 611

-continued

Example 612

1921                                               1922

-continued

Example 613

1923                                          1924

Example 614

-continued

1927  1928

Example 615

1929  1930

Example 616

-continued 1931         1932

Example 617

-continued

T-L-N-OH

H—F-V-N-Q-H-L-C-G-S-H——L-V-E-A-L-Y-L-V-C-G—E-R-G-F-F-Y-T-P

H—G-I-V-E-Q-C-C-T-S-I——C-S-L-Y-Q-L-E-N-Y-C—N-A-D 1933                                                    1934

Example 618

1935

1936

Example 619

-continued

1937    1938

Example 620

-continued

H—G—I—V—E—Q—C—C—T—S—I—C—S—L—Y—Q—L—E—N—Y—C—N—OH

T—L—N—F—V—N—Q—H—L—C—G—S—H—L—V—E—A—L—Y—L—V—C—G—E—R—G—F—F—Y—T—P

1939                                         1940

Example 621

-continued

1941                                    1942

Example 622

1943                                                    1944

-continued

Example 623

-continued

Example 624

-continued

Example 625

1949                                                                                  1950

-continued

Example 626

H—G—I—V—E—Q—C—C—T—S—I—C—S—L—Y—Q—L—E—N—Y—C—N

F—V—N—Q—H—L—C—G—S—H—L—V—E—A—L—Y—L—V—C—G—E—R—G—F—F—Y—T—P—R—T—OH 1951                                                          1952

-continued

Example 627

1953

1954

1955 1956

Example 628

-continued

Example 629

-continued

Example 630

1961

1962

Example 631

-continued

Example 632

1965  1966

1967

1968

Example 633

-continued

Example 634

Example 635

-continued

1973
1974

Example 636

-continued

1975 1976

-continued

Example 637

Example 638

-continued

Example 639

1981 1982

Example 640

-continued

1983        1984

-continued

Example 641

Example 642

-continued

-continued

Example 643

1989                    1990

Example 644

Example 645

-continued

H-G-I-V-E-Q-C-C-T-S-I-C-S-L-Y-Q-L-E-N-Y-C-N

A-G-F-V-N-Q-H-L-C-G-S-H-L-V-E-A-L-Y-L-V-C-G-E-R-G-F-F-Y-T-P-R-T-OH

Example 646

-continued

-continued

Example 647

-continued

Example 648

-continued

Example 649

2001

2002

Example 650

2003                                    2004

Example 651

2005                                            2006

-continued

Example 652

-continued

2009                                                                 2010

-continued

2011                                                                                                 2012

-continued

Example 653

G—I—V—E—Q—C—C—T—S—I—C—S—L—Y—Q—L—E—N—Y—C—N—OH

2013                                        2014

-continued

Example 654

2017                                                        2018

-continued

2019

2020

Example 655

2021                                                                    2022

Example 656

-continued

Example 657

-continued

Example 658

H—G—I—V—E—Q—C—C—T—S—I—C—S—L—Y—Q—L—E—N—Y—C—N—OH

F—V—N—Q—H—L—C—G—S—H—L—V—E—A—L—Y—L—V—C—G—E—R—G—F—F—Y—T—P—R—T—OH

-continued

Example 659

H—F—V—N—Q—H—L—C—G—S—H—L—V—E—A—L—Y—L—V—C—G—E—R—G—F—F—Y—T—P—R—T—OH

G—I—V—E—Q—C—C—T—S—I—C—S—L—Y—Q—L—E—N—Y—C—N—OH 2029                                                      2030

Example 660

-continued

2031

2032

Example 661

-continued

Example 662

2035                                   2036

Example 663

Example 664

-continued

H-G-I-V-E-Q-C-C-T-S-I-C-S-L-Y-Q-L-E-N-Y-C-N

A-G-F-V-N-Q-H-L-C-G-S-H-L-V-E-L-Y-L-V-C-G-E-R-G-F-F-Y-T-P-R-OH

-continued

Example 665

2041

2042

Example 666

-continued

2043

2044

Example 667

2045

2046

-continued

Example 668

G-I-V-E-Q-C-C-Y-S-I-C-S-L-Y-Q-L-E-N-Y-C-N-OH

H-F-V-N-Q-H-L-C-G-S-H-L-V-E-A-L-Y-L-V-C-G-E-R-G-F-F-Y-T-P-R-T-OH

F-I-F

2047

2048

Example 669

-continued

H-G-I-V-E-Q-C-C-Y-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-R-T-OH

F-I-F

-continued

Example 670

H-G-I-V-E-Q-C-C-Y-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P

F-I-F

T-OH

2051                                        2052

Example 671

H-F-V-N-Q-H-L-C-Q-S-H-L-V-E-A-L-Y-L-V-C-G-E-R-G-F-F-Y-T-P-

G-I-V-E-Q-C-C-Y-S-I-C-S-L-Y-Q-L-E-N-Y-C-N-OH

T-OH

2053　　　　　　　　　　　　　　　2054

Example 672

-continued

H-G-I-V-E-Q-C-C-Y-S-I-C-S-L-Y-Q-L-E-N-Y-C-N-OH

H-F-V-N-Q-H-L-C-G-S-H-L-V-E-A-L-Y-L-V-C-G-E-R-G-F-F-Y-T-P

2055  2056

-continued

Example 673

Peptide sequence labels visible in structure:

F-I-F-T-OH

H-F-V-N-Q-H-L-C-G-S-H-L-V-E-A-L-Y-L-V-C-G-E-R-G-F-F-Y-T-P

G-I-V-E-Q-C-C-T-S-I-C-S-L-Y-Q-L-E-N-Y-C-N-OH

H₂N-

2057 2058

Example 674

2059 2060

Example 675

-continued

H-F-V-N-Q-H-L-C-G-S-H—L-V-E-A-L-Y-L-V-C-G—E-R-G-F-F-Y-T-P-

G-V-E-Q-C-C-T-S-I-C——S-L-Y-Q-L-E-N-Y-C-N-OH

Example 676

-continued

-continued

Example 677

2065

2066

-continued

Example 678

2067

2068

Example 679

-continued

2069

2070

Example 680

2071

2072

-continued

Example 681

-continued

Example 682

2075

2076

Example 683

-continued

Example 684

-continued

-continued

Example 685

Example 686

-continued

L-L-OH

Y-C-N-D

C-G-E-R-G-F-F-Y-T-P-R-T-OH

S-I-C-S-L-Y-Q-L-E-N

S-H-L-V-E-A-L-Y-L-V

L-L-V-E-Q-C-C-T

H-D-N

L-L-N-Q-H-L-C-G

H-D-N 2083           2084

Example 687

H—F-V-N-Q-H-L-C-G-S-H-L-V-E-A-L-Y-L-V-C-G-E-R-G-F-F-Y-T-P

H—D-N-I-G-I-V-E-Q-C-C-T-S-I-C-S-L-Y-Q-L-E-N-Y-C-N—OH

L-L-D

Example 688

H—G-I-V-E-Q-C-C-T-S-I-C-S-L-Y-Q-L-E-N-Y-C-N-D

H—F-V-N-Q-H-L-C-G-S-H-L-V-E-A-L-Y-L-V-C-G-E-R-G-F-F-Y-T-P

L-L-D

N-I—OH

2085

2086

-continued

Example 689

H—G-I-V-E-Q-C-C-T-S-I-C-S-L-Y-Q-L-E-N-Y-C-N—OH

—N-I-F-V-N-Q-H-L-C-G-S-H-L-V-E-A-L-Y-L-V-C-G-E-R-G-F-F-Y-T-P—NH

T—OH

2087                                                                                                  2088

Example 690

2089

2090

Example 691

2091

2092

Example 692

Example 693

2093                                                                 2094

-continued

Example 694

-continued

Example 695

H—G-I-V-E-Q-C-C-T-S-I-C-S-L-Y-Q-L-E-N-Y-C-N-D

H—D

L-L-N-Q-H-L-C-G-S-H-L-V-E-A-L-Y-L-V-C-G-E-R-G-F-F-Y-T-P

N-I—OH

T—OH

Example 696

2097

2098

-continued

H—G-I-V-E-Q-C-C-T-S-I-C-S-L-Y-Q-L-E-N-Y-C-N-D

L-L-F-V-N-Q-H-L-C-G-S-H-L-V-E-A-L-Y-L-V-C-G-E-R-G-F-F-Y-T-P

2099

2100

Example 697

2101

2102

Example 698

2103                                                    2104

Example 699

2105

2106

Example 700

-continued

2107

2108

Example 701

2109                                                                              2110

Example 702

Example 703

-continued

H-F-V-N-Q-H-L-C-G-S-H-L-V-E-A-L-Y-L-V-C-G-E-R-G-F-F-Y-T-P

H-D-H-L-L-G-I-V-E-Q-C-C-T-S-I-C-S-L-Y-Q-L-E-N-Y-C-N-OH 2113                                                                           2114

Example 704

H—G-I-V-E-Q-C-C-T-S-I-C-S-L-Y-Q-L-E-N-Y-C-N-D

L-L-F-V-N-Q-H-L-C-G-S-H-L-V-E-A-L-Y-L-V-C-G-E-R-G-F-F-Y-T-P-R-T—OH

L-L—OH

2115                    2116

Example 705

-continued

L-L-G-I-V-E-Q-C-C-T-S-I-C-S-L-Y-Q-L-E-N-Y-C-N-D

L-L-F-V-N-Q-H-L-C-G-S-H-L-V-E-A-L-Y-L-V-C-G-E-R-G-F-F-Y-T-P

T—OH

L-L—OH

H—D

H—D

2117

2118

Example 706

2119

2120

Example 707

2121          2122

Example 708

-continued 2123          2124

Example 709

2125                                           2126

Example 710

—G-I-V-E—Q-C-C-T-S-I-C-S-L-Y—Q-L-E-N-Y-C-N—OH

H—F-V-N-Q-H-L-C-G-S-H—L-V-E-A-L-Y-L-V-C-G—E-R-G-F-F-Y-T-P—N-H—T—OH

2127                                                                 2128

Example 711

2129                                                                                          2130

—G-I-V-E—Q-C-C-T-S-I-C-S-L-Y—Q-L-E-N-Y-C-N—OH

H—F-V-N-Q-H-L-C-G-S-H—L-V-E-A-L-Y-L-V-C-G—E-R-G-F-F-Y-T-P—N

Example 712

2131　　　　　　　　　　　　　　　　　　　　　　　　　2132

—I-V-E-Q—C-C-T-S-I-C-S-L-Y-Q—L-E-N-Y-C-N—OH

H—F-V-N-Q-H-L-C-G-S-H—L-V-E-A-L-Y-L-V-C-G—E-R-G-F-F-Y-T-P—N-H—T—OH 2133                                                          2134

-continued

Example 713

2135

2136

-continued

H—G-I-V-E—Q-C-C-T-S-I-C-S-L-Y—Q-L-E-N-Y-C-N—OH

—F-V-N-Q-H-L-C-G-S-H—L-V-E-A-L-Y-L-V-C-G—E-R-G-F-F-Y-T-P—T-OH

-continued

Example 714

—V-E-Q-C——C-T-S-I-C-S-L-Y-Q-L——E-N-Y-C-N——OH

H—F-V-N-Q-H-L-C-G-S-H——L-V-E-A-L-Y-L-V-C-G——E-R-G-F-F-Y-T-P——N——T—OH

2139

2140

-continued

35

Example 715

2141

2142

-continued

Example 716

H—G-I-V-E-Q-C-C-T-S-I-C-S-L-Y-Q-L-E-N-Y-C—N—OH

H—G—N—P-A-R—N—V-N-Q-H-L-C-G-S-H-L-V-E-A-L-Y-L-V-C-G-E-R-G-F-F-Y-T-P—N—T-OH

-continued

Example 717

Example 718

2145

2146

-continued

Example 719

-continued

Example 720

H—G-I-V-E-Q-C-C-T-S-I-C-S-L-Y-Q-L-E-N-Y-C—N—OH

H—G—N—...—P-A-R—N—F-V-N-Q-H-L-C-G-S-H-L-V-E-A-L-Y-L-V-C-G-E-R-G-F-F-Y-T-P-R-T—OH

Example 721

H₂N—G-E-G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P—N—...—T—OH

2149

2150

-continued

Example 722

2151                                                                    2152

Example 723

Example 724

2153  2154

-continued

Example 725

2155        2156

-continued

Example 726

2157

2158

-continued

Example 728

2161 2162

Example 729

-continued

Example 730

-continued 2165 2166

-continued

Example 731

-continued

Example 732

-continued

Example 733

2171      2172

Example 734

Example 735

-continued

-continued

Example 735

2177

2178

Example 737

2179                                                                                          2180

Example 738

H–F–V–N–Q–H–L–C–G–S–H–L–V–E–A–L–Y–L–V–C–G–E–R–G–F–F–Y–T–P–K–T–OH

2181

2182

-continued

Example 739

2183                                                                 2184

-continued

-continued

Example 740

-continued

-continued

Example 741

2191

2192

-continued

-continued
Example 742
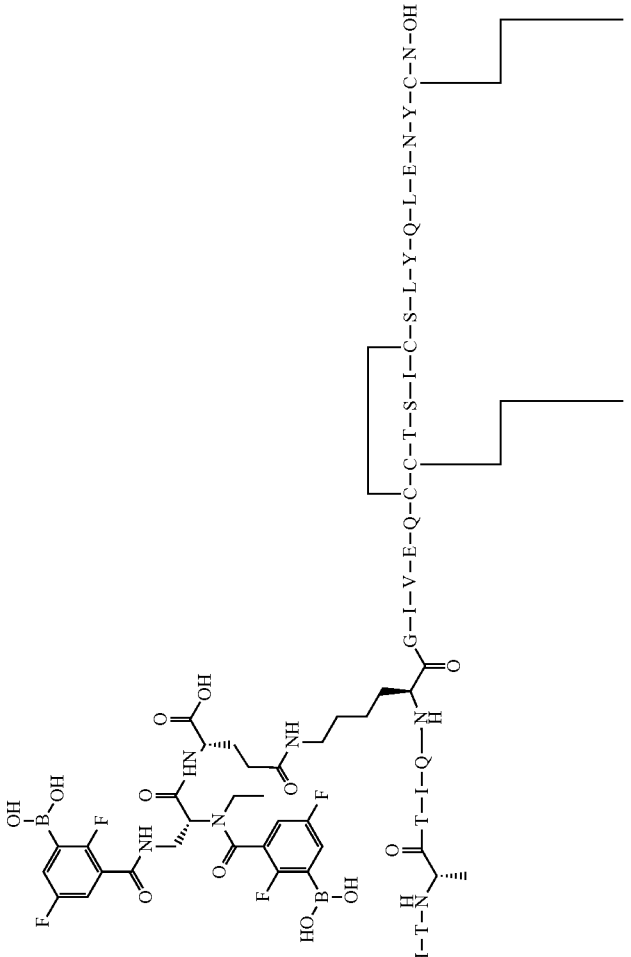

2195
2196
-continued
H—F—V—N—Q—H—L—C—G—S—H—L—V—E—A—L—Y—L—V—C—G—E—N
H—G—I—V—E—Q—C—C—T—S—I—C—S—L—Y—Q—L—E—N—Y—C—N—OH
G—F—F—Y—T—P—K—T—OH
Example 743
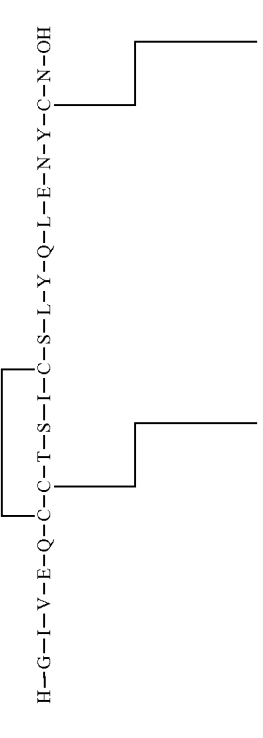

-continued

-continued

Example 744

2201　　　　　　　　　　　　　　　2202

-continued

Example 745

Example 746

-continued

Example 747

-continued

2209

2210

Example 748

2211

2212

Example 749

2213                                                                 2214

Example 750

2215

2216

Example 751

2217 2218

Example 752

2219

2220

2221

2222

-continued

Example 753

H—G-I-V-E-Q-C-C-T-S-I—C-S-L-Y-Q-L-E-N-Y-C—N—OH

F-V-N-Q-H-L-C-G-S-H—L-V-E-A-L-Y-L-V-C-G—E-R-G-F-F-Y-T-P-R-T—OH

P-A-E

H—G

2223

2224

2225                                                        2226

Example 754

2227

2228

-continued 2229                                            2230

Example 755

-continued

2231                                        2232

-continued

2233                                                2234

Example 756

2235
2236

Example 757

-continued 2237            2238

Example 758

-continued

2239

2240

Example 759

2241

2242

Example 760

-continued

-continued

Example 761

2245

2246

Example 762

2247 2248

Example 763

2249

2250

Example 764

2251 2252

-continued

Example 765

H—F-V-N-Q-H-L-C-G-S-H-L-V-E-A-L-Y-L-V-C-G-E-R-G-F-F-Y-T-P

A-E-G-I-V-E-Q-C-C-T-S-I-C-S-L-V-Q-L-E-N-Y-C—N—OH

2253                                                                 2254

-continued

Example 766

2255

2256

Example 767

-continued

2257

2258

Example 768

-continued

H—G-I-V-E-Q-C-C-T-S-I-C-S-L-V-Q-L-E-N-Y-C—N—OH

F-V-N-Q-H-L-C-G-S-H-L-V-E-A-L-Y-L-V-C-G-E-R-G-F-F-Y-T-P

E-E-S 2259 2260

Example 769

-continued

H—G-I-V-E-Q-C-C-T-S-I-C-S-L-V-Q-L-E-N-Y-C—N—OH

F-V-N-Q-H-L-C-G-S-H-L-V-E-A-L-Y-L-V-C-G-E-R-G-F-F-Y-T-P-R-T-OH

E-E-S

2261

2262

Example 770

H—F-V-N-Q-H-L-C-G-S-H-L-V-E-A-L-Y-L-V-C-G-E-R-G-F-F-Y-T-P-R-T—OH

G-I-V-E-Q-C-C-T-S-I-C-S-L-Y-Q-L-E-N-Y-C-N—OH

-continued

Example 771

2265                                          2266

Example 772

2267      2268

Example 773

H–F–V–N–Q–H–L–C–G–S–H–L–V–E–A–L–Y–L–V–C–G–E–R–G–F–F–Y–T–P

G–V–E–Q–C–C–T–S–I–C—S–L–Y–Q–L–E–N–Y–C–N–OH

2269

2270

Example 774

Example 775

-continued

E-E-G-I-V-E-Q-C-C-T—S-I-C-S-L-Y-Q-L-E-N-Y-C-N—OH

H—F-V-N-Q-H-L-C-G-S-H-L-V-E-A-L-Y-L-V-C-G-E-R-G-F-F-Y-T-P

2273

2274

Example 776

2275

2276

Example 777

-continued

E-E-E-I-V-E-Q-C—C-T-S-I-C-S-L-Y-Q-L—E-N-Y-C-N—OH

H-F-V-N-Q-H-L-C-G-S-H—L-V-E-A-L-Y-L-V-C-G-E-R-G-F-F-Y-T-P—

T—OH

E-E-N

E-E-N

H—G 2277                                                   2278

Example 778

2281

2282

Example 779

-continued

E-E-V-E-Q-C-C-T-S-I-C-S-L-V-Q-L-E-N-Y-C-N—OH

H—F-V-N-Q-H-L-C-G-S-H-L-V-E-A-L-Y-L-V-C-G-E-R-G-F-F-Y-T-P-

T—OH

H-G

E-E

2283

2284

Example 780

-continued

E-E-G-I-V-E-Q-C-C-T-S-I-C-S-L-Y-Q-L-E-N—Y-C—N—OH

E-E-F-V-N-Q-H-L-C-G-S-H-L-V-E-A-L-Y-L-V-C-G-E-R-G-F-F-Y-T-P—T-OH

2285

2286

Example 781

2287

2288

Example 782

-continued 2289  2290

Example 783

-continued

2291                                        2292

Example 784

H-G-I-V-E-Q-C-C-T-S-I-C-S-L-Y-Q-L-E-N-Y-C-N-

E-E-F-V-N-Q-H-L-C-G-S-H-L-V-E-A-L-Y-L-V-C-G-E-R-G-F-F-Y-T-P-

E-E-OH

T-OH

Example 785

-continued

H-F-V-N-Q-H-L-C-G-S-H-L-V-E-A-L-Y-L-V-C-G-E-R-G-F-F-Y-T-P

G-S-G-I-V-E-Q-C-C-T-S-I-C-S-L-Y-Q-L-E-N-Y-C-N—OH

H-G—NH

G-P-E-NH

T—OH

2295  2296

-continued

Example 786

N-I-G-I-V-E-Q-C-C-T-S-I-C-S-L-Y-Q-L-E-N-Y-C-N—OH

H-F-V-N-Q-H-L-C-G-S-H-L-V-E-A-L-Y-L-V-C-G-E-R-G-F-F-Y-T-P

H-E

T-OH 2297                                                         2298

Example 787

Example 788

-continued

H-F-V-N-Q-H-L-C-G-S-H-L-V-E-A-L-Y-L-V-C-G-E-R-G-F-F-Y-T-P

N-I-G-I-V-E-Q-C-C-T-S-I-C-S-L-Y-Q-L-E-N-Y-C-N-E

H-G 2301                                        2302

Example 789

-continued

N-I-G-I-V-E-Q-C-C-T-S-I-C-S-L-Y-Q-L-E-N-Y-C-N-OH

N-I-F-V-N-Q-H-L-C-G-S-H-L-V-E-A-L-Y-L-V-C-G-E-R-G-F-F-Y-T-P-

-continued

Example 790

2305      2306

-continued

Example 791

H-G-I-V-E-Q-C-C-T-S-I-C-S-L-Y-Q-L-E-N-Y-C-N-E

H-F-V-N-Q-H-L-C-G-S-H-L-V-E-A-L-Y-L-V-C-G-E-R-G-F-F-Y-T-P

2307

2308

Example 792

-continued

-continued

Example 793

2311 2312

Example 794

-continued

G-S—OH

H-F-V-N-Q-H-L-C-G-S-H-L-V-E-A-L-Y-L-V-C-G-E-R-G-F-F-Y-T-P

G-S-G-I-V-E-Q-C-C-T-S-I-C-S-L-Y-Q-L-E-N-Y-C-N-G-H

H-G—N

T—OH

Example 795

-continued

H-F-V-N-Q-H-L-C-G-S-H-L-V-E-A-L-Y-L-V-C-G-E-R-G-F-F-Y-T-P-H

H-E-H-N-I-E-H-N-I-G-I-V-E-Q-C-C-T-S-I-C-S-L-Y-Q-L-E-N-Y-C-N-OH

-continued

Example 796

2317

2318

-continued

Example 797

G-I-V-EQ-C-C-T-S-I-C-S-L-Y-Q-L-E-N-Y-C-N—OH

H-F-V-N-Q-H-L-C-G-S-H-L-V-E-A-L-Y-L-V-C-G-E-R-G-F-F-Y-T-P-R-T—OH

E-G-Y-D-A-Y

H-E

Example 798

G-I-V-E-Q-C-C-T-S-I-C-S-L-Y-Q-L-E-N-Y-C-N-OH

H-F-V-N-Q-H-L-C-G-S-H-L-V-E-A-L-Y-L-V-C-G-E-R-G-F-F-Y-T-P-R-T-OH

E-G-Y-D-A-Y

H-E

2321 2322

Example 799

-continued

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G-E-R-G-F-F-Y-T-P-R-T-OH

E-G-Y-D-A-Y

H-E 2323 2324

Example 800

Example 801

-continued

2327

2328

Example 802

-continued

G-I-V-E-Q-C-C-T-S-I-C-S-L-Y-Q-L-E-N-Y-C-N-OH

H-F-V-N-Q-H-L-C-G-S-H-L-V-E-A-L-Y-L-V-C-G-E-R-G-F-F-Y-T-P-R-T-OH

E-A-Y 2329                                                                                    2330

Example 803

-continued

2331                                                            2332

-continued

Example 804

H-G-F-F-Y-T-P-K-T-OH

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G

H-G-S-H

Example 805

-continued

H-G-I-V-E-Q-C-C-T-S-I-C-S-L-Y-Q-L-E-N-Y-C-N-OH

H—F-V-N-Q-H-L-C-G-S-H-L-V-E-A-L-Y-L-V-C-G-E-R-G-F-F-Y-T-P-

2335          2336

Example 806

-continued

H-G-I-V-E-Q-C-C-T-S-I-C-S-L-Y-Q-L-E-N-Y-C-N-OH

H-K-G-S-H-K-F-V-N-Q-H-L-C-G-S-H-L-V-E-A-L-Y-L-V-C-G-K-R-G-F-F-Y-T-P-K-T-OH 2337                                               2338

Example 807

-continued

2339

2340

Example 808

-continued

H-G-I-V-E-Q-C-C-T-S-I-C-S-L-Y-Q-L-E-N-Y-C-N-OH

F-V-N-Q-H-L-C-G-S-H-L-V-E-A-L-Y-L-V-C-G

R-G-F-F-Y-T-P

H-G

G-S-H

2341

2342

Example 809

-continued

GSI - 094135

H-G-I-V-E-Q-C-C-T-S-I-C-S-L-Y-Q-L-E-N-Y-C-N-OH

H-F-V-N-Q-H-L-C-G-S-H-L-V-E-A-L-Y-L-V-C-G-E-R-G-F-F-Y-T-P 2343 2344

Example 810

H—G-I-V-E-Q-C-C-T-S-I—C-S-L-Y-Q-L-E-N-Y-C—N—OH

H-L-C-G-S-H-L-V-E-A—L-Y-L-V-C-G-K-R-G-F—F-Y-T-P-K-T—OH

H—G-K-G-S-H-K-F-V-N-Q

2345 2346

Example 811

H—G-I-V-E-Q-C-C-T-S-I— C-S-L-Y-Q-L-E-N-Y-C-N—OH

H-L-C-G-S-H-L-V-E-A— L-Y-L-V-C-G-K-R-G-F— F-Y-T-P-K-T—OH

H—G-K-G-S-H-K-F-V-N-Q

-continued

Example 812

2349

2350

Example 813

Example 814

-continued

H—G-I-V-E-Q-C-C-T-S-I——C-S-L-Y-Q-L-E-N-Y-C—N—OH

H-L-C-G-S-H-L-V-E-A——L-Y-L-V-C-G-K-R-G-F——F-Y-T-P-K-T—H

H—G-K-G-S-H-K-F-V-N-Q

H—G-I-V-E-Q-C-C-T-S-I——C-S-L-Y-Q-L-E-N-Y-C—N—OH

H—G-I-V-E-Q-C-C-T-S-I——C-S-L-Y-Q-L-E-N-Y-C—N—OH

HN—F-V-N-Q-H-L-C-G-S-H——L-V-E-A-L-Y-L-V-C-G——E-R-G-F-F-Y-T-P-K-T—OH 2351                                                                 2352

Example 815

H—G-I-V-E-Q-C-C-T-S-I—C-S-L-Y-Q-L-E-N-Y-C—N—OH

H—F-V-N-Q-H-L-C-G-S-H—L-V-E-A-L-Y-L-V-C-G—E-R-G-F-F-Y-T-P-K-T—OH

2353

2354

Example 816

Example 817

-continued

H—G-I-V-E-Q-C-C-T-S-I—C-S-L-Y-Q-L-E-N-Y-C—N—OH

H-L-C-G-S-H-L-V-E-A—L-Y-L-V-C-G-K-R-G-F—F-Y-T-P-R-T—OH

H—G-K-G-S-H-K-F-V-N-O

2357

2358

Example 818

Example 819

-continued

Example 820

2361                  2362

-continued

Example 821

H—G-I-V-E-Q-C-C-T-S-I——C-S-L-Y-Q-L-E-N-Y-C—N—OH

H—L-C-G-S-B-L-V-E-A——L-Y-L-V-C-G-K-R-G-F——F-Y-T-P-K-T—OH

H—G-K-G-S-H-K-F-V-N-O

-continued

Example 822

-continued

Example 823

-continued

Example 824

2369          2370

Example 825

2371                                                                 2372

-continued

Example 826

2373           2374

Example 827

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 828

H-G-I-V-E-Q-C-C-T-S-I-C-S-L-Y-Q-L-E-N-Y-C-N-OH

H-G-K-F-V-N-Q-H-L-C-G-S-H-L-V-E-A-L-Y-L-V-C-G-K-R-G-F-F-Y-T-P-K-T-OH 2375 2376

Example 829

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 830

H-G-I-V-E-Q-C-C-T-S-I-C-S-L-Y-Q-L-E-N-Y-C-N-OH

HN-F-V-N-Q-H-L-C-G-S-H-L-V-E-A-L-Y-L-V-C-G-E-R-G-F-F-Y-T-P-K-T-OH

2377 2378

Example 831

H-G-I-V-E-Q-C-C-T-S-I-C-S-L-Y-Q-L-E-N-Y-C-N-OH

HN-F-V-N-Q-H-L-C-G-S-H-L-V-E-A-L-Y-L-V-C-G-E-R-G-F-F-Y-T-P

T-OH

Example 832

H-G-I-V-E-Q-C-C-T-S-I-C-S-L-Y-Q-L-E-N-Y-C-N-OH

H-G-K-F-V-N-Q-H-L-C-G-S-H-L-V-E-A-L-Y-L-V-C-G-K-R-G-F-F-Y-T-P-K-T-OH

Example 833

H-G-I-V-E-Q-C-C-T-S-I-C-S-L-Y-Q-L-E-N-Y-C-N-OH

H-G-K-H-E-N-K-F-V-N-Q-H-L-C-G-S-H-L-V-E-A-L-Y-L-V-C-G-K-R-G-F-F-Y-T-P-K-T-OH

-continued

Example 834

H-G-I-V-E-Q-C-C-T-S-I-C-S-L-Y-Q-L-E-N-Y-C-N-OH

H-G-K-F-V-N-Q-H-L-C-G-S-H-L-V-E-A-L-Y-L-V-C-G-K-R-G-F-F-Y-T-P-K-T-OH

Example 835

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 836

H-G-I-V-E-Q-C-C-T-S-I-C-S-L-Y-Q-L-E-N-Y-C-N-OH

H-G-K-F-V-N-Q-H-L-C-G-S-H-L-V-E-A-L-Y-L-V-C-G-K-R-G-F-F-Y-T-P-K-T-OH

2381          2382

Example 837

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 838

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

-continued

Example 839

H-G-I-V-E-Q-C-C-T-S-I—C-S-L-Y-Q-L-E-N-Y-C—N—OH

HN—F-V-N-Q-H-L-C-G-S-H-L-V-E-A-L-Y-L-V-C-G-E-R-G-F-F-Y-T-P—N—T—OH

Example 840

H—G-I-V-E-Q-C-C-T-S-I-C-S-L-Y-Q-L-E-N-Y-C—N—OH

H—F-V-N-Q-H-L-C-G-S-H-L-V-E-A-L-Y-L-V-C-G-E-R-G-F-F-Y-T-P—N—T—OH

H—G-I-V-E-Q-C-C-T-S-I-C-S-L-Y-Q-L-E-N-Y-C—N—OH

V-N-Q-H-L-C-G-S-H-L-V-E-A-L-Y-L-V-C-G—R-G-F-F-Y-T-P-K-T—OH 2385                                                                     2386

Example 842

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

Example 843

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

Example 844

H—G-I-V-E-Q-C-C-T-S-I-C-S-L-Y-Q-L-E-N-Y-C—N—OH

H₂N   HN—F-V-N-Q-H-L-C-G-S-H-L-V-E-A-L-Y-L-V-C-G-E-R-G-F-F-Y-T-P—N—T—OH

-continued

Example 845

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

Example 846

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

Example 847

H—G-I-V-E-Q-C-C-T-S-I-C-S-L-Y-Q-L-E-N-Y-C—N—OH

HN—F-V-N-Q-H-L-C-G-S-H-L-V-E-A-L-Y-L-V-C-G-E-R-G-F-F-Y-T-P-K-T—OH

-continued

Example 848

H—G-I-V-E-Q-C-C-T-S-I-C-S-L-Y-Q-L-E-N-Y-C—N—OH

HN—F-V-N-Q-H-L-C-G-S-H-L-V-E-A-L-Y-L-V-C-G-E-R-G-F-F-Y-T-P-K-T—OH

Example 849

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH 2391                                                                                    2392

-continued

Example 850

H—G-I-V-E-Q-C-C-T-S-I-C-S-L-Y-Q-L-E-N-Y-C—N—OH

H-G-K-G-S-H-K-F-V-N-Q-H-L-C-G-S-H-L-V-E-A-L-Y-L-V-C-G-K-R-G-F-F-Y-T-P-K-T—OH

Example 851

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

-continued

Example 852

H—G-I-V-E-Q-C-C-T-S-I-C-S-L-Y-Q-L-E-N-Y-C—N—OH

H—K-G-S-H-K-F-V-N-Q-H-L-C-G-S-H-L-V-E-A-L-Y-L-V-C-G-K-R-G-F-F-Y-T-P-K-T—OH

Example 853

H—G-I-V-E-Q-C-C-T-S-I-C-S-L-Y-Q-L-E-N-Y-C—N—OH

HN—F-V-N-Q-H-L-C-G-S-H-L-V-E-A-L-Y-L-V-C-G-E-R-G-F-F-Y-T-P

T—OH

-continued

Example 854

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

Example 855

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-K-T—OH

-continued

Example 856

Example 857

-continued

Example 858

H-G-I-V-E-Q-C-C-T-S-I-C-S-L-Y-Q-L-E-N-Y-C-N-OH

H-G-K-Q-S-S-K-P-F-V-N-Q-H-L-C-G-S-H-L-V-E-A-L-Y-L-V-C-G-K-R-G-F-F-Y-T-P-K-T-OH

Example 859

H-G-I-V-E-Q-C-C-T-S-I-C-S-L-Y-Q-L-E-N-Y-C-N-OH

HN-F-V-N-Q-H-L-C-G-S-H-L-V-E-A-L-Y-L-V-C-G-K-R-G-F-F-Y-T-P-K-T-OH

Example 860

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH 2401                                                                                                                    2402

Example 861

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 862

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 863

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

-continued

Example 864

H-G-I-V-E-Q-C-C-T-S-I-C-S-L-Y-Q-L-E-N-Y-C-N-OH

H-G-K-F-V-N-Q-H-L-C-G-S-H-L-V-E-A-L-Y-L-V-C-G-K-R-G-F-F-Y-T-P-K-T-OH

Example 865

H-G-I-V-E-Q-C-C-T-S-I-C-S-L-Y-Q-L-E-N-Y-C-N-OH

H-G ... G-S-K ... F-V-N-Q-H-L-C-G-S-H-L-V-E-A-L-Y-L-V-C-G ... R-G-F-F-Y-T-P ... T-OH

Example 866

H-G-I-V-E-Q-C-C-T-S-I-C-S-L-Y-Q-L-E-N-Y-C-N-OH

HN-F-V-N-Q-H-L-C-G-S-H-L-V-E-A-L-Y-L-V-C-G-E-R-G-F-F-Y-T-P

2405

2406

-continued

Example 867

H-G-I-V-E-Q-C-C-T-S-I-C-S-L-Y-Q-L-E-N-Y-C-N-OH

HN-F-V-N-Q-H-L-C-G-S-H-L-V-E-A-L-Y-L-V-C-G-E-R-G-F-F-Y-T-P 2407 2408

-continued

Example 868

Example 869

-continued

Example 870

-continued

Example 871

Example 872

-continued

—S—L—Y—Q—L—E—N—Y—C—N—OH

—A—L—Y—L—V—C—G—K—R—G—F—F—Y—T—P—K—T—OH

Example 873

H—G—I—V—E—Q—C—C—T—S—I—C—S—

H—G—K—N—S—T—K—F—V—N—Q—H—L—C—G—S—H—L—V—E—A—

-continued

Example 874

2417                                                    2418

Example 875

-continued

Example 876

H—G—I—V—E—Q—

H—G—I—V—E—Q— ... F—V—N—Q—H—

C—C—T—S—I—C—S—L—Y—Q—L—E—N—Y—C—N—OH

L—C—G—S—H—L—V—E—A—L—Y—L—V—C—G— ... R—G—F—F—Y—T—P—R—T—OH

2421

2422

Example 877

H—G—I—V—E—Q—C—C—T—S—I—C—

H—G—N

F—V—N—Q—H—L—C—G—S—H—L—

—S—L—Y—Q—L—E—N—Y—C—N—OH

—V—E—A——L—Y—L—V—C—G

R—G—F——F—Y—T—P—R—OH

2423                                                                 2424

Example 878

2425                                                2426

Example 879

Example 880

2429 2430

-continued

Example 881

H—G—I—V—E—Q—C—C—T—S—I—C—

H—G—K—P—G—G—G—S—G—G—G—S—G—G—G—S—F—V—N—O—H—L—C—G—S—H—L—V

—S—L—Y—Q—L—E—N—Y—C—N—OH

—E—A—L—Y—L—C—G—D—R—G—F—F—Y—T—P—K—OH

Example 882

H—G—I—V—E—Q—

H—G—K—P—G—G—G—S—G—G—G—G—S—G—G—G—S—F—V—N—Q—H—

2431                                                         2432

-continued

Example 883

2433                                                                                           2434

Example 884

H—G—I—V—E—Q—

H—G—K—P—G—G—G—S—G—G——G—G—S—G—G—G—S—F—V—N—Q—H—

—C—C—T—S—I—C—S—L—Y—Q—L—E—N—Y—C—N—OH

—L—C—G—S—H—L—V——E—A—L—Y—L—V—C—G—D—R—G—F—F—Y—T—P—K—OH

H-G-I-V-E-Q-C-C-T-S-I-C-S-L-Y-Q-L-E-N-Y-C-N-OH

H-G-K-F-G-G-G-S-G-G-G-S-G-G-G-S-F-V-N-Q-H-L-C-G-S-H-L-V-E-A-L-Y-L-V-C-G-D-R-G-F-F-Y-T-P-K-OH

-continued

Example 886

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 887

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 888

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH 2437             2438

-continued

Example 889

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

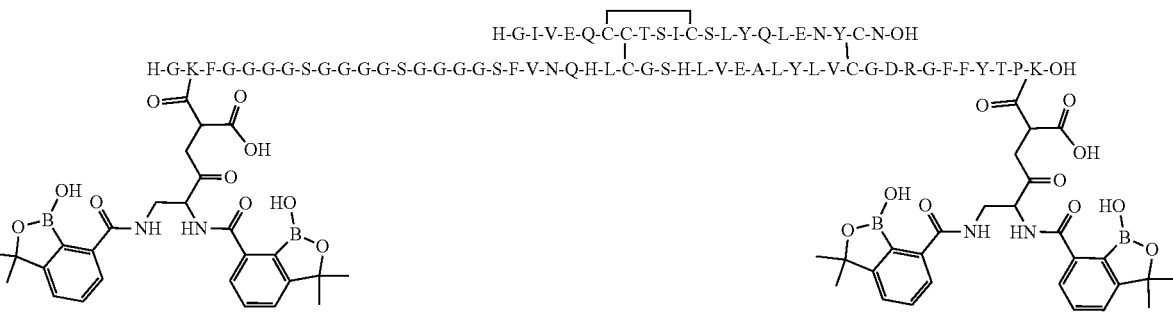

Example 890

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

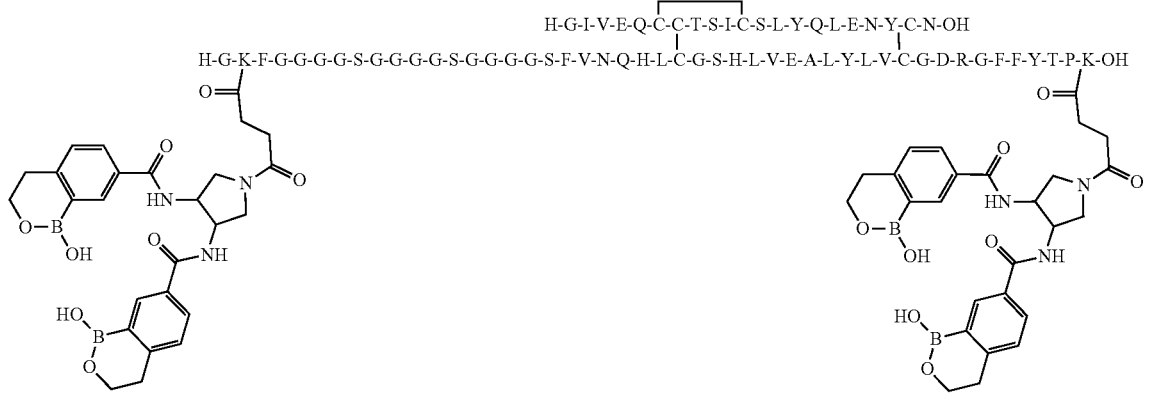

Example 891

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 892

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH 2439 2440

-continued

Example 893

H-G-I-V-E-Q-C-C-T-S-I-C-S-L-Y-Q-L-E-N-Y-C-N-OH
H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 894

H-G-I-V-E-Q-C-C-T-S-I-C-S-L-Y-Q-L-E-N-Y-C-N-OH
H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 895

H-G-I-V-E-Q-C-C-T-S-I-C-S-L-Y-Q-L-E-N-Y-C-N-OH
H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

-continued

Example 896

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 897

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 898

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH 2443        2444

-continued

Example 899

H-G-I-V-E-Q-C-C-T-S-I-C-S-L-Y-Q-L-E-N-Y-C-N-OH

H-G-K-F-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

20

Example 900

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH 2445      2446

-continued

Example 901

H—G-K-P-G-G-G-S-G-G—G-G-S-G-G-G-S-F-V——

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH 2447                                                    2448

-continued

Example 902

H—G-K-P-G-G-G-G-S-G-G—G-G-S-G-G-G-G-S-F-V——

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 903

H—G-K-P-G-G-G-G-S-G-G—G-G-S-G-G-G-G-S-F-V——

-continued

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 904

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

-continued

Example 905

H—G-K-P-G-G-G-G-S-G-G—G-G-S-G-G-G-G-S-F-V——

H-G-I-V-E-Q-C-C-T-S-I—C-S-L-Y-Q-L-E-N-Y-C—N—OH
—N-Q-H-L-C-G-S-H-L-V—E-A-L-V-L-V-C-G-D-R—G-F-F-Y—T—P-K—OH

Example 906

H—G-K-P-G-G-G-G-S-G-G—G-G-S-G-G-G-G-S-F-V——

-continued

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 907

H—G-K-P-G-G-G-G-S-G-G—G-G-S-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH 2455 2456

-continued

Example 908

H—G-K-P-G-G-G-G-S-G-G—G-G-S-G-G-G-G-S-F-V——

Example 908

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 909

H—G-K-P-G-G-G-G-S-G-G—G-G-S-G-G-G-G-S-F-V——

-continued

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 910

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

-continued

Example 911

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 912

H—G-K-P-G-G-G-G-S-G-G—G-G-S-G-G-G-G-S-F-V—

-continued

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 913

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

-continued

Example 914

H—G-K-P-G-G-G-G-S-G-G—G-G-S-G-G-G-G-S-F-V—

H-G-I-V-E-Q-C-C-T-S-I—C-S-L-Y-Q-L-E-N-Y-C—N—OH

—N-Q-H-L-C-G-S-H-L-V—E-A-L-V-L-V-C-G-D-R—G-F-F-Y—T—P-K—OH

Example 915

H—G-K-P-G-G-G-G-S-G-G—G-G-S-G-G-G-G-S-F-V—

-continued

H-G-I-V-E-Q-C-C-T-S-I——C-S-L-Y-Q-L-E-N-Y-C——N——OH

——N-Q-H-L-C-G-S-H-L-V——E-A-L-V-L-V-C-G-D-R——G-F-F-Y——T——P-K——OH

NUMBERED EMBODIMENTS

The present disclosure may also be defined according to any one of the following numbered embodiments:

1. A compound comprising one or more diboronates of the following formula, or a stereoisomer or a mixture of stereoisomers, or pharmaceutically acceptable salt thereof:

$$[Z1c-(Z_1b)_{\overline{n'}}]_{q'}-X1,$$

wherein:

each $Z_1b$ is independently a linker moiety, and each $n'$ is 0, 1, 2, 3, 4, or 5, wherein at least one $n'$ is 1, 2, 3, 4, or 5;

$X1$ comprises a drug substance or a polypeptide;

each $Z_1c$ is covalently conjugated directly or via one or more $Z_1b$ to an amine in $X1$; wherein a) at least one $Z_1c$ is independently selected from a diboronate, wherein the diboronate is independently selected from Formulae FF12A, FF12B, FF12C, FF12D, FF116A, FF116B, FF116C, FF116D, FF225, and FF227; and b) each additional $Z_1c$ is optionally independently selected from a diboronate, a sugar moiety, a diol containing moiety, and a polyol containing moiety, wherein the diboronate is independently selected from Formulae FF12A, FF12B, FF12C, FF12D, FF116A, FF116B, FF116C, FF116D, FF225, and FF227; and each $q'$ is 1, 2, 3, 4, or 5, wherein when $q'$ is 2 or more, each corresponding $Z_1c$ and $Z_1b$ is independently selected and may be the same or different; and wherein Formulae FF12A, FF12B, FF12C, FF12D, FF116A, FF116B, FF116C, FF116D, FF225, and FF227 are:

FF12A

-continued

FF12B

FF12C

FF12D

FF116A

FF116B

FF116C

2467

-continued

FF116D

FF225

FF227 wherein X represents a point of covalent attachment to an amine of Z1b or to an amine of X1 when n' is 0;

i is 1, 2, 3, 4, 5, 6, or 7; and wherein $B_1$ and $B_2$, which may be identical or different, each independently represent an aromatic boron-containing group; and wherein when each Z1c is selected from Formulae FF225 and FF227, at least one of the $B_1$ and the $B_2$ is Formula F7, wherein Formula F7 is:

(F7)

wherein:

one $R_1$ represents (C=O)—*, wherein —* represents the attachment point to the rest of Z1c;

each remaining $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)$ $NH(CH_2)_mCH_3$, and $OCF_3$, wherein m is 1, 2, 3, 4, 5, 6, or 7;

Y8 is 0 or NR, wherein R is a $C_1$-$C_6$alkyl group or H; and each Y10 is independently selected from H, $CH_3$, F, and $CF_3$, wherein for at least one F7 at least one Y10 is not H.

2. The compound of embodiment 1, or stereoisomer or a mixture of stereoisomers, or pharmaceutically acceptable salt thereof, wherein:

each n' is 0, 1, 2, or 3, wherein at least one n' is 1, 2, or 3;

each q' is 1, 2, 3, or 4;

each Z1b is independently a linker moiety, wherein each Z1c is covalently conjugated directly or via one or more of the Z1b to an amine of X1, with the proviso that the Z1b is not a diol containing moiety, and

2468 wherein one or more positions of the compound may comprise an isotope.

3. The compound of embodiment 1 or 2, or stereoisomer or a mixture of stereoisomers, or pharmaceutically acceptable salt thereof, wherein each Z1c is covalently conjugated via one or more of the Z1b to an amine of X1, wherein each Z1b is independently selected from Formulae FL3, FL5, FL5A, FL5B, FL65A, FL65B, FL69, FL69A, FL69B, FL70, FL70A, and FL70B;

wherein FL3, FL5, FL5A, FL5B, FL65A, FL65B, FL69, FL69A, FL69B, FL70, FL70A, and FL70B are:

FL3

FL5

FL5A

FL5B

FL65A

FL65B

FL69

2469

-continued

FL69A

5

FL69B 10

15

FL70

20

FL70A 25

30

FL70B

35

40 wherein:

R" represents a covalent bond, directly or indirectly, to Z1c;

Z" represents a covalent bond, directly or indirectly, to X1;

A' is selected from H and a $C_1$- to $C_{20}$ alkyl; and

A" is a $C_2$-$C_{20}$ acyl group optionally terminating in an acid group, wherein one or more carbon atoms of the $C_2$-$C_{20}$ acyl group are optionally and independently replaced by a group selected from C(=O), O, NH, $NH_2$, S, S(O), $SO_2$, phenyl, 5-membered heterocyclyl, 6-membered heterocyclyl, 5-membered heteroaryl, 6-membered heteroaryl, and wherein the $C_2$-$C_{20}$ acyl group, NH, $NH_2$, $SO_2$, phenyl, 5-membered heterocyclyl, 6-membered heterocyclyl, 5-membered heteroaryl, and 6-membered heteroaryl is each independently substituted with 0, 1, 2, 3, or 4 $R_x$, wherein $R_x$ is selected from $C_1$-$C_5$ alkyl, halogen, $C_1$-$C_5$ haloalkyl, carboxylic acid, hydroxyl, —O—$C_1$-$C_5$ alkyl, —S(=O)$_2$$NH_2$, $NH_2$, 5-membered heterocyclyl, 6-membered heterocyclyl, 5-membered heteroaryl, phenyl, and 6-membered heteroaryl;

p is 1, 2, 3, 4, or 5, q is 1, 2, 3, 4, or 5, and any primary amine is optionally acetylated or alkylated.

4. The compound of embodiment 3, wherein each Z1b is independently selected from:

2470

FL3

FL5B

FL65A

FL65B

FL69A wherein:

p is 1, 2, 3, 4, or 5.

5. The compound of embodiment 3 or 4, or pharmaceutically acceptable salt thereof, wherein each Z1b is independently selected from:

2471

-continued

6. The compound of any one of embodiments 3-5, or pharmaceutically acceptable salt thereof, wherein each A" is independently selected from:

AB-1

AB-2

AB-3

AB-4

AB-5

AB-6

2472

-continued

AB-7

AB-8

AB-9

AB-10

AB-11

AB-12

AB-13

AB-14

AB-15

AB-16

AB-17

2473

-continued

AB-18

AB-19

AB-20

AB-21

AB-22

AB-23

AB-24

AB-25

AB-26

AB-27

2474

-continued

AB-28

AB-30

AB-31

AB-31

AB-32

AB-33

AB-34

AB-35

5

10

15

20

25

30

35

40

45

50

55

60

65

| 2475 | 2476 |

-continued

-continued

AB-36

AB-37

AB-37A

AB-38

AB-39

7. The compound of any one of embodiments 1-5, or pharmaceutically acceptable salt thereof, wherein the $B_1$ and $B_2$ are independently selected from Formulae F2 and F7, wherein Formulae F2 and F7 are:

(F2)

(F7)

wherein:

one $R_1$ represents (C═O)—*, wherein —* represents the attachment point to the rest of Z1c;

each remaining $R_1$ is independently selected from H, F, Cl, Br, OH, $CH_2$—$NH_2$, $NH_2$, (C═O)—$NH_2$, CH═O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)$ $NH(CH_2)_mCH_3$, and $OCF_3$, wherein m is 1, 2, 3, 4, 5, 6, or 7;

Y8 is O, or Y8 is NR, wherein R is a $C_1$-$C_6$alkyl group or H; and each Y10 is independently selected from H, $CH_3$, F, and $CF_3$, wherein for at least one F7 at least one Y10 is not H.

8. The compound of embodiment 7, or pharmaceutically acceptable salt thereof, wherein the $R_1$ at position 5' represents (C═O)—*, wherein —* represents the attachment point to the rest of Z1c.

9. The compound of embodiment 7, or pharmaceutically acceptable salt thereof, wherein the $B_1$ and the $B_2$ are independently represented by Formula F2, wherein Formula F2 is:

(F2)

wherein:

$R_1$ at position 5' represents (C═O)—*, wherein —* represents the attachment point to the rest of Z1c; and each remaining $R_1$ is independently selected from H, F, Cl, Br, OH, $CF_3$, $CHF_2$, $NO_2$, $CH_3$, $OCH_3$, and $OCF_3$.

10. The compound of embodiment 7, or pharmaceutically acceptable salt thereof, wherein the $B_1$ and $B_2$ are independently Formula F7, (F7)

wherein:

$R_1$ at position 5' represents (C=O)—*, wherein —* represents the attachment point to the rest of Z1c;

each remaining $R_1$ is independently selected from H, F, Cl, Br, OH, $CF_3$, $CHF_2$, $NO_2$, $CH_3$, $OCH_3$, and $OCF_3$;

Y8 is O or NR, wherein R is a $C_1$-$C_6$alkyl group or H; and each Y10 is independently selected from H, $CH_3$, F, and $CF_3$, wherein for at least one F7 at least one Y10 is not H.

11. The compound of embodiment 7 or 10, or pharmaceutically acceptable salt thereof, wherein the $B_1$ and $B_2$ are independently Formula F7A, (F7A)

wherein:

$R_1$ at position 5' represents (C=O)—*, wherein —* represents the attachment point to the rest of Z1c; and each remaining $R_1$ is independently selected from H, F, Cl, Br, OH, $CF_3$, $CHF_2$, $NO_2$, $CH_3$, $OCH_3$, and $OCF_3$.

12. The compound of any one of embodiments 1-8, or pharmaceutically acceptable salt thereof, wherein at least one $B_1$ or $B_2$ is F7, and wherein Y8 is O and each Y10 is $CH_3$.

13. The compound of any one of embodiments 7-11, or pharmaceutically acceptable salt thereof, wherein each remaining $R_1$ is independently selected from H, $CF_3$, and F, optionally two remaining $R_1$ are H and one remaining $R_1$ is $CF_3$ or F.

14. The compound of any one of embodiments 7-11, or pharmaceutically acceptable salt thereof, wherein at least one $R_1$ in the $B_1$ or the $B_2$ is F or $CF_3$.

15. The compound of any one of embodiments 7-11, or pharmaceutically acceptable salt thereof, wherein each remaining $R_1$ is H.

16. The compound of embodiment 3 having the following formula, or a stereoisomer or a mixture of stereoisomers, or pharmaceutically acceptable salt thereof:

$$[Z1c\text{---}Z1b1\text{---}Z1b2]_{q'}\text{---}X1,$$

wherein:

q' is 2, 3, or 4;

each corresponding Z1c and Z1b1 is independently selected and may be the same or different;

each Z1b1 is a bond or is selected from FL70, FL70A, and FL70B, wherein FL70, FL70A, and FL70B are:

FL70

FL70A

FL70B and wherein R", Z", A', A", p and q are as defined in embodiment 3;

each Z1b2 is FL3, wherein FL3 is

FL3 and wherein R", Z", and p are as defined in embodiment 3;

each Z1c is covalently conjugated to Z1b1 via an amine in beta or gamma position of a backbone of the Z1b1, and wherein at least one Z1c is covalently conjugated to at least one Z1b1 selected from FL70, FL70A, and FL70B.

17. The compound of embodiment 3 having the following formula, or a stereoisomer or a mixture of stereoisomers, or pharmaceutically acceptable salt thereof:

$$[Z1c\text{---}Z1b1\text{---}Z1b2]_{q'}\text{---}X1$$

wherein:

q' is 2, 3, or 4;

each corresponding Z1c and Z1b1 is independently selected and may be the same or different;

each Z1b1 is a bond or is selected from FL70, FL70A, and FL70B wherein FL70, FL70A, and FL70B are:

FL70

FL70A

-continued

FL70B wherein R", Z", A', A", p and q are as defined in embodiment 3;

each Z1b2 is selected from FL5, FL5A, and FL5B, wherein FL5, FL5A, and FL5B are:

FL5

FL5A

FL5B wherein R", Z", and p are as defined in embodiment 3;

each Z1c is covalently conjugated to Z1b1 via an amine in an beta or gamma position of a backbone of the Z1b1, and wherein at least one Z1c is covalently conjugated to at least one Z1b1 selected from FL70, FL70A, and FL70B.

18. The compound of embodiment 16 or 17, or pharmaceutically acceptable salt thereof, wherein at least one Z1c is conjugated to an amine in the beta position of the backbone of the Z1b1 or Z1b2.

19. The compound of embodiment 3 having the following formula, or a stereoisomer or a mixture of stereoisomers, or pharmaceutically acceptable salt thereof:

$$[Z1c\!-\!Z1b1\!-\!Z1b2]_{q'}\!-\!X1$$

wherein:

q' is 2, 3, or 4;

each corresponding Z1c and Z1b1 is independently selected and may be the same or different;

each Z1b1 is a bond or is selected from FL69, FL69A, and FL69B, wherein FL69, FL69A, and FL69B are:

FL69

FL69A

FL69B and wherein R", Z", A', A", and p are as defined in embodiment 3;

each Z1b2 is FL3 or FL5B, wherein FL3 and FL5B are:

FL3 and

FL5B wherein R", Z", and p are as defined in embodiment 3;

each Z1c is covalently conjugated to Z1b1 via an amine in an alpha position of a backbone of the Z1b1, and wherein at least one Z1c is covalently conjugated to at least one Z1b1 selected from FL69, FL69A, and FL69B.

20. The compound of embodiment 3 having the following formula, or a stereoisomer or a mixture of stereoisomers, or pharmaceutically acceptable salt thereof:

$$[Z1c\!-\!Z1b1\!-\!Z1b2]_{q'}\!-\!X1$$

wherein:

q' is 2, 3, or 4;

each corresponding Z1c is independently selected and may be the same or different;

each Z1b1 is a bond;

each Z1b2 is FL3, wherein FL3 is

FL3 and wherein R″, Z″, and p are as defined in embodiment 3;

and each Z1c is covalently conjugated to Z1b2 via an amine in a beta position of a backbone of the Z1b2.

21. The compound of any one of embodiments 1-20, or pharmaceutically acceptable salt thereof, wherein X1 is a polypeptide and the polypeptide comprises an insulin receptor agonist having an A-chain and a B-chain.

22. The compound of embodiment 1, or pharmaceutically acceptable salt thereof, wherein each Z1c is selected from Formulae FFL-1 to FFL-68, wherein Formulae FFL-1 to FFL-68 are:

FFL-1

FFL-2

FFL-3

FFL-4

FFL-5

-continued

FFL-6

FFL-7

FFL-8

FFL-9

FFL-10

-continued

FFL-11

FFL-12

FFL-13

FFL-14

2487                                                        2488

FFL-15                                                      FFL-16

FFL-17                                                      FFL-18

FFL-19                                                      FFL-20

2489                                2490

-continued

FFL-21

FFL-22

FFL-23

FFL-24

FFL-25

FFL-26

FFL-27

FFL-28

2491 2492

FFL-29 FFL-30

FFL-31 FFL-32

FFL-33 FFL-34

2493　　　　　　　　　　　　　　　　　　　　　　2494

-continued

FFL-35

FFL-36

FFL-37

FFL-38

FFL-39

FFL-40

-continued

FFL-41

FFL-42

FFL-43

FFL-44

FFL-45

-continued

FFL-46

FFL-47

FFL-48

FFL-49

2499                             2500

-continued

FFL-50

FFL-51

FFL-52

FFL-53

FFL-54

FFL-55

FFL-56

FFL-57

2501                                                                                    2502

FFL-58

FFL-59

FFL-60

FFL-61

FFL-62

FFL-63

2503 2504

FFL-64

FFL-65

FFL-66

FFL-67

FFL-68 or stereoisomers thereof, wherein X represents a point of covalent attachment to the amine of X1.

23. The compound of embodiment 7, or pharmaceutically acceptable salt thereof, wherein the B₁ and the B₂ are each independently selected from Formulae F2 and F7; wherein each remaining $R_1$ is independently selected from H, $CF_3$, and F, wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67:

2505

2506

FFL-2

FFL-3

FFL-4

FFL-5

FFL-9

FFL-10

FFL-11

2507                                                              2508

-continued

FFL-12

FFL-16

FFL-20

FFL-21

FFL-27

2509                                                           2510

FFL-32                                                            FFL-34

FFL-35                                                            FFL-37

FFL-38                                                            FFL-39

FFL-40

2511                  2512

-continued

FFL-44

FFL-45

FFL-46

FFL-47

FFL-51             FFL-55

2513

2514

FFL-56

FFL-62

FFL-66

FFL-67 or stereoisomers thereof;

wherein X represents a point of covalent attachment to the amine of X1.

24. The compound of embodiment 7, or pharmaceutically acceptable salt thereof, wherein the $B_1$ and the $B_2$ are each independently Formula F2, wherein each remaining $R_1$ is independently selected from H, $CF_3$, and F; wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67:

FFL-2

FFL-3

2515 2516

-continued

FFL-4

FFL-5

FFL-9

FFL-10

FFL-11

FFL-12

-continued

FFL-16

FFL-20

FFL-21

FFL-27

FFL-32

FFL-34

-continued

FFL-35

FFL-37

FFL-38

FFL-39

FFL-40

FFL-44

FFL-45

2521                                                                          2522

FFL-46

FFL-47

FFL-51                                                    FFL-55

FFL-56

FFL-62

FFL-66 and

FFL-67 or stereoisomers thereof;

wherein X represents a point of covalent attachment to the amine of X1.

25. The compound of embodiment 11, or pharmaceutically acceptable salt thereof, wherein the $B_1$ and the $B_2$ are each independently Formula F7A, wherein each remaining $R_1$ is independently selected from H, $CF_3$, and F; wherein each Z1c is covalently conjugated via one or more of the Z1b to an amine of X1 and each of the Z1c and the one or more Z1b in combination is selected from Formulae FFL 2-5, 9-12, 16, 20, 21, 27, 32, 34, 35, 37-40, 44-47, 51, 55, 56, 62, 66, and 67:

FFL-2

FFL-3

2525                                                           2526

FFL-4

FFL-5

FFL-9

FFL-10

FFL-11

FFL-12

-continued

FFL-16

FFL-20

FFL-21

FFL-27

FFL-32

FFL-34

2529                                                                      2530

-continued

FFL-35

FFL-37

FFL-38

FFL-39

FFL-40

FFL-44

FFL-45

2531                                                                2532

FFL-46

FFL-47

FFL-51                                                            FFL-55

2533 2534

FFL-56

FFL-62

FFL-66

FFL-67 or stereoisomers thereof;

wherein X represents a point of covalent attachment to the amine of X1.

26. The compound of embodiment 1 or 2, or pharmaceutically acceptable salt thereof, wherein the compound has affinity to bind to one or more glycated proteins or glycosylated proteins and/or sugar moieties or saccharides or polysaccharides on surface of cells.

27. The compound of embodiment 1, or pharmaceutically acceptable salt thereof, wherein q' is at least 2, and wherein at least one of the Z1c is a sugar moiety, a diol containing moiety, and a polyol containing moiety.

28. The compound of embodiment 27, or pharmaceutically acceptable salt thereof, wherein the Z1c is selected from Formulae STR1, STR2, STR3, STR4, and STR5:

STR1

STR2

STR3

STR4

-continued

STR5 wherein:

one $R_1'''$ represents the attachment point to a Z1b;

each carbon atom attached to an $R_1'''$ independently has (R) or (S) stereochemistry;

each remaining $R_1'''$ is independently selected from —H, —OR$^3$, —N(R$^3$)$_2$, —SR$^3$, —OH, —OCH$_3$, —OR$^5$, NHC(O)CH$_3$, —CH$_2$R$_3$, —C(O)NHOH, —NHC(O) CH$_3$, —CH$_2$OH, —CH$_2$OR$^5$, —NH$_2$, —CH$_2$R$_4$, —R$^6$, and —R$^7$, wherein in STR1, STR2, and STR4 at least one of the remaining $R_1$ is OH, each R$^3$ is independently selected from —H, acetyl, phosphate, —R$_2$, —SO$_2$R$^2$, —S(O)R$^2$, —P(O)(OR$^2$)$_2$, —C(O)R$^2$, —CO$_2$R$^2$, and —C(O)N(R$^2$)$_2$, each R$^2$ is independently selected from —H, C$_{1-6}$ aliphatic ring, phenyl ring, 5-6 membered monocyclic heteroaryl ring having 1-4 heteroatoms selected from nitrogen, oxygen, and sulfur, a 4-7 membered heterocyclic ring having 1-2 heteroatoms selected from nitrogen, oxygen, and sulfur, and a C$_1$-C$_6$alkyl, each R$^4$ is independently selected from —H, —OH, —OR$^3$, —N(R$^3$)$_2$, —OR$^5$ and —SR$^3$;

each R$^5$ is independently selected from a mono-saccharide, a di-saccharide, a tri-saccharide, a pentose, and a hexose, each R$^6$ is independently selected from —NCOCH$_2$—, —(OCH$_2$CH$_2$)$_n$—, a —O—C$_{1-9}$ alkylene group, and a substituted C$_{1-9}$ alkylene group in which one or more methylene groups are optionally replaced by —O—, —(CH$_2$)$_n$—, —OCH$_2$—, —N(R$^2$)C(O)—, —N(R$^2$)C (O)N(R$^2$)—, —SO$_2$—, —SO$_2$N(R$^2$)—, —N(R$^2$) SO$_2$—, —S—, —N(R$^2$)—, —C(O)—, —OC(O)—, —C(O)O—, —C(O)N(R$^2$)—, or —N(R$^2$)SO$_2$N (R$^2$)—, wherein index n is 1, 2, 3, 4, 5, 6, 7, or 8, each R$^7$ is independently selected from —N(R$^2$)$_2$, —F, —Cl, —Br, —I, —SH, —OR$^2$, —SR$^2$, —NH$_2$, —N$_3$, —C≡CR$^2$, —CH$_2$C≡CH, —C≡CH, —CO$_2$R$^2$, —C(O) R$^2$, —OSO$_2$R$^2$—N(R$^2$)$_2$, —OR$^2$, —SR$^2$, and —CH$_3$, —CH$_2$NH$_2$, and structures STR1, STR2, STR3, STR4, and STR5 optionally include one or more acetyl, acetylene, acetonide, and/or pinacol protecting groups.

29. The compound of embodiment 1 or 2, or pharmaceutically acceptable salt thereof, wherein X1 comprises a polypeptide human hormone, an insulin receptor agonist, an endocrine hormone, insulin, human insulin, glucagon, amylin, relaxin, GLP-1, GIP, oxyntomodulin, somatostatin, gastric inhibitory polypeptide, glucose-dependent insulinotropic polypeptide, a hybrid peptide comprising sequences from two or more human polypeptide hormones, or an analogue of any thereof.

30. The compound of any one of embodiments 1-2 and 19-29, or pharmaceutically acceptable salt thereof, wherein:

X1 comprises an insulin having an A-chain and a B-chain, wherein optionally the A-chain comprises a sequence selected from SEQ ID NOs 1, 25, 24051, and 24052, and optionally the B-chain comprises a sequence selected from SEQ ID NOs 24060, 24061, 24062, 24063, 24064, and 25000-25397.

31. The compound of embodiment 30, or pharmaceutically acceptable salt thereof, wherein:

X1 comprises an insulin having an A-chain and a B-chain, wherein the A-chain comprises a sequence selected from SEQ ID NOs 1, 24051, and 24052, and wherein the B-chain comprises a sequence selected from SEQ ID NOs 24063, 25095, 25228, 25229, 25232, 25236, 25305, 25308, 25312, and 25380-25397;

each Z1b is independently selected from FL3, FL5, FLSA, FL5B, FL65A, FL65B, FL69A, and FL69B;

each Z1c is independently selected from FF12A, FF12B, FF12C, FF12D, FF116A, FF116B, FF116C, FF116D, and FF227, wherein each Z1c is covalently conjugated via one or more of the Z1b to a lysine residue in X1; and B$_1$ and B$_2$ are each independently Formula F2 or Formula F7.

32. The compound of embodiment 1 or 2, or pharmaceutically acceptable salt thereof, wherein:

each B$_1$ and B$_2$ is independently selected from F2 and F7 and is covalently conjugated to Z1c using an amide linkage, each Z1b is independently selected from (i) FL3, wherein p is 1, 2, or 3; (ii) FL5B, wherein p is 2, 3, or 4; (iii) FL65A; and (iv) FL69A, wherein p is 2, 3, or 4;

each Z1c is independently selected from FF12A, FF116A, and FF227, wherein each Z1c is covalently conjugated via one or more of the Z1b to a lysine residue in X1; and X1 is a polypeptide comprising an insulin receptor agonist having an A-chain and a B-chain, wherein the A-chain comprises a sequence selected from SEQ ID NOs 1, 24051, and 24052, and wherein the B-chain comprises a sequence selected from SEQ ID NOs 24063, 25095, 25228, 25229, 25232, 25236, 25305, 25308, 25312, and 25380-25397, and wherein at least two lysine in X1 are each independently conjugated to Z1b.

33. The compound of embodiment 1 or 2, or pharmaceutically acceptable salt thereof, wherein at least one Z1c is FF227 and i is 1.

34. The compound of embodiment 1 or 2, wherein the compound is selected from:

2537

2538

Example 1A

-continued

Example 2A

-continued

Example 3A

-continued

Example 4A 2545                                                      2546

Example 5A

-continued

H—G—I—V—E—Q—C—C—T—S—I—C—S—L—Y—Q—L—E—N—Y—C—N—OH

L—Y—L—V—C—G—K—R—G—F—F—Y—T—P—R—OH

H—L—C—G—S—H—L—V—E—A

H—G—K—G—S—H—K—F—V—N—Q

-continued

Example 6A

H—G—I—V—E—Q—C—C—T—S—I—C—S—L—Y—Q—L—E—N—Y—C—N—OH

H—L—C—G—S—H—L—V—E—A——L—Y—L—V—C—G—K—R—G—F—F—Y—T—P—R—OH,

H—G—K—G—S—H—K—F—V—N—Q

Example 7A

-continued

H—G—I—V—E—Q—C—C—T—S—I—C—S—L—Y—Q—L—E—N—Y—C—N—OH

H—L—C—G—S—H—L—V—E—A—L—Y—L—V—C—G—K—R—G—F—F—Y—T—P—R—OH

H—G—K—G—S—H—K—F—V—N—Q

2551          2552

Example 8A

Example 9A

-continued

H—G—I—V—E—Q—C—C—T—S—I——C—S—L—Y—Q—L—E—N—Y—C—N—OH

H—L—C—G—S—H—L—V—E—A——M—L—V—C—G—K—R—G—F—F—Y—T—P—R—OH

Example 10A

-continued

H—G—I—V—E—Q—C—C—T—S—I—C—S—L—Y—Q—L—E—N—Y—C—N—OH

H—L—C—G—S—H—L—V—E—A—L—Y—L—V—C—G—K—R—G—F—F—Y—T—P—R—OH,

H—G—K—G—S—H—K—F—V—N—Q (S)

(R)

(R)

(S)

-continued

Example 11A

Example 12A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 13A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

-continued

Example 14A

Example 15A

-continued

Example 16A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH

Example 17A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH

-continued

Example 18A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH

Example 19A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH 2567                                                    2568

Example 20A

-continued

Example 21A

2571  2572

Example 22A

-continued

H—G—I—V—E—Q—C—C—T—S—I—C—S—L—Y—Q—L—E—N—Y—C—N—OH

H—L—C—G—S—H—L—V—E—A—L—Y—L—V—C—G—K—R—G—F—F—Y—T—P—R—OH,

H—G—K—S—H—K—F—V—N—Q

-continued

Example 23A

-continued

Example 24A

H—G—I—V—E—Q—C—C—T—S—I—C—S—L—Y—Q—L—E—N—Y—C—N—OH,

H—L—C—G—S—H—L—V—E—A—L—Y—L—V—C—G—K—R—G—F—F—Y—T—P—R—OH,

H—G—S—H—K—F—V—N—Q—

HOOC

COOH

2577

2578

-continued

Example 25A

-continued

Example 26A

Example 27A

-continued

2583  2584

-continued

Example 28A

H—G—I—V—E—Q—C—C—T—S—I—C—S—L—Y—Q—L—E—N—Y—C—N—OH,

H—G—S—H—K—F—V—N—Q—H—L—C—G—S—H—L—V—E—A—L—Y—L—V—C—G—K—G—F—F—Y—T—P—R—OH,

-continued

Example 29A

2587

2588

Example 30A

-continued

Example 31A

Example 32A

H-G-I-V-E-Q-C-C-T-S-I-C-S-L-Y-Q-L-E-N-Y-C-N-OH
H-G-K-G-S-H-K-P-V-N-Q-H-L-C-G-S-H-L-V-E-A-L-Y-L-V-C-G-K-R-G-P-P-Y-T-P-R-OH,

Example 33A

H-G-I-V-E-Q-C-C-T-S-I-C-S-L-Y-Q-L-E-N-Y-C-N-OH
H-G-K-G-S-H-K-P-V-N-Q-H-L-C-G-S-H-L-V-E-A-L-Y-L-V-C-G-K-R-G-P-P-Y-T-P-R-OH,

-continued

Example 34A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

Example 35A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

-continued

Example 36A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

Example 37A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

-continued

Example 38A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

Example 39A

H-G-I-V-E-Q-C-C-T-S-I-C-S-L-Y-Q-L-E-N-Y-C-N-OH

H-G-K-G-S-H-K-P-V-N-Q-H-L-C-G-S-H-L-V-E-A-L-Y-L-V-C-G-K-R-G-P-P-Y-T-P-R-OH,

Example 40A

H—G-I-V-E-Q-C-C-T-S-I—C-S-L-Y-Q-L-E-N-Y-C—N—OH

H-G-K-S-H-K-F-V-N-Q—H-L-C-G-S-H-L-V-E-A———L-Y-L-V-C-G-K-R-G-F—F-Y-T-P-R—OH,

Example 41A

H—G-I-V-E-Q-C-C-T-S-I—C-S-L-Y-Q-L-E-N-Y-C—N—OH

H-G-K-S-H-K-F-V-N-Q—H-L-C-G-S-H-L-V-E-A———L-Y-L-V-C-G-K-R-G-F—F-Y-T-P-R—OH,

2601

2602

-continued

Example 42A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A————L-Y-L-V-C-G-K-R-G-F—F-Y-T-P-R—OH,

2603  2604

-continued

Example 43A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A————L-Y-L-V-C-G-K-R-G-F—F-Y-T-P-R—OH,

Example 44A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A————L-Y-L-V-C-G-K-R-G-F—F-Y-T-P-R—OH,

2605

2606

-continued

Example 45A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A———L-Y-L-V-C-G-K-R-G-F—F-Y-T-P-R—OH,

-continued

Example 46A

H—G-I-V-E-Q-C-C-T-S-I—C-S-L-Y-Q-L-E-N-Y-C—N—OH

H-G-K-S-H-K-F-V-N-Q—H-L-C-G-S-H-L-V-E-A————L-Y-L-V-C-G-K-R-G-F—F-Y-T-P-R—OH,

Example 47A

H—G-I-V-E-Q-C-C-T-S-I—C-S-L-Y-Q-L-E-N-Y-C—N—OH

H-G-K-S-H-K-F-V-N-Q—H-L-C-G-S-H-L-V-E-A————L-Y-L-V-C-G-K-R-G-F—F-Y-T-P-R—OH,

2609                                                    2610

-continued

Example 48A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A——L-Y-L-V-C-G-K-R-G-F—F-Y-T-P-R—OH,

-continued

Example 49A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A————L-Y-L-V-C-G-K-R-G-F—F-Y-T-P-R—OH,

Example 50A

H—G-I-V-E-Q-C-C-T-S-I—C-S-L-Y-Q-L-E-N-Y-C—N—OH

H-G-K-S-H-K-F-V-N-Q—H-L-C-G-S-H-L-V-E-A————L-Y-L-V-C-G-K-R-G-F—F-Y-T-P-R—OH,

2613                                                      2614

-continued

Example 51A

H—G-I-V-E-Q-C-C-T-S-I—C-S-L-Y-Q-L-E-N-Y-C—N—OH

H—G-K-S-H-K-F-V-N-Q—H-L-C-G-S-H-L-V-E-A————L-Y-L-V-C-G-K-R-G-F—F-Y-T-P-R—OH,

Example 52A

H-G-I-V-E-Q-C-C-T-S-I—C-S-L-Y-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 53A

H-G-I-V-E-Q-C-C-T-S-I—C-S-L-Y-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH,

2617  2618

-continued

Example 54A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH, 2619                                                                              2620

Example 55A

H-G-I-V-E-Q-C-C-T-S-I—C-S-L-Y-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

Example 56A

H-G-I-V-E-Q-C-C-T-S-I——C-S-L-Y-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

2621                                    2622

Example 57A

H-G-I-V-E-Q-C-C-T-S-I-C-S-L-Y-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 58A

H-G-I-V-E-Q-C-C-T-S-I—C-S-L-Y-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 59A

H-G-I-V-E-Q-C-C-T-S-I—C-S-L-Y-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH,

2625                                                                    2626

-continued

Example 60A:

-continued

-continued

Example 61A:

-continued 2633                                                                                2634

-continued

Example 62A:

H—G—I—V—E—Q—C—C—T—S—I—C—

H—G—K—G—S—H—K—F—V—N—Q—H—L—C—G—S—H—L—V—E—

-continued

-continued

Example 63A:

H—G—I—V—E—Q—C—C—T—S—I—C—

H—G—K—G—S—H—K—F—V—N—Q—H—L—C—G—S—H—L—V—E—

-continued

-continued

Example 64A:

-continued

-continued

Example 65A:

H—G—I—V—E—Q—C—C—T—S—I—C—

H—G—K—G—S—H—K—F—V—N—Q—H—L—C—G—S—H—L—V—E—

-continued

—S—L—Y—Q—L—E—N—Y—C—N—OH

—A————L—Y—L—V—C—G—K—R—G—F———F—Y—T—P—R—OH,

Example 66A:

-continued

Example 67A:

-continued

Example 68A:

H—G—I—V—E—Q—C—C—T—S—I—C—

H—G—K—G—S—H—K—F—V—N—Q—H—L—C—G—S—H—L—V—E—

-continued 2657 2658

-continued

Example 69A:

H—G—I—V—E—Q—C—C—T—S—I—C—

H—G—K—G—S—H—K—F—V—N—Q—H—L—C—G—S—H—L—V—E—

-continued

-continued

Example 70A:

H—G—I—V—E—Q—C—C—T—S—I—C—

H—G—K—G—S—H—K—F—V—N—Q—H—L—C—G—S—H—L—V—E—

-continued

-continued

Example 71A:

H—G—I—V—E—Q—C—C—T—S—I—C—

H—G—K—G—S—H—K—F—V—N—Q—H—L—C—G—S—H—L—V—E—

-continued

S—L—Y—Q—L—E—N—Y—C—N—OH

A——L—Y—L—V—C—G—K—R—G—F——F—Y—T—P—R—OH,

Example 72A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

-continued

Example 73A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

Example 74A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH

Example 75A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

Example 76A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

-continued

Example 77A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

Example 78A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

-continued

Example 79A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-K-T-OH,

Example 80A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

2677

2678

Example 81A

2679

2680

-continued

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

Example 82A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

2681

2682

-continued

Example 83A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

,

-continued

Example 84A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH,

-continued

Example 85A

H—G-I-V-E-Q-C-C-T-S-I-C-S-L-Y-Q-L-E-N-Y-C-N—OH

H—G-K-G-S-H-K-F-V-N-Q-H-L-C-G-S-H-L-V-E-A-L-Y-L-V-C-G-K-R-G-F-F-Y-T-P-R—OH or a pharmaceutically acceptable salt thereof, an isotope thereof, and combinations thereof.

35. A compound selected from the group consisting of a polypeptide comprising an A-chain and a B-chain, wherein the A-chain comprises a sequence selected from 1, 24051, and 24052; and wherein the B-chain comprises a sequence selected from SEQ ID NOs 24063, 25228, 25229, 25232, 25305, 25308, 25312, 25236, 25095, and 25380-25397.

36. A pharmaceutical composition comprising at least one compound or a pharmaceutically acceptable salt thereof according to any one of embodiments 1-35 and a pharmaceutically acceptable carrier.

37. The compound of any one of embodiments 1-35, or a pharmaceutically acceptable salt thereof, wherein X1 is an insulin further comprising from 1 to 5 residues replaced, inserted, appended, or mutated to an amino acid that has a free amine conjugated via one or more of the Z1b to a Z1c.

38. The compound of any one of embodiments 1-35, or a pharmaceutically acceptable salt thereof, wherein at least one Z1c is conjugated via one or more of the Z1b to a free amine side chain of an amino acid in X1 that has been replaced, inserted, or mutated on an insulin.

39. A compound of the following formula, or a stereoisomer or a mixture of stereoisomers, or pharmaceutically acceptable salt thereof

2687                                 2688

Z1c-Linker wherein the Z1c-Linker is selected from:

FFL-1

FFL-2

FFL-3

FFL-4

FFL-5

-continued

FFL-6

FFL-7

FFL-8　　　　　　　　　　　　　　　　　　FFL-9

FFL-10　　　　　　　　　　　　　　　　　　FFL-11

-continued

FFL-12

FFL-13

FFL-14

2693                                                                                                  2694

FFL-15                                                                                              FFL-16

FFL-17                                                                                              FFL-18

FFL-19                                                                                              FFL-20

2695            2696

FFL-21

FFL-22

FFL-23

FFL-24

FFL-25

FFL-26

2697 2698

FFL-27

FFL-28

FFL-29

FFL-30

FFL-31

FFL-32

2699                                                    2700

FFL-33                                                 FFL-34

FFL-35                                                 FFL-36

FFL-37                                                 FFL-38

-continued

FFL-39

FFL-40

FFL-41

FFL-42

2703

2704

FFL-43

FFL-44

FFL-45

FFL-46

FFL-47

FFL-48

-continued

FFL-49

FFL-50

FFL-51

FFL-52

FFL-53

2707

2708

FFL-54

FFL-55

FFL-56

FFL-57

FFL-58

FFL-59

-continued

FFL-60

FFL-61

FFL-62

FFL-63

FFL-64

FFL-65

-continued

FFL-66

FFL-67

FFL-68 wherein X is selected from a leaving group, $NH_2$, and H; and

B$_1$ and B$_2$, which may be identical or different, each independently represents an aromatic boron-containing group.

40. The compound of embodiment 39, or a pharmaceutically acceptable salt thereof, comprising at least one B$_1$ or B$_2$ independently selected from Formulae F2 and F7, wherein Formulae F2 and F7 are:

(F2)

-continued (F7)

wherein:

R$_1$ at position 5' represents (C=O)—*, wherein —* represents the attachment point to the rest of Z1c;

each remaining R$_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7;

Y8 is O, or Y8 is NR, wherein R is a $C_1$-$C_6$alkyl group or H; and each Y10 is independently selected from H, $CH_3$, F, and $CF_3$, wherein for at least one F7 at least one Y10 is not H.

41. The compound of embodiment 39, wherein the Z1c-Linker is selected from:

2713

2714

DSL-1

DSL-2

DSL-3

DSL-4

-continued

DSL-5

DSL-6

2717                                                                                            2718

DSL-7

DSL-8                                                           DSL-9

2719                                                                                              2720

DSL-10                                                                                                DSL-11

DSL-12

-continued

DSL-13

DSL-14

2723

2724

-continued

DSL-15

DSL-16

DSL-17

DSL-18

2725

2726

DSL-19

DSL-20

2727                                                                    2728

DSL-21

DSL--22                                                                    DSL-23

2729

2730

DSL-24

DSL-25

DSL-26

-continued

DSL-27

DSL-28

2733 2734

DSL29 DSL-30

DSL-31 DSL-32

2735                                                                 2736

-continued

DSL-33                                                           DSL-34

DSL-35                                                           DSL-36

2737                                              2738

-continued

DSL-37                                          DSL-38

DSL-39                                          DSL-40

2739

2740

DSL-41

DSL-42

DSL-43

DSL-44

2741                                                                    2742

DSL-45

DSL-46

DSL-47

2743                                 2744

-continued

DSL-48

DSL-49

DSL-50

DSL-51

2745 2746

-continued

DSL-52

DSL-53

DSL-54

DSL-55

2747 2748

DSL56 DSL-57

DSL-58 DSL-59

2749      2750

-continued

DSL-60      DSL-61

DSL-62      DSL-63

2751

2752

DSL-64

DSL-65

DSL-66

DSL-67

2753           2754

DSL-68        DSL-69

DSL-70        DSL-71

2755                                    2756

DSL-72                                                      DSL-73

DSL-74

-continued

DSL-75

DSL-76

2759            2760

-continued

DSL-77

DSL-78

DSL-79

2761                                                              2762

-continued

DSL-80

DSL-81

-continued

DSL-82

DSL-83

2765 2766

DSL-84

DSL-85

DSL-86

2767

2768

DSL-87

DSL-88

DSL-89

-continued

DSL-90

DSL-91

2771

2772

DSL-92

DSL-93

DSL-94

-continued

DSL-95

DSL-96

-continued

DSL-97

DSL-98

2777                                                                      2778

DSL-99                                                                          DSL-100

DSL-101                                                                         DSL102

2779                                                                                2780

DSL-103                                                                             DSL-104

DSL-105                                                                             DSL-106

2781

2782

-continued

DSL-107

DSL-108

DSL-109

DSL-110

DSL-111

DSL-112

2783            2784

-continued

DSL-113            DSL-114

DSL-115            DSL-116

2785 2786

DSL-117

DSL-118

DSL-119

DSL-120

2787                                                                  2788

DSL-121                                                              DSL-122

DSL-123                                                              DSL-124

2789　　　　　　　　　　　　　　　　　　　　2790

DSL-125　　　　　　　　　　　　　　　　　　DSL-126

DSL-127　　　　　　　　　　　　　　　　　　DSL-128

2791 2792

DSL-129

DSL-130

DSL-131

DSL-132

2793                                                                                    2794

DSL-133

DSL-134

DSL-135

DSL-136

2795                                                              2796

DSL-137                                                          DSL-138

DSL-139                                                          DSL-140

DSL-141                                                          DSL-142

2797                                                                 2798

DSL-143                                                               DSL-144

DSL-145                                                               DSL-146

DSL-147                                                               DSL-148

2799

2800

DSL-149

DSL-150

DSL-151

DSL-152

2801

2802

-continued

DSL-153

DSL-154

DSL-155

DSL-156

DSL-157

DSL-158

2803                                                                 2804

DSL-159                                                                 DSL-160

DSL-161                                                                 DSL-162

2805

2806

-continued

DSL-163

DSL-164

DSL-165

DSL-166

-continued

DSL-167

DSL-168

DSL-169

DSL-170

DSL-171

DSL-172

-continued

DSL-173

DSL-174

O, and

-continued

DSL-175 or a stereoisomer or a mixture of stereoisomers, a pharmaceutically acceptable salt thereof, and combinations thereof; wherein X is a leaving group.

42. The compound of embodiment 41, or a pharmaceutically acceptable salt thereof, wherein X is selected from N-oxysuccinimide, 2,3,5,6-tetrafluorophenoxy (TFP), pentafluorophenoxy (Pfp), OH, halogen, maleimide alkyl amino, maleimide amido polyethylene glycol amino, and maleimide polyethylene glycol amino.

43. The compound of embodiment 42, wherein the compound is selected from:

DSL-1A

DSL-2A

2813                                                 2814

DSL-3A                                                    DSL-4A

DSL-5A

DSL-6A 2815            2816

-continued

DSL-7A

DSL-8A        DSL-9A

DSL-10A        DSL-11A

-continued

DSL-12A

DSL-13A 2819 2820

DSL-14A

DSL-15A

DSL-16A

2821

2822

DSL-17A

DSL-18A

DSL-19A

-continued

DSL-20A

DSL-21A 2825       2826

DSL-22A       DSL-23A

DSL-24A       DSL-25A

-continued

DSL-26A

DSL-27A

2829

2830

DSL-28A

DSL-29A

DSL-30A 2831                                                                                    2832

DSL-31A                                                                                    DSL-32A

DSL-33A                                                                                    DSL-34A

2833

2834

DSL-35A

DSL-36A

DSL-37A

DSL-38A

2835                                                              2836

DSL-39A                                                              DSL-40A

DSL-41A                                                              DSL-42A

2837                                             2838

-continued

DSL-43A                                          DSL-44A

DSL-45A                                          DSL-46A

-continued

DSL-47A

DSL-48A

DSL-49A

DSL-50A

2841

2842

DSL-51A

DSL-52A

DSL-53A

DSL-54A

2843

2844

-continued

DSL-55A

DSL-56A

DSL-57A

DSL-58A 2845                                            2846

-continued

DSL-59A

DSL-60A

DSL-61A

DSL-62A

2847

2848

DSL-63A

DSL-64A

DSL-65A

DSL-66A 2849 2850

DSL-67A

DSL-68A

DSL-69A

DSL-70A

2851                                                                                           2852

DSL-71A                                                                                           DSL-72A

DSL-73A                                                                                           DSL-74A

DSL-75A

-continued

DSL-76A

DSL-77A

2855 2856

DSL-78A

DSL-79A

DSL-80A 2857                                                                 2858

DSL-81A

DSL-82A

-continued

DSL-83A

DSL-84A

2861                                                                     2862

DSL-85A                                                                      DSL-86A

DSL-87A                                                                      DSL-88A

-continued

DSL-89A

DSL-90A

-continued

DSL-91A

DSL-92A

DSL-93A

-continued

DSL-94A

DSL-95A

-continued

DSL-96A

DSL-97A

2871                             2872

-continued

DSL-98A

DSL-99A

DSL-100A 2873 2874

DSL-101A

DSL-102A

DSL-103A

DSL-104A 2875 2876

DSL-105A DSL-106A

DSL-107A DSL-108A

2877
                 2878

-continued

DSL-109A
                 DSL-110A

DSL-111A
                 DSL-112A

2879

2880

DSL-113A

DSL-114A

DSL-115A

DSL-116A

2881

2882

DSL-117A

DSL-118A

DSL-119A

DSL-120A 2883 2884

-continued

DSL-121A

DSL-122A

DSL-123A

DSL-124A 2885                                                                 2886

DSL-125A                                                         DSL-126A

DSL-127A                                                         DSL-128A

-continued

DSL-129A

DSL-130A

DSL-131A

DSL-132A

DSL-133A

DSL-134A

2889            2890

-continued

DSL-135A

DSL-136A

DSL-137A

DSL-138A

2891

2892

DSL-139A

DSL-140A

DSL-141A

DSL-142A

DSL-143A

DSL-144A

2893                                                                        2894

DSL-145A

DSL-146A

DSL-147A

DSL-148A

DSL-149A

DSL-150A

2895

2896

-continued

DSL-151A

DSL-152A

DSL-153A

DSL-154A

DSL-155A

DSL-156A 2897 2898

DSL-157A

DSL-158A

DSL-159A

DSL-160A

DSL-161A

DSL-162A

2899

2900

DSL-163A

DSL-164A

DSL-165A

DSL-166A

2901

2902

DSL-167A

DSL-168A

DSL-169A

DSL-170A

DSL-171A

DSL-172A

-continued

DSL-173A

DSL-174A

-continued

DSL-175A

, or a stereoisomer or a mixture of stereoisomers, a pharmaceutically acceptable salt thereof, and combinations thereof.

44. A polypeptide comprising an A-chain and a B-chain, wherein the A-chain comprises a sequence selected from 1, 24051, and 24052; and wherein the B-chain comprises a sequence selected from 25000-25397.

45. The polypeptide of embodiment 44, wherein the A-chain comprises a sequence selected from 1, 24051, and 24052; and wherein the B-chain comprises a sequence selected from 24063, 25228, 25229, 25000, 25001, 25006-25009, 25076, 25077, 25082-25085, 25228, 25229, 25232, 25234-25237, 25304, 25305, 25308, and 25310-25313.

46. The polypeptide of embodiment 44, wherein the A-chain comprises a sequence selected from 1 and 24051; and wherein the B-chain comprises a sequence selected from 24063, 25228, 25229, 25011, 25012, 25017-25020, 25087, 25088, 25093-25096, 25229, 25239, 25232, 25240, 25245-25248, 25305, 25308, 25315, 25316, and 25321-25324.

47. The polypeptide of embodiment 44, wherein the A-chain comprises a sequence selected from 1 and 24051; and wherein the B-chain comprises a sequence selected from 24063, 25228, 25229, 25232, 25234-25237, 25304, 25305, 25308, and 25310-25313.

48. A compound having agonist potency for an insulin receptor comprising at least one aromatic boron-containing group having agonist potency for an insulin receptor, or a pharmaceutically acceptable salt thereof, the compound having a first EC50 potency for activating the insulin receptor at a first glucose concentration and a second EC50 potency for activating the insulin receptor at a second glucose concentration, wherein when the first glucose concentration is 5.6 mM and the second glucose concentration is 16.7 mM the compound has an insulin receptor agonist potency ratio of the first EC50 to the second EC50 of about 1.2 to about 20, about 1.5 to about 15, about 2 to about 14, about 2.5 to about 13, about 2.5 to about 12, about 2.5 to about 11, about 2.5 to about 10, about 2.5 to about 9, about 2.5 to about 8, about 2.5 to about 7, about 2.5 to about 6, about 2.5 to about 5, or about 2.5 to about 4.5.

49. A compound having agonist potency for glucose comprising at least one aromatic boron-containing group having binding affinity for glucose, or a pharmaceutically acceptable salt thereof, wherein when administered at a dose of 30 nmol/kg to a first group of rats with a first glucose infusion rate to provide a blood glucose concentration of 100 mg/dL and to a second group of rats with a second glucose infusion rate to provide a blood glucose concentration of 200 mg/dL the compound provides a relative glucose infusion rate difference (mg/kg/min·min) of about 1 to about 2500, about 1 to about 2000, about 1 to about 1500, about 100 to about 1500, and about 1000 to about 1500, and a relative glucose infusion rate ratio of about 0.1 to about 5, about 0.2 to about 4.5, about 0.5 to about 4, about 0.5 to about 3.5, about 1 to about 3.5, about 1.5 to about 3.5, or about 2 to about 3.

50. The compound of embodiment 48 or 49, or pharmaceutically acceptable salt thereof, wherein the at least one aromatic boron-containing group is attached to an FF scaffold, wherein the FF scaffold is selected from Formulae FF12A, FF12B, FF12C, FF12D, FF116A, FF116B, FF116C, FF116D, FF225, and FF227.

51. The compound of embodiment 48 or 49, or pharmaceutically acceptable salt thereof, wherein the at least one aromatic boron-containing group comprises at least one $B_1$ and $B_2$, which may be identical or different.

52. The compound of embodiment 51, or pharmaceutically acceptable salt thereof, wherein at least one of the $B_1$ and the $B_2$ is Formula F2 or Formula F7.

53. The compound of embodiment 1, or pharmaceutically acceptable salt thereof, wherein the compound comprises a diboronate covalently conjugated to an amine in X1, and a diol or polyol containing moiety conjugated to an amine in X1.

54. The compound of embodiment 53, or pharmaceutically acceptable salt thereof, wherein the X1 is an insulin or analog thereof comprising an A-chain and a B-chain.

55. The compound of embodiment 54, or pharmaceutically acceptable salt thereof, wherein the amine to which the diboronate is covalently conjugated is at or near the C-terminus of the B-chain, preferably to an amine of a B29 lysine or a B21 lysine, and the amine to which the polyol is conjugated is at or near the N-terminus of the A-chain or B chain.

56. The compound of embodiment 54, or pharmaceutically acceptable salt thereof, wherein the amine to which the polyol is covalently conjugated is at or near the C-terminus of the B-chain, preferably to an amine of a B29 lysine or a B21 lysine, and the amine to which the diboronate is conjugated is at or near the N-terminus of the A-chain or B chain.

57. A compound according to any one of embodiments 1-35 and 48-56, or pharmaceutically acceptable salt thereof, for use as a medicament.

58. A method of treatment or prevention of diabetes, impaired glucose tolerance, hyperglycemia or metabolic syndrome, wherein the method comprises administering to a subject in need thereof the compound of any one of embodiments 1-35, 37-43, and 48-56, or a pharmaceutical composition according to embodiment 36.

59. A compound according to any one of embodiments 1-35, 37-43, and 48-56, or the pharmaceutical composition according to embodiment 36, for use in the treatment or prevention of diabetes, impaired glucose tolerance, hyperglycemia or metabolic syndrome.

60. Use of the compound according to any one of embodiments 1-35, 37-43, and 48-56, or the pharmaceutical composition according to embodiment 36, in the manufacture of a medicament.

61. A compound according to any one of embodiments 1-35, 37-43, and 48-56, or the pharmaceutical composition according to embodiment 36, for use as a therapeutic agent for the treatment of diabetes or obesity, for control of blood sugar levels, or for control of release of a drug.

62. A method of administering the compound of any one of embodiments 1-35, 37-43, and 48-56, or a pharmaceutical composition according to embodiment 36 to a subject, wherein the method comprises administering to the subject the compound as a therapeutic or prophylactic agent.

63. A method of treating a subject by administering a device or formulation comprising a compound of any one of embodiments 1-35, 37-43, and 48-56.

64. Use of the compound according to any one of embodiments 1-35, 37-43, and 48-56 as an intermediate in the synthesis of a drug substance or a therapeutic of a prophylactic compound.

65. A device or formulation comprising the compound of any one of embodiments 1-35, 37-43, and 48-56, or a pharmaceutical composition according to embodiment 36.

66. A compound comprising at least one diboronate, wherein the diboronate comprises at least two aromatic boron-containing groups, wherein at least one aromatic boron-containing group is covalently attached to the compound and selected from F3-F11, and the other aromatic boron-containing group is covalently attached to the compound and optionally selected from F1-F11 or a boronic acid, (F1)

-continued (F2)

(F3)

(F4)

(F5)

(F6)

(F7)

(F8)

-continued (F9)

(F10)

(F11)

wherein at least one R1 in each of F1-F11 is covalently attached to the compound, and each remaining $R_1$ and $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH(CH_2)_mCH_3$, and $OCF_3$, wherein m is 1, 2, 3, 4, 5, 6, or 7, wherein, for Formulae F3-F4:

$R_w$ is O or S;

for Formula F6:

when Y8 is O, i is 1, 2, 3, 4, or 5; or i is 2, 3, 4, or 5; and none, one, or two $R_1$ represents F, Cl, $CF_2$, $CF_3$, $SF_5$, $OCF_3$, $SO_2CH_3$ and/or $SO_2CF_3$; or when Y8 is NR, R is an alkyl group or H, and i is 1, 2, 3, 4, or 5;

for Formulae F5 and F7-F10:

when Y8 is O, i is 1, 2, 3, 4, or 5; or when Y8 is NR, R is an alkyl group or H, and i is 1, 2, 3, 4, or 5;

Y9 is $CH_3$, F, $CF_3$, $CHF_2$, or $OCH_3$; and each Y10 is independently selected from H, $CH_3$, F, $CF_3$, $CHF_2$, and $OCH_3$, with the proviso that at least one Y10 is not H.

67. The compound of embodiment 66, wherein the compound is a diboron containing compound.

68. The compound of embodiment 66, wherein the compound is a diboron containing compound.

69. The compound of embodiment 66, wherein the at least one aromatic boron-containing group is F7.

70. The compound of embodiment 66, wherein the at least one aromatic boron-containing group is F7, and wherein Y8 is O and each Y10 is $CH_3$.

71. The compound of any one of embodiments 66-70 comprising X1 and one or more Z1c, or a tautomer, stereoisomer or a mixture of stereoisomers, or a pharmaceutically acceptable salt, or hydrate, or isotopic derivative thereof, wherein:

X1 comprises:

i. $NH_2$ or OH;

ii. a drug substance comprising an amine;

iii. a drug substance that is covalently conjugated to an amine containing linker; or iv. an amine configured to be covalently conjugated to a drug substance;

wherein each Z1c is covalently conjugated, directly or indirectly, to an amine in X1 or to OH when X1 is OH, and wherein each Z1c is independently selected from:

a) Formulae FF1-FF48, wherein Formulae FF1-FF48 are:

(FF1)

(FF2)

(FF3)

(FF4)

(FF5)

(FF6)

-continued (FF7)

(FF8)

(FF9)

(FF10)

(FF11)

(FF12)

(FF13)

-continued (FF14)

(FF15)

(FF16)

(FF17)

(FF18)

(FF19)

(FF20)

5

10

15

20

25

30

35

40

45

50

55

60

65

-continued (FF21)

(FF22)

(FF23)

(FF24)

(FF25)

(FF26)

(FF27)

-continued (FF28)

(FF29)

(FF30)

(FF31)

(FF32)

(FF33)

(FF34)

(FF35)

2915

-continued (FF36)

(FF37)

(FF38)

(FF39)

(FF40)

(FF41)

(FF42)

(FF43)

(FF44)

2916

-continued (FF45)

(FF46)

(FF47) and (FF48)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7; and $B_1$ and $B_2$, which may be identical or different, each independently represents the aromatic boron-containing groups;

b) Formulae FF49-FF88, wherein Formulae FF49-FF88 are:

(FF49)

(FF50)

(FF51)

-continued

-continued (FF52)

(FF53)

(FF54)

(FF55)

(FF56)

(FF57)

(FF58)

(FF59)

(FF60)

(FF61)

(FF62)

(FF63)

(FF64)

(FF65)

(FF66)

(FF67)

(FF68)

5

10

15

20

25

30

35

40

45

50

55

60

65

2919

-continued (FF69)

5

10

(FF70)

15

20

(FF71)

25

30

(FF72)

35

(FF73)

40

45

(FF74)

50

55

(FF75) 60

65

2920

-continued (FF76)

(FF77)

(FF78)

(FF79)

(FF80)

(FF81)

-continued (FF82)

(FF83)

(FF84)

(FF85)

(FF86)

(FF87)

and

-continued (FF88)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

R1a is selected from COOH, $CH_3$, H, and OH;

R2, R3, R4 and R5 are each independently selected from $CH_3$, H, OH, and COOH, and at least one of R2, R3, R4 and R5 is $CH_3$ or OH; and $B_1$ and $B_2$, which may be identical or different, are each independently the aromatic boron-containing groups;

c) Formulae FF89-FF112, wherein Formulae FF89-FF112 are:

(FF89)

(FF90)

2923

-continued (FF91)

(FF92)

(FF93)

(FF94)

(FF95)

(FF96)

2924

-continued (FF97)

(FF98)

(FF99)

(FF100)

(FF101)

(FF102)

5

10

15

20

25

30

35

40

45

50

55

60

65

2925

-continued (FF103)

2926

-continued (FF108)

(FF104)

(FF109)

(FF105)

(FF110)

(FF111)

(FF106)

and (FF112)

(FF107)

wherein X represents a point of covalent attachment either directly to an amine in X1 or to an amine that is covalently conjugated directly or indirectly to X1, or to OH when X1 is OH;

i is 1, 2, 3, 4, 5, 6, or 7; and $B_1$, $B_2$ and $B_3$, which may be identical or different, are each independently the aromatic boron-containing

2927 groups, a carboxylic acid derivative, or a H, wherein in each FF89-FF112 structure containing B1, B2 and B3 groups, at least two of the B1, B2 and B3 groups are independently the aromatic boron-containing groups;

d) Formulae FF113-FF136, wherein Formulae FF113-FF136 are:

(FF113)

(FF114)

(FF115)

(FF116)

(FF117)

(FF118)

2928

-continued (FF119)

(FF120)

(FF121)

(FF122)

(FF123)

(FF124)

(FF125)

(FF126)

(FF127)

(FF128)

(FF129)

(FF130)

(FF131)

(FF132)

(FF133)

(FF134)

(FF135)

and (FF136)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl, or aryl groups; and $B_1$ and $B_2$, which may be identical or different, each independently represents the aromatic boron-containing groups;

e) Formulae FF137-FF160, wherein Formulae FF137-FF160 are:

2931

2932

(FF137)

(FF144)

(FF138)

(FF145)

(FF139)

(FF146)

(FF140)

(FF147)

(FF141)

(FF148)

(FF142)

(FF149)

(FF143)

(FF150)

2933

-continued (FF151)

(FF152)

(FF153)

(FF154)

(FF155)

(FF156)

2934

-continued (FF157)

(FF158)

(FF159)

and (FF160)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl, or aryl groups; and $B_1$ and $B_2$, which may be identical or different, each independently represents the aromatic boron-containing groups;

f) Formulae FF161-FF164, wherein Formulae FF161-FF164 are:

(FF161)

2935

-continued (FF162)

(FF163)

(FF164)

wherein X represents a point of covalent attachment either directly to an amine in X1 or to an amine that is covalently conjugated directly or indirectly to X1, or to OH when X1 is OH;

i is 1, 2, 3, 4, or 5;

j is 1, 2, 3, 4, or 5;

each R6, R7, R8, and R9 for different values of j is independently selected from H, CF₃, CH₃, CHF₂, and (CH₂)ₘCH₃, wherein m is 1, 2, 3, 4, or 5;

Y3, Y4, Y5, Y6 and Y7 are each independently selected from H, CH₂—X4, and Formulae IV-1 to IV-135;

wherein X4 is selected from —COOH, —(CH₂)ₘCOOH, an alkyl group, an acyl group, a cycloalkyl group, a haloalkyl group, an aryl group, and a heteroaryl group, each X4 optionally comprises one or more alkyl-halide, halide, sulfhydryl, aldehyde, amine, acid, hydroxyl, alkyl or aryl groups; wherein m is 1, 2, 3, 4, or 5;

wherein at least one of Y5, Y6 and Y7 in Formulae FF162 and FF163 is not H and at least one of Y7, R8 and R9 in FF164 is not H; and wherein Formulae IV-1 to IV-135 are:

(IV-1)

(IV-2)

2936

-continued (IV-3)

(IV-4)

(IV-5)

(IV-6)

(IV-7)

(IV-8)

(IV-9)

(IV-10)

(IV-11)

(IV-12)

(IV-13)

2937

-continued (IV-14)

(IV-15)

(IV-16)

(IV-17)

(IV-18)

(IV-19)

(IV-20)

(IV-21)

(IV-22)

(IV-23)

(IV-24)

2938

-continued (IV-25)

(IV-26)

(IV-27)

(IV-28)

(IV-29)

(IV-30)

(IV-31)

(IV-32)

(IV-33)

(IV-34)

(IV-35)

(IV-36)

(IV-37)

2939

-continued (IV-38)

(IV-39)

(IV-40)

(IV-41)

(IV-42)

(IV-43)

(IV-44)

(IV-45)

(IV-46)

(IV-47)

(IV-48)

2940

-continued (IV-49)

(IV-50)

(IV-51)

(IV-52)

(IV-53)

(IV-54)

(IV-55)

(IV-56)

5

10

15

20

25

30

35

40

45

50

55

60

65

2941

-continued (IV-57)

5

10

(IV-58)

15

20

(IV-59)

25

30

(IV-60)

35

40

(IV-61)

45

50

(IV-62)

55

60 (IV-63)

65

2942

-continued (IV-64)

(IV-65)

(IV-66)

(IV-67)

(IV-68)

(IV-69)

2943

-continued (IV-70)

5

10

(IV-71)

15

20

(IV-72)

25

30

(IV-73)

35

(IV-74)

40

(IV-75)

45

50

55

(IV-76)

60

65

2944

-continued (IV-77)

(IV-78)

(IV-79)

(IV-80)

(IV-81)

(IV-82)

(IV-83)

(IV-84)

(IV-85)

2945

-continued (IV-86)

5

(IV-87)

10

(IV-88)

15

20

(IV-89)

25

(IV-90)

30

35

(IV-91)

40

(IV-92)

45

(IV-93)

50

55

(IV-94)

60

65

2946

-continued (IV-95)

(IV-96)

(IV-97)

(IV-98)

(IV-99)

(IV-100)

(IV-101)

(IV-102)

(IV-103)

2947

-continued (IV-104)

5

10

15

(IV-105)

20

(IV-106)

25

30

(IV-107)

35

40

45

(IV-108)

50

55

(IV-109)

60

65

2948

-continued (IV-110)

(IV-111)

(IV-112)

(IV-113)

(IV-114)

(IV-115)

(IV-116)

(IV-117)

(IV-118)

(IV-119)

2949

-continued (IV-120)

(IV-121)

(IV-122)

(IV-123)

(IV-124)

(IV-125)

(IV-126)

(IV-127)

2950

-continued (IV-128)

(IV-129)

(IV-130)

(IV-131)

(IV-132)

(IV-133)

(IV-134)

and (IV-135)

wherein Xa represents CH=O, CHF$_2$, CF$_3$, CH$_2$SH, COOH, CH$_2$OH, CH$_2$NO$_2$, CH$_2$NH$_2$, CH$_3$, C(CH$_3$)$_3$, CH(CH$_3$)$_2$, CH((CH$_2$)$_3$—CH$_3$)$_2$, or CH(CH$_2$—CH$_3$)$_2$;

Xb represents O, NH, $CH_2$, or S;

Xc represents CH or N;

each $R_{10}$ is independently selected from H, F, Cl, Br, $CH_3$, $CF_3$, CH=O, OH, COOH, and $(CH_2)_nCH_3$, m is 1, 2, 3, 4, or 5; and n is 1, 2, 3, 4, or 5;

$B_1$ and $B_2$, which may be identical or different, each independently represents the aromatic boron-containing groups; and

* in Formulae IV-1 to IV-135 represents a point of attachment to corresponding Formulae FF161-164;

g) Formulae FF165-FF166, wherein Formulae FF165-FF166 are:

(FF165)

and (FF166)

and;

wherein X represents a point of covalent attachment either directly to an amine in X1 or to an amine that is covalently conjugated directly or indirectly to X1, or to OH when X1 is OH;

m is 1, 2, 3, 4, 5, 6, or 7;

n is 1, 2, 3, 4, 5, 6, or 7;

X5 is S, O, or NH; and each $R_1$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)$NH—$CH_3$, —$(SO_2)$NH$(CH_2)_mCH_3$, and $OCF_3$, wherein m is 1, 2, 3, 4, 5, 6, or 7;

h) Formulae FF167-FF192, wherein Formulae FF167-FF192 are:

(FF167)

(FF168)

(FF169)

(FF170)

(FF171)

(FF172)

(FF173)

(FF174)

(FF175)

2953

-continued (FF176)

5

(FF177) 10

15

(FF178) 20

25

(FF179)

30

35

(FF180)

40

45

(FF181)

50

55

(FF182)

60

65

2954

-continued (FF183)

(FF184)

(FF185)

(FF186)

(FF187)

(FF188)

(FF189)

2955

-continued (FF190)

(FF191)

and (FF192)

wherein X represents a point of covalent attachment either directly to an amine in X1 or to an amine that is covalently conjugated directly or indirectly to X1, or to OH when X1 is OH;

$B_1$ and $B_2$, which may be identical or different, each independently represents the aromatic boron-containing groups;

i) Formulae FF193-FF209, wherein Formulae FF193-FF209 are:

FF193

FF194

FF195

2956

-continued

FF196

FF197

FF198

FF199

FF200

FF201

FF202

FF203

2957

-continued

FF204

FF205

FF206

FF207

FF208

FF209 wherein R in FF208 and FF209 is an alkyl, aryl or halide that is covalently conjugated through at least one $CH_2$ group to the amino group in the side chain of FF208 or FF209, R1 and R2 are independently selected from H, $CH_3$, alkyl, and formulae IV-1 to IV-135;

i is 1, 2, 3, 4, or 5;

j is 1, 2, 3, 4, or 5; and wherein X represents a point of covalent attachment either directly to an amine in X1 or to an amine that is covalently conjugated directly or indirectly to X1, or to OH when X1 is OH; and $B_1$ and $B_2$, which may be identical or different, each independently represents the aromatic boron-containing groups;

j) Formulae FF210-FF224, wherein Formulae FF210-FF224 are:

2958

FF210

FF211

FF212

FF213

FF214

FF215

FF216

FF217

FF218

-continued

FF219

FF220

FF221

FF222

FF223

FF224

(FF225)

(FF226)

(FF227)

(FF228)

(FF229)

(FF230)

(FF231)

wherein R11 in FF210 to FF212 is selected from Formulae IV-1 to IV-135 and R12 is selected from an amine, a hydroxyl, an alkyl, and a halide group;

wherein each R13 is independently selected from H, CH₃, alkyl, aryl and Formulae IV-1 to IV-135; R14 is selected from H, CH₃, alkyl, aryl and heteroaryl;

wherein X represents a point of covalent attachment either directly to an amine in X1 or to an amine that is covalently conjugated directly or indirectly to X1, or to OH when X1 is OH;

X" represents a point of covalent attachment to an amine —N in the compound, wherein — represents a single covalent bond to a CH₂ or CH group in the compound;

i is 1, 2, 3, 4, or 5;

j is 1, 2, 3, 4, or 5; and

B₁, B₂, B₃, B₄, B₅, and B₆ each independently represents the aromatic boron-containing groups, wherein in each FF structure containing B₁, B₂ and B₃ groups, at least two of the B₁, B₂ and B₃ groups are independently the aromatic boron-containing groups; and k) Formulae FF225-FF231, wherein Formulae FF225-FF231 are:

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

$B_1$ and $B_2$, which may be identical or different, each independently represents the aromatic boron-containing groups; and wherein at least one primary or secondary amine in FF1-FF223 and FF225-231 is optionally covalently conjugated to $B_6$.

72. The compound of embodiment 71, wherein the at least one Z1c is FF227.

73. The compound of embodiment 72, wherein the least one Z1c is FF227 and i is 1.

74. The compound of embodiment 71, wherein the least one Z1c is selected from FF12-FF35, FF104-FF117, FF180-FF193, and FF196-FF205.

75. The compound of embodiment 71, wherein the compound is a molecular conjugate represented by the following formula, or a stereoisomer or a mixture of stereoisomers, or pharmaceutically acceptable salt thereof:

$$[[[Z1c]_{\overline{p'}}+Z1a\,)_{\overline{m'}}]_{\overline{o'}}+Z1b\,)_{\overline{n'}}]_{\overline{q'}}-X1,$$

wherein

X1 comprises:

(i) $NH_2$ or OH, (ii) a polypeptide drug substance comprising an amine, (iii) a polypeptide drug substance that is covalently conjugated to an amine containing linker, or (iv) an amine configured to be covalently conjugated to a polypeptide drug substance;

each Z1c is independently selected from Formulae FF1-FF231;

each Z1a independently comprises 1 to 50 amino acids connected together using amide or peptide bonds;

each Z1b is independently a small-molecule linker;

each m' is independently 0 or 1;

each n' is independently 0 or a positive integer;

each o' is independently an integer greater than or equal to 1;

each p' is a positive integer; and q' is a positive integer of at least 1 and not more than two times the total number of amine groups in X1, wherein when any of n', o', p', or q' is 2 or more, the corresponding groups Z1a, Z1b, and Z1c are independently selected and may be the same or different;

wherein each Z1c is independently covalently conjugated, directly or indirectly, to an amine of Z1a, to an amine of Z1b, or to X1; and wherein optionally the molecular conjugate may comprise one or more isotopes at any position of the molecular conjugate.

76. The compound of embodiment 71, wherein the compound comprises at least one group selected from $B_1$, $B_2$, $B_3$, $B_4$, $B_5$ and $B_6$, each independently selected from:

(F2)

(F7)

(F8)

(F11)

wherein for $B_1$, $B_2$, and $B_3$:

one $R_1$ represents (C=O)—*, wherein —* represents the attachment point to the rest of Z1c; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —($SO_2$)NH—$CH_3$, —($SO_2$)NH $(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c and one R1 for $B_5$ represents (C=O)—*, S(=O)(=O)—*, ($CH_2$) nm(C=O)—*, or $(CH_2)_m$—*, wherein —* represents an attachment point to the rest of Z1c, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$; CH=O, $SO_2CH_3$, $SO_2CF_3$, $CF_3$, $CHF_2$, $NO_2$, $CH_3$, $OCH_3$, $O(CH_2)_mCH_3$, ($SO_2$)NH—$CH_3$, —($SO_2$)NH $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)NH$ $(CH_2)_m CH_3$, and $OCF_3$, wherein m is 1, 2, 3, 4, 5, 6, or 7;

wherein for Formula F7:

Y8 is O; and each Y10 is independently selected from $CH_3$, F, and $CF_3$;

wherein for Formula F8:

Y8 is O;

i is 2, 3, 4, or 5; and each Y10 is independently selected from H, $CH_3$, F, and $CF_3$, with the proviso that at least one Y10 is not H; and — represents an attachment point to the rest of Z1c.

77. The compound of embodiment 71, wherein the compound comprises at least one group selected from $B_1$, $B_2$, $B_3$, $B_4$, $B_5$ and $B_6$, each independently selected from:

(F7A)

(F8A)

(F11)

wherein for $B_1$, $B_2$, and $B_3$:

$R_1$ at position 5' represents $(C=O)$—*, wherein —* represents the attachment point to the rest of Z1c; and each remaining $R_1$ or $R_2$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)NH$ $(CH_2)_m CH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of $Z1_c$ and one $R_1$ for $B_5$ represents $(C=O)$—*, $S(=O)(=O)$—*, $(CH_2)_m(C=O)$—*, or $(CH_2)_m$—*, wherein —* represents an attachment point to the rest of Z1c, and m is 1, 2, 3, 4, 5, 6, or 7; and each remaining $R_1$ or $R_2$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)NH$ $(CH_2)_m CH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)NH$ $(CH_2)_m CH_3$, and $OCF_3$, wherein m is 1, 2, 3, 4, 5, 6, or 7;

wherein for Formula F7A:

Y8 is O; and wherein for Formula F8A:

Y8 is O; and i is 2, 3, 4, or 5; and

— represents an attachment point to the rest of Z1c.

78. The compound of any one of embodiments 71-77, wherein the $B_1$, $B_2$, $B_3$, $B_4$, $B_5$ and $B_6$ are each independently Formula F7A, (F7A)

wherein for $B_1$, $B_2$, and $B_3$:

$R_1$ at position 5' represents $(C=O)$—*, wherein —* represents the attachment point to the rest of Z1c; and each remaining $R_1$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)$ $NH(CH_2)_m CH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of Z1c and one $R_1$ for $B_5$ represents $(C=O)$—*, $S(=O)(=O)$—*, $(CH_2)_m(C=O)$—*, or $(CH_2)_m$—*, wherein —* represents an attachment point to the rest of Z1c, and m is 1, 2, 3, 4, 5, 6, or 7; and each remaining $R_1$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_m CH_3$, —$(SO_2)NH$—$CH_3$, —$(SO_2)$ $NH(CH_2)_m CH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ is independently selected from H, F, Cl, Br, OH, $CH_2$—$NH_2$, $NH_2$, $(C=O)$—$NH_2$, $CH=O$, $SO_2CH_3$, $SO_2CF_3$, $CF_3$, $CHF_2$, $NO_2$, $CH_3$, $OCH_3$, $O(CH_2)_mCH_3$,    —$(SO_2)NH$—$CH_3$,    —$(SO_2)$$NH(CH_2)_mCH_3$, and $OCF_3$, wherein m is 1, 2, 3, 4, 5, 6, or 7;

Y8 is O; and

— represents an attachment point to the rest of Z1c

79. The compound of any one of embodiments 71-75, wherein at least one Z1c is covalently conjugated indirectly via a linker to an amine of X1 or to $NH_2$ when X1 is $NH_2$ or to OH when X1 is OH or to an amine of Z1a, wherein the linker is represented by Formula $(X'')_{n1}$, wherein each n1 is independently selected from 1, 2, 3, 4, and 5, and each X" is independently selected from:

i. an L- or D-amino acid, wherein an amine functional group of the L- or D-amino acid is covalently conjugated, directly or indirectly, to Z1c and an acid functional group of the L- or D- amino acid is conjugated, directly or indirectly, to X1 or to Z1a; and ii. Formulae FL(IA), FL(IB), FL69, and FL70;

wherein Formula FL(IA) and FL(IB) are:

FL(IA)

FL(IB)

and stereoisomers thereof;

wherein:

G is selected from a 3- to 6-membered cycloalkyl group, a 3- to 10-membered heterocyclyl group, a heteroaryl group, and an aryl group, wherein each group is optionally substituted with 1-3 groups independently selected from hydroxy, amino, halogen, cycloalkyl, alkoxy, and alkyl;

E is absent or is an alkylene group optionally substituted with 1-3 groups independently selected from halogen, hydroxy, and amino;

Q is absent or is selected from hydrogen, alkyl, halo, cyano, alkoxy, carboxylic acid, amino, hydroxy, amide, halo alkyl, cycloalkyl, heterocycle, heteroaryl, and aryl, wherein the alkyl, alkoxy, cycloalkyl, heterocycle, heteroaryl, and aryl is each optionally substituted with 1-5 groups independently selected from alkyl, amino, amide, halo, hydroxy, cyano, halo alkyl, and alkoxy;

Q' is selected from hydrogen, alkyl, and an acyl group;

Q and Q', together with the carbon and nitrogen atom to which they are attached, optionally form a 4-membered heterocyclyl, a 5-membered heterocyclyl, a 6-membered heterocyclyl, a 9-membered bicyclic heterocyclyl, or a 10-membered bicyclic heterocyclyl, wherein the 4-membered heterocyclyl, 5-membered heterocyclyl, 6-membered heterocyclyl, 9-membered bicyclic heterocyclyl, and 10-membered bicyclic heterocyclyl are each optionally substituted with 1-5 groups independently selected from alkyl, amino, halo, hydroxy, cyano, amide, halo alkyl, and alkoxy;

p is 0, 1, 2, 3, 4, or 5;

q is 0, 1, 2, 3, 4, or 5;

R" represents a covalent bond, directly or indirectly, to Z1c;

Z" represents a covalent bond, directly or indirectly, to X1 or to Z1a; and any primary amine is optionally acetylated or alkylated; wherein Formulae FL69 and FL70 are:

FL69

FL70 and stereoisomers thereof;

wherein:

R" represents a covalent bond, directly or indirectly, to Z1c;

Z" represents a covalent bond, directly or indirectly, to X1 or to Z1a;

A' is selected from H, an alkyl, a saturated fatty acid, an unsaturated fatty acid, a cycloalkyl, a haloalkyl, an aryl, and a heteroaryl; and A" is (i) a bile acid conjugated, directly or indirectly, via its acid group to the amine in FL69 or FL70; or (ii) a $C_2$-$C_{20}$ acyl group optionally terminating in an acid group, wherein one or more carbon atoms of the $C_2$-$C_{20}$ acyl group are optionally and independently replaced by a group selected from C(=O), O, NH, $NH_2$, S, S(O), $SO_2$, phenyl, 5-membered heterocyclyl, 6-membered heterocyclyl, 5-membered heteroaryl, 6-membered heteroaryl, and wherein the one or more carbon atoms of the $C_2$-$C_{20}$ acyl group, NH, $NH_2$, $SO_2$, phenyl, 5-membered heterocyclyl, 6-membered heterocyclyl, 5-membered heteroaryl, and 6-membered heteroaryl is each independently substituted with 0, 1, 2, 3, or 4 $R_x$, wherein $R_x$ is selected from $C_1$-$C_5$ alkyl, halogen, $C_1$-$C_5$ haloalkyl, carboxylic acid, hydroxyl, —O—$C_1$-$C_5$ alkyl, $NH_2$, and a substituted or unsubstituted 5-membered heterocyclyl, 6-membered heterocyclyl, 5-membered heteroaryl, and 6-membered heteroaryl;

p is 1, 2, 3, 4, or 5, q is 1, 2, 3, 4, or 5, and any primary amine is optionally acetylated or alkylated.

80. The compound of embodiment 79, wherein each A" is independently selected from:

AB-1

2967

AB-2

5

AB-3

10

AB-4

15

AB-5

20

AB-6

25

AB-7

30

35

AB-8

40

AB-9

45

AB-10

50

AB-11    55

60

AB-12

65

2968

AB-13

AB-14

AB-15

AB-16

AB-17

AB-18

AB-19

AB-20

AB-21

AB-22

2969

-continued

AB-23

AB-24

AB-25

AB-26

AB-27

AB-28

AB-29

AB-30

2970

-continued

AB-31

AB-32

AB-33

AB-34

AB-35

81. The compound of embodiment 71 or 75, wherein the compound comprises at least one Z1b selected from Formulae IIa-IIai and Formulae IIIa-IIIai, wherein Formulae IIa-IIai are:

Formula IIa

Formula IIb

Formula IIc

Formula IId

2971

-continued

Formula IIe

Formula IIf

Formula IIg

Formula IIh

Formula IIi

Formula IIj

Formula IIk

Formula IIl

Formula IIm

Formula IIn

Formula IIo

Formula IIp

Formula IIq

2972

-continued

Formula IIr

Formula IIs

Formula IIt

Formula IIu

Formula IIv

Formula IIw

Formula IIx

Formula IIy

Formula IIz

Formula IIaa

Formula IIab

Formula IIac

Formula IIad

Formula IIae

5

10

15

20

25

30

35

40

45

50

55

60

65

2973

-continued

Formula IIaf

5

Formula IIag

10

Formula IIah and

15

Formula IIai

20 wherein:

r is 0, 1, 2, 3, 4, or 5;

25 s is 0, 1, 2, 3, 4, or 5;

W represents CH$_2$——~ or (C=O)——~, wherein ——~ is a covalent linkage to X1; and

30 each V$_1$ is independently selected from NH—†, CH$_2$—†, and (C=O)—† and each V$_2$ is N—†, wherein —† is a covalent linkage towards successive Z1b, Z1a or Z1c, provided that V$_1$ is NH—† when connected to Z1c; and the covalent linkages between Z1a and Z1b units each independently comprise an amine linkage or an amide linkage; and when n'=0 and m'=1, Z1a is directly conjugated to X1 by an amine linkage or amide linkage, and

35 wherein Formulae IIIa-IIIai are:

40

Formula IIIa

Formula IIIb

45

Formula IIIc

50

Formula IIId

55

Formula IIIe

60

Formula IIIf

65

2974

-continued

Formula IIIg

Formula IIIh

Formula IIIi

Formula IIIj

Formula IIIk

Formula IIIl

Formula IIIm

Formula IIIn

Formula IIIo

Formula IIIp

Formula IIIq

Formula IIIr

Formula IIIs

-continued

Formula IIIt

Formula IIIu

Formula IIIv

Formula IIIw

Formula IIIx

Formula IIIy

Formula IIIz

Formula IIIaa

Formula IIIab

Formula IIIac

-continued

Formula IIIad

Formula IIIae

Formula IIIaf

Formula IIIag

Formula IIIah and

Formula IIIai wherein
  r is 1, 2, 3, 4, or 5;
  s is 1, 2, 3, 4, or 5; and
  each $V_1$ is independently selected from NH—†, CH$_2$—†, and (C=O)—† and each $V_2$ is N—†, wherein —† is a covalent linkage towards successive Z1b, Z1a or Z1c, provided that $V_1$ is NH—† when connected to Z1c; and the covalent linkages between Z1a and Z1b units each independently comprise an amine linkage or an amide linkage; and when n'=0 and m'=1, Z1a is directly conjugated to X1 by an amine linkage or amide linkage.
  82. The compound of embodiment 75, wherein the at least one Z1c is covalently conjugated indirectly via a linker selected from (i) Formulae FL1-FL19:

(FL1)

(FL2)

(FL3)

(FL4)

(FL4A)

(FL5)

2977

2978

(FL6)

(FL7)

(FL7A)

(FL8)

(FL9)

(FL8A)

(FL9A)

(FL10)

(FL11)

(FL12)

(FL13)

(FL14)

(FL15)

(FL16)

(FL17)

(FL18)

(FL19)

wherein, in Formulae FL1 to FL19:

Z″ represents an attachment point toward X1;

R″ represents an attachment point toward Z1c;

p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group directly conjugated to Z1c, wherein an acid functional group of the amino acid is conjugated toward X1.

83. The compound of embodiment 75 wherein n' is 1 and each of the Z1b is independently selected from (i) Formulae FL1-FL19:

(FL14)

-continued wherein, in Formulae FL1 to FL19:

Z″ represents an attachment point toward X1;

R″ represents an attachment point toward Z1c;

p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group directly conjugated to Z1c, wherein an acid functional group of the amino acid is conjugated toward X1.

84. The compound of embodiment 71 or 75, wherein the compound comprises a drug substance comprising a human polypeptide hormone of the human pancreas, insulin, glucagon, GLP-1, a somatostatin, a gastric inhibitory polypeptide, a glucose-dependent insulinotropic polypeptide, a hybrid peptide comprising sequences from two or more human polypeptide hormones, or an analogue thereof.

85. The compound of embodiment 71 or 75, wherein:

X1 comprises human insulin or a human insulin analogue comprising an A-chain and a B-chain, wherein the A-chain comprises a sequence selected from SEQ ID NOs 1 and 3 to 33, and the B-chain comprises a sequence selected from SEQ ID NOs 2 and 34 to 74, 24047, and 24048;

each Z1c is independently selected from FF1, FF10, FF12, FF14, FF15, FF114, FF115, FF116, FF163, FF193, FF194, FF203, FF221-FF231 and covalently conjugated either directly, or indirectly via the linker, to Z1a and/or Z1b, or to X1;

each Z1a is independently absent or independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKGSTK (SEQ ID NO:13205), GKHENK (SEQ ID NO:13271), GKNSHK (SEQ ID NO:13982), GKN-STK (SEQ ID NO:13989), GKQSSK (SEQ ID NO:14380), GKYQFK (SEQ ID NO:15128), GKG- SKK (SEQ ID NO:24045), GKKPGKK (SEQ ID NO:24046), GKGPSK (SEQ ID NO:24044), GKP-SHKP (SEQ ID NO:24043), and GSHKGSHK (SEQ ID NO:24042);

each said linker is selected from FL1, FL3, FL4, and FL5;

each m′ is independently 0 or 1;

each n′ is independently 0, 1, 2, or 3;

each o′ is independently 1, 2, 3, 4, or 5;

each p′ is 1, 2, 3, 4, or 5; and q′ is 1, 2, 3, or 4, wherein when any of n′, o′, p′, or q′ is 2 or more, the corresponding groups Z1a, Z1b, and Z1c are independently selected and may be the same or different; and wherein each Z1c is independently covalently conjugated, directly or indirectly, to an amine of Z1a, to an amine of Z1b, or to X1.

86. The compound of embodiment 71 or 75, wherein:

X1 comprises the human insulin or human insulin analogue comprising an A-chain and a B-chain, wherein the A-chain comprises SEQ ID NO:1; and the B-chain is selected from SEQ ID NOs 2, 36, 24047, and 24048;

each Z1c is independently selected from FF1, FF10, FF12, FF14, FF15, FF114, FF115, FF116, FF193, FF194, FF203, and FF221-FF231 and covalently conjugated either directly, or indirectly via the linker, to Z1a and/or Z1b, or to X1;

each Z1a independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKG-STK (SEQ ID NO:13205), GKHENK (SEQ ID NO:13271), GKNSHK (SEQ ID NO:13982), GKN-STK (SEQ ID NO:13989), GKQSSK (SEQ ID NO:14380), GKYQFK (SEQ ID NO:15128), GKG-SKK (SEQ ID NO:24045), GKKPGKK (SEQ ID NO:24046), GKGPSK (SEQ ID NO:24044), GKP-SHKP (SEQ ID NO:24043), and GSHKGSHK (SEQ ID NO:24042);

each said linker is independently absent or independently selected from FL3 and FL5;

each m' is independently 0 or 1;

each n' is independently 0 or 2;

each o' is independently 1, 2, or 3;

each p' is 1, 2, or 3; and q' is 1, 2, or 3, wherein when any of n', o', p', or q' is 2 or more, the corresponding groups Z1a, Z1b, and Z1c are independently selected and may be the same or different;

wherein each Z1c is independently covalently conjugated, directly or indirectly, to an amine of Z1a, to an amine of Z1b, or to X1.

87. The compound of embodiment 71 or 75, wherein each of the Z1a is independently absent or independently comprises a sequence selected from K, GK, KGSH (SEQ ID NO:24049), GKGSH (SEQ ID NO:24050), KGSHK (SEQ ID NO:4238), and GKGSHK (SEQ ID NO:13198).

88. The compound of embodiment 71 or 75, wherein each of the Z1c is independently selected from FF1; FF10, FF12, FF14, FF15, FF114, FF115, FF116, and FF221-FF231, and wherein the $B_1$ and the $B_2$ are independently selected from Formulae F1 and F2.

89. The compound of any one of embodiments 71 and 75-76, wherein the $B_1$ and the $B_2$ are independently selected from F2 and F7.

90. The compound of any one of embodiments 76-78, wherein at least one $R_1$ in $B_1$ or $B_2$ is F or $CF_3$.

91. The compound of embodiment 71 or 75, wherein Z1b is independently absent, FL3, or FL5.

92. The compound of embodiment 71 or 75, wherein each of the Z1c is independently selected from FF10, FF12, FF116, FF221, FF222, and FF224-FF231.

93. The compound of embodiment 76, wherein:

each $B_1$ and $B_2$ is independently selected from F2 and F7 and is covalently conjugated to Z1c using an amide linkage, each Z1b is independently absent; FL3 wherein p is 1, 2, or 3; or FL5 wherein p is 2, 3, or 4;

each FF is independently selected from FF10, FF12, FF116, FF134, FF163, FF193, FF203, FF221, FF222 and FF224-FF231; wherein each FF12 and FF222 has either (S,R) or (S,S) stereochemistry;

each Z1c is conjugated either directly or indirectly through FL3 or FL5 to the amine group in one or more lysine side chain in X1 or the N-terminus in X1; and X1 is a polypeptide drug substance and/or an insulin optionally having from 0 to 4 residues replaced, inserted, or mutated to lysines, and wherein the lysines are each conjugated directly or indirectly to a Z1c.

94. The compound of embodiment 71 or 75, wherein Z1c is FF224, n' is 0, and Z1a is an amine containing amino acid.

95. The compound of any one of embodiments 71-94, wherein the compound is selected from:

$$((Z1c)\overline{\tfrac{}{p'}}(Z1a\overline{\tfrac{}{m'}})_{q'}\!-X1; \tag{IA}$$

$$((Z1c)\overline{\tfrac{}{p'}}(Z1b\overline{\tfrac{}{m'}})_{q'}\!-X1; \text{ and} \tag{IB}$$

$$((Z1c)\overline{\tfrac{}{p'}})_{q'}\!X1. \tag{IC}$$

96. The compound of any one of embodiments 71-94, wherein the compound is selected from:

$$\left[[Z1c]_1\right]_1\!\!-X1; \quad \left[[Z1c]_1\right]_2\!\!-X1; \quad \left[[Z1c]_1\right]_3\!\!-X1; \quad \left[[Z1c]_1\right]_4\!\!-X1;$$

$$\left[[Z1c]_1\right]_5\!\!-X1; \quad \left[[Z1c]_2\!-\![Z1a]_1\right]_2\!\!-X1;$$

$$\left[[Z1c]_2\!-\![Z1a]_1\right]_2\!\!-X1\!-\!\left[[Z1c]_1\right]_1;$$

$$\left[[Z1c]_2\!-\![Z1a]_1\right]_2\!\!-X1\!-\!\left[[Z1c]_1\right]_2;$$

$$\left[[Z1c]_2\!-\![Z1a]_1\!+\!Z1b]_1\right]_1\!\!-X1;$$

$$\left[[Z1c]_2\!-\![Z1a]_1\!-\![Z1b]_1\right]_1\!\!-X1\!-\!\left[[Z1c]_1\right]_1;$$

$$\left[[Z1c]_1\!-\![Z1b]_1\right]_1\!\!-X1; \quad \left[[Z1c]_2\!-\![Z1a]_1\right]_1\!\!-X1\!-\![Z1c]_1\right]_1;$$

$$\left[[Z1c]_2\!-\![Z1a]_1\right]_1\!\!-X1\!-\!\left[[Z1c]_1\right]_2; \text{ and}$$

$$\left[[Z1c]_2\!-\![Z1a]_1\right]_1\!\!-X1\!-\!\left[[Z1c]_1\right]_2.$$

97. The compound of embodiment 96, wherein the compound is selected from $$[[Z1c]\!-\!(Z1a)\overline{\tfrac{}{1}}\overline{\tfrac{}{1}}\!-X1\!-\![Z1c]_1]_1 \text{ and}$$

$$[[Z1a]\overline{\tfrac{}{1}}\overline{\tfrac{}{1}}\!-X1.$$

98. The compound of embodiment 71 or 75, wherein Z1c is covalently conjugated directly to X1 via a linker, and wherein the linker is independently selected from gamma-glutamic acid, beta-alanine, and Formula FL3

(FL3)

wherein p is 1, 2, or 3; and

Formula FL5

(FL5)

wherein p is 2, 3, or 4.

99. The compound of embodiment 71 or 75, wherein X1 is OH or $NH_2$, and the compound further comprises a drug substance covalently conjugated directly or indirectly to the compound.

100. A tautomer, stereoisomer or a mixture of stereoisomers, or a pharmaceutically acceptable salt, or hydrate, or isotopic derivative thereof of the compound of any one of embodiments 66-71.

101. A compound comprising X1 and one or more Z1c, or a tautomer, stereoisomer or a mixture of stereoisomers, or a pharmaceutically acceptable salt, or hydrate, or isotopic derivative thereof,

2985

2986 wherein:

X1 comprises:

(i) NH$_2$ or OH;

(ii) a drug substance comprising an amine;

(iii) a drug substance that is covalently conjugated to an amine containing linker; or (iv) an amine configured to be covalently conjugated to a drug substance;

wherein each Z1c is covalently conjugated, directly or indirectly, to an amine in X1 or to OH when X1 is OH, and wherein each Z1c is independently selected from:

a) Formulae FF1-FF48, wherein Formulae FF1-FF48 are:

(FF1)

(FF2)

(FF3)

(FF4)

(FF5)

(FF6)

(FF7)

(FF8)

(FF9)

(FF10)

(FF11)

(FF12)

(FF13)

2987

-continued (FF14)

5

(FF15)

10

15

(FF16)

20

25

(FF17)

30

(FF18)

35

(FF19)

40

45

50

(FF20)

55

60

65

2988

-continued (FF21)

(FF22)

(FF23)

(FF24)

(FF25)

(FF26)

(FF27)

2989

-continued (FF28)

(FF29)

(FF30)

(FF31)

(FF32)

(FF33)

(FF34)

(FF35)

2990

-continued (FF36)

(FF37)

(FF38)

(FF39)

(FF40)

(FF41)

(FF42)

(FF43)

(FF44)

2991

(FF45)

5

10

(FF46)

15

(FF47)

20 and

25

(FF48)

30 wherein X represents a point of covalent attachment either
directly to an amine in X1 or to an amine that is
covalently conjugated directly or indirectly to X1, or to
OH when X1 is OH;

i is 1, 2, 3, 4, 5, 6, or 7;

j is 1, 2, 3, 4, 5, 6, or 7; and

B₁ and B₂, which may be identical or different, each
independently represents an aromatic boron-containing
group;

b) Formulae FF49-FF88, wherein Formulae FF49-
    FF88 are:

(FF49)

50

(FF50)

60

(FF51)

65

2992

(FF52)

(FF53)

(FF54)

(FF55)

(FF56)

(FF57)

(FF58)

(FF59)

(FF60)

2993

-continued (FF61)

5

(FF62)

10

15

(FF63)

20

25

(FF64)

30

35

(FF65)

40

(FF66)

45

(FF67) 50

55

(FF68)

60

65

2994

-continued (FF69)

(FF70)

(FF71)

(FF72)

(FF73)

(FF74)

(FF75)

2995

-continued (FF76)

(FF77)

(FF78)

(FF79)

(FF80)

(FF81)

2996

-continued (FF82)

(FF83)

(FF84)

(FF85)

(FF86)

(FF87)

and

-continued (FF88)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

R1a is selected from COOH, $CH_3$, H, and OH;

R2, R3, R4 and R5 are each independently selected from $CH_3$, H, OH, and COOH, and at least one of R2, R3, R4 and R5 is $CH_3$ or OH; and $B_1$ and $B_2$, which may be identical or different, are each independently an aromatic boron-containing group;

c) Formulae FF89-FF112, wherein Formulae FF89-FF112 are:

(FF89)

(FF90)

-continued (FF91)

(FF92)

(FF93)

(FF94)

(FF95)

(FF96)

-continued (FF97)

(FF98)

(FF99)

(FF100)

(FF101)

(FF102)

-continued (FF103)

(FF104)

(FF105)

(FF106)

(FF107)

3001

-continued (FF108)

(FF109)

(FF110)

(FF111)

and (FF112)

wherein X represents a point of covalent attachment either directly to an amine in X1 or to an amine that is covalently conjugated directly or indirectly to X1, or to OH when X1 is OH;

i is 1, 2, 3, 4, 5, 6, or 7; and $B_1$, $B_2$ and $B_3$, which may be identical or different, are each independently an aromatic boron-containing

3002 group, a carboxylic acid derivative, or a H, wherein in each FF89-FF112 structure containing B1, B2 and B3 groups, at least two of the B1, B2 and B3 groups are independently an aromatic boron-containing group;

d) Formulae FF113-FF136, wherein Formulae FF113-FF136 are:

(FF113)

(FF114)

(FF115)

(FF116)

(FF117)

(FF118)

3003

-continued (FF119)

(FF120)

(FF121)

(FF122)

(FF123)

(FF124)

(FF125)

3004

-continued (FF126)

(FF127)

(FF128)

(FF129)

(FF130)

(FF131)

5

10

15

20

25

30

35

40

45

50

55

60

65

3005

-continued (FF132)

(FF133)

(FF134)

(FF135)

(FF136)

3006

(FF137)

(FF138)

(FF139)

(FF140)

(FF141)

(FF142)

(FF143)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

k is 1, 2, 3, 4, 5, 6, or 7;

mis 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl, or aryl groups; and B₁ and B₂, which may be identical or different, each independently represents an aromatic boron-containing group;

e) Formulae FF137-FF160, wherein Formulae FF137-FF160 are:

3007

-continued (FF144)

(FF145)

(FF146)

(FF147)

(FF148)

(FF149)

(FF150)

3008

-continued (FF151)

(FF152)

(FF153)

(FF154)

(FF155)

(FF156)

3009

-continued (FF157)

(FF158)

(FF159)

(FF160)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each R1 is independently selected from H, an alkyl group, an acyl group, a cycloalkyl group, a haloalkyl group, an aryl group, and a heteroaryl group, each R1 optionally comprises one or more alkyl-halide, halide, sulfhydryl, aldehyde, amine, acid, hydroxyl, alkyl, or aryl groups; and B₁ and B₂, which may be identical or different, each independently represents an aromatic boron-containing group;

f) Formulae FF161-FF164, wherein Formulae FF161-FF164 are:

FF161

3010

-continued

FF162

FF163

FF164 wherein X represents a point of covalent attachment either directly to an amine in X1 or to an amine that is covalently conjugated directly or indirectly to X1, or to OH when X1 is OH;

i is 1, 2, 3, 4, or 5;

j is 1, 2, 3, 4, or 5;

each R6, R7, R8, and R9 for different values of j is independently selected from H, CF₃, CH₃, CHF₂, and (CH₂)ₘCH₃, wherein m is 1, 2, 3, 4, or 5;

Y3, Y4, Y5, Y6 and Y7 are each independently selected from H, CH₂—X4, and Formulae IV-1 to IV-135;

wherein X4 is selected from —COOH, —(CH₂)ₘCOOH, an alkyl group, an acyl group, a cycloalkyl group, a haloalkyl group, an aryl group, and a heteroaryl group, each X4 optionally comprises one or more alkyl-halide, halide, sulfhydryl, aldehyde, amine, acid, hydroxyl, alkyl or aryl groups; wherein m is 1, 2, 3, 4, or 5;

wherein at least one of Y5, Y6 and Y7 in Formulae FF162 and FF163 is not H and at least one of Y7, R8 and R9 in FF164 is not H; and wherein Formulae IV-1 to IV-135 are:

(IV-1)

(IV-2)

3011

-continued (Iv-3)

5

(IV-4)

(IV-5)

10

15

(IV-6)

20

25

(IV-7)

30

(IV-8)

35

(IV-9)

40

45 (IV-10)

50

(IV-11)

55

(IV-12)

60

(IV-13)

65

3012

-continued (IV-14)

(IV-15)

(IV-16)

(IV-17)

(IV-18)

(IV-19)

(IV-20)

(IV-21)

(IV-22)

(IV-23)

(IV-24)

3013

-continued (IV-25)

(IV-26)

(IV-27)

(IV-28)

(IV-29)

(IV-30)

(IV-31)

(IV-32)

(IV-33)

(IV-34)

(IV-35)

(IV-36)

(IV-37)

3014

-continued (IV-38)

(IV-39)

(IV-40)

(IV-41)

(IV-42)

(IV-43)

(IV-44)

(IV-45)

(IV-46)

(IV-47)

(IV-48)

3015

-continued (IV-49)

(IV-50)

(IV-51)

(IV-52)

(IV-53)

(IV-54)

(IV-55)

(IV-56)

3016

-continued (IV-57)

(IV-58)

(IV-59)

(IV-60)

(IV-61)

(IV-62)

(IV-63)

3017

-continued (IV-64)

(IV-65)

(IV-66)

(IV-67)

(IV-68)

(IV-69)

3018

-continued (IV-70)

(IV-71)

(IV-72)

(IV-73)

(IV-74)

(IV-75)

(IV-76)

3019
-continued

3020
-continued (IV-77)

(IV-86)

(IV-78)

(IV-87)

(IV-79)

(IV-88)

(IV-80)

(IV-89)

(IV-81)

(IV-90)

(IV-82)

(IV-91)

(IV-83)

(IV-92)

(IV-84)

(IV-93)

(IV-85)

(IV-94)

5

10

15

20

25

30

35

40

45

50

55

60

65

3021

-continued (IV-95)

(IV-96)

(IV-97)

(IV-98)

(IV-99)

(IV-100)

(IV-101)

(IV-102)

(IV-103)

3022

-continued (IV-104)

(IV-105)

(IV-106)

(IV-107)

(IV-108)

(IV-109)

5

10

15

20

25

30

35

40

45

50

55

60

65

3023

-continued

3024

-continued (IV-110)

(IV-111)

(IV-112)

(IV-113)

(IV-114)

(IV-115)

(IV-116)

(IV-117)

(IV-118)

(IV-119)

(IV-120)

(IV-121)

(IV-122)

(IV-123)

(IV-124)

(IV-125)

(IV-126)

(IV-127)

-continued (IV-128)

(IV-129)

(IV-130)

(IV-131)

(IV-132)

(IV-133)

(IV-134)

and (IV-135)

wherein Xa represents $CH=O$, $CHF_2$, $CF_3$, $CH_2SH$, $COOH$, $CH_2OH$, $CH_2NO_2$, $CH_2NH_2$, $CH_3$, $C(CH_3)_3$, $CH(CH_3)_2$, $CH((CH_2)_3-CH_3)_2$, or $CH(CH_2-CH_3)_2$;

Xb represents O, NH, $CH_2$, or S;

Xc represents CH or N;

each $R_{10}$ is independently selected from H, F, Cl, Br, $CH_3$, $CF_3$, $CH=O$, OH, COOH, and $(CH_2)_n CH_3$, m is 1, 2, 3, 4, or 5; and n is 1, 2, 3, 4, or 5;

$B_1$ and $B_2$, which may be identical or different, each independently represents an aromatic boron-containing group; and

* in Formulae IV-1 to IV-135 represents a point of attachment to corresponding Formulae FF161-164;

g) Formulae FF165-FF166, wherein Formulae FF165-FF166 are:

(FF165)

and (FF166)

wherein X represents a point of covalent attachment either directly to an amine in X1 or to an amine that is covalently conjugated directly or indirectly to X1, or to OH when X1 is OH;

m is 1, 2, 3, 4, 5, 6, or 7;

n is 1, 2, 3, 4, 5, 6, or 7;

X5 is S, O, or NH; and each $R_1$ is independently selected from H, F, Cl, Br, OH, $CH_2-NH_2$, $NH_2$, $(C=O)-NH_2$, $CH=O$, $SO_2CH_3$, $SO_2CF_3$, $CF_3$, $CHF_2$, $NO_2$, $CH_3$, $OCH_3$, $O(CH_2)_m CH_3$, $-(SO_2)NH-CH_3$, $-(SO_2)NH(CH_2)_m CH_3$, and $OCF_3$, wherein m is 1, 2, 3, 4, 5, 6, or 7;

h) Formulae FF167-FF192, wherein Formulae FF167-FF192 are:

3027

3028

-continued (FF167)

5

(FF168)

10

15

(FF169)

20

(FF170)

25

30

(FF171)

35

40

(FF172)

45

(FF173)

50

(FF174)

55

(FF175)

60

65

(FF176)

(FF177)

(FF178)

(FF179)

(FF180)

(FF181)

(FF182)

-continued (FF183)

(FF184)

(FF185)

(FF186)

(FF187)

(FF188)

(FF189)

-continued (FF190)

(FF191)

and (FF192)

wherein X represents a point of covalent attachment either directly to an amine in X1 or to an amine that is covalently conjugated directly or indirectly to X1, or to OH when X1 is OH;

$B_1$ and $B_2$, which may be identical or different, each independently represents an aromatic boron-containing group;

i) Formulae FF193-FF209, wherein Formulae FF193-FF209 are:

FF193

FF194

FF195

-continued

FF196

FF197

FF198

FF199

FF200

FF201

FF202

FF203

-continued

FF204

FF205

FF206

FF207

FF208

FF209 wherein R in FF208 and FF209 is an alkyl, aryl or halide that is covalently conjugated through at least one $CH_2$ group to the amino group in the side chain of FF208 or FF209, $R_1$ and $R_2$ are independently selected from H, $CH_3$, alkyl, and formulae IV-1 to IV-135;

i is 1, 2, 3, 4, or 5;

j is 1, 2, 3, 4, or 5; and wherein X represents a point of covalent attachment either directly to an amine in X1 or to an amine that is covalently conjugated directly or indirectly to X1, or to OH when X1 is OH; and $B_1$ and $B_2$, which may be identical or different, each independently represents an aromatic boron-containing group;

j) Formulae FF210-FF224, wherein Formulae FF210-FF224 are:

FF210

FF211

FF212

FF213

FF214

FF215

FF216

FF217

FF218

-continued

FF219

FF220

FF221

FF222

FF223 and

FF224 wherein R11 in FF210 to FF212 is selected from Formulae IV-1 to IV-135 and R12 is selected from an amine, a hydroxyl, an alkyl, and a halide group;

wherein each R13 is independently selected from H, CH$_3$, alkyl, aryl and Formulae IV-1 to IV-135; R14 is selected from H, CH$_3$, alkyl, aryl and heteroaryl;

wherein X represents a point of covalent attachment either directly to an amine in X1 or to an amine that is covalently conjugated directly or indirectly to X1, or to OH when X1 is OH;

X" represents a point of covalent attachment to an amine —N in the compound, wherein — represents a single covalent bond to a CH$_2$ or CH group in the compound;

i is 1, 2, 3, 4, or 5;

j is 1, 2, 3, 4, or 5; and

B$_1$, B$_2$, B$_3$, B$_4$, B$_5$, and B$_6$ each independently represents an aromatic boron-containing group, wherein in each FF structure containing B$_1$, B$_2$ and B$_3$ groups, at least two of the B$_1$, B$_2$ and B$_3$ groups are independently an aromatic boron-containing group; and k) Formulae FF225-FF231, wherein Formulae FF225-FF231 are:

(FF225)

(FF226)

(FF227)

(FF228)

(FF229)

(FF230)

(FF231)

wherein X represents a point of covalent attachment either directly to an amine in X1 or to an amine that is covalently conjugated directly or indirectly to X1, or to OH when X1 is OH;

i is 1, 2, 3, 4, 5, 6, or 7;

$B_1$ and $B_2$, which may be identical or different, each independently represents an aromatic boron-containing group, wherein $B_1$ and $B_2$ in Formulae FF225-FF231 are not a boronic acid or an F2 or F6 aromatic boron-containing group, wherein Formulae F2 and F6 are:

(F2)

(F6)

$R_1$ at position 4' or position 5' represents (C=O)—*, wherein —* represents the attachment point to the rest of Z1c;

zero, one, or two $R_1$ represents F, Cl, $CF_2$, $CF_3$, $SF_5$, $OCF_3$, $SO_2CH_3$, and/or $SO_2CF_3$, and each remaining $R_1$ represents H;

Y8 is O; and i is 1; and wherein at least one primary or secondary amine in FF1-FF223 and FF225-231 is optionally covalently conjugated to $B_6$.

102. The compound of embodiment 101, wherein the compound is a molecular conjugate represented by the following formula, or a stereoisomer or a mixture of stereoisomers, or pharmaceutically acceptable salt thereof:

$$\left[\left[\left[Z1c\right]_{p'}\!\!\left(Z1a\right)_{m'}\right]_{o'}\!\!\left(Z1b\right)_{n'}\right]_{q'}\!\!X1,$$

wherein

X1 comprises:
  (i) $NH_2$ or OH,
  (ii) a polypeptide drug substance comprising an amine,
  (iii) a polypeptide drug substance that is covalently conjugated to an, amine containing linker, or
  (iv) an amine configured to be covalently conjugated to a polypeptide drug substance;

each Z1c is independently selected from Formulae FF1-FF231;

each Z1a independently comprises 1 to 50 amino acids connected together using amide or peptide bonds;

each Z1b is independently a small-molecule linker;

each m' is independently 0 or 1;

each n' is independently 0 or a positive integer;

each o' is independently an integer greater than or equal to 1;

each p' is a positive integer; and q' is a positive integer of at least 1 and not more than two times the total number of amine groups in X1, wherein when any of n', o', p', or q' is 2 or more, the corresponding groups Z1a, Z1b, and Z care independently selected and may be the same or different;

wherein each Z1c is independently covalently conjugated, directly or indirectly, to an amine of Z1a, to an amine of Z1b, or to X1; and wherein optionally the molecular conjugate may comprise one or more isotopes at any position of the molecular conjugate.

103. The compound of embodiment 101 or 102, wherein the compound comprises at least one of $B_1$, $B_2$ and $B_3$ independently selected from Formulae F1-F11 or wherein the compound comprises at least one of $B_4$, $B_5$ and $B_6$ independently selected from Formulae F1-F11, wherein Formulae F1-F11 are:

(F1)

(F2)

(F3)

(F4)

-continued (F5)

(F6)

(F7)

(F8)

(F9)

(F10)

-continued (F11)

wherein for $B_1$, $B_2$, and $B_3$:

one $R_1$ represents (C=O)—*, S(=O)(=O)—*, $(CH_2)_m$ (C=O)—*, or $(CH_2)_m$—*, wherein —* represents the attachment point to the rest of Z1c, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of $Z1_c$ and one $R_1$ for $B_5$ represents (C=O)—*, S(=O)(=O)—*, $(CH_2)_m(C=O)$—*, or $(CH_2)_m$—*, wherein —* represents an attachment point to the rest of Z1c, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein, for Formulae F3-F4:

$R_w$ is O or S;

for Formulae F5-F10:

when Y8 is O, i is 1, 2, 3, 4, or 5; or when Y8 is NR, R is an alkyl group or H, and i is 1, 2, 3, 4, or 5;

Y9 is H, $CH_3$, or an alkyl group, provided that when Y8 is O, Y9 is a $CH_3$ or an alkyl group; and each Y10 is independently selected from H, $CH_3$, F, $CF_3$, and $OCH_3$, with the proviso that at least one Y10 is not H.

104. The compound of any one of embodiments 101-103, wherein the compound comprises at least one group selected from $B_1$, $B_2$, $B_3$ $B_4$, $B_5$ and $B_6$, each independently selected from Formulae F2, F7, F8, and F11, wherein Formulae F2, F7, F8, and F11 are:

(F2)

(F7)

(F8)

and (F11)

wherein for $B_1$, $B_2$, and $B_3$:

one $R_1$ represents (C=O)—* or $(CH_2)_m(C=O)$—*, wherein —* represents the attachment point to the rest of Z1c, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of $Z1_c$ and one $R_1$ for $B_5$ represents (C=O)—*, S(=O)(=O)—*, $(CH_2)_m(C=O)$—*, or $(CH_2)_m$—*, wherein —* represents an attachment point to the rest of $Z1_c$, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7; and wherein for Formula F7:

Y8 is 0 or NR, wherein R is an alkyl group or H; and each Y10 is independently selected from $CH_3$, F, $CF_3$, and $OCH_3$;

wherein for Formula F8:

when Y8 is O, i is 1, 2, 3, 4, or 5; and when Y8 is NR, R is an alkyl group or H, and i is 1, 2, 3, 4, or 5;

each Y10 is independently selected from H, $CH_3$, F, $CF_3$, and $OCH_3$, with the proviso that at least one Y10 is not H; and — represents an attachment point to the rest of Z1c.

105. The compound of any one of embodiments 101-104, wherein the compound comprises at least one group selected from $B_1$, $B_2$, $B_3$, $B_4$, $B_5$ and $B_6$, each independently selected from:

(F2)

(F7)

(F8)

(F11)

wherein for $B_1$, $B_2$, and $B_3$:

one $R_1$ represents (C=O)—*, wherein —* represents the attachment point to the rest of Z1c; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_4$ and $B_5$:

one $R_1$ for $B_4$ represents $(CH_2)_m$—ø, wherein —ø represents an attachment point to the rest of $Z1_c$ and one $R_1$ for $B_5$ represents (C=O)—*, S(=O)(=O)—*, $(CH_2)_m(C$=O)—*, or $(CH_2)_m$—*, wherein —* represents an attachment point to the rest of $Z1_c$, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents an attachment point to the rest of the compound, and m is 1, 2, 3, 4, 5, 6, or 7; and each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$—$CH_3$, —$(SO_2)NH$ $(CH_2)_mCH_3$, and $OCF_3$, wherein m is 1, 2, 3, 4, 5, 6, or 7;

wherein for Formula F7:

Y8 is O; and each Y10 is independently selected from $CH_3$, F, and $CF_3$;

wherein for Formula F8:

Y8 is O;

i is 1, 2, 3, 4, or 5; and each Y10 is independently selected from H, $CH_3$, F, and $CF_3$, with the proviso that at least one Y10 is not H; and — represents an attachment point to the rest of Z1c.

106. The compound of any one of embodiments 101-105, wherein the compound comprises at least one group selected from $B_1$, $B_2$, $B_3$, $B_4$, $B_5$ and $B_6$, each independently selected from:

(F7A)

(F8A)

3043

-continued (F11)

wherein for B$_1$, B$_2$, and B$_3$:

R$_1$ at position 5' represents (C═O)—*, wherein —* represents the attachment point to the rest of Z1c; and each remaining R$_1$ or R$_2$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$)NH (CH$_2$)$_m$CH$_3$, and OCF$_3$, wherein m is 1, 2, 3, 4, 5, 6, or 7;

wherein for B$_4$ and B$_5$:

one R$_1$ for B$_4$ represents (CH$_2$)$_m$—ø, wherein —ø represents an attachment point to the rest of Z1$_c$ and one R$_1$ for B$_5$ represents (C═O)—*, S(═O)(═O)—*, (CH$_2$)$_m$(C═O)—*, or (CH$_2$)$_m$—*, wherein —* represents an attachment point to the rest of Z1$_c$, and m is 1, 2, 3, 4, 5, 6, or 7; and each remaining R$_1$ or R$_2$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$)NH (CH$_2$)$_m$CH$_3$, and OCF$_3$, wherein m is 1, 2, 3, 4, 5, 6, or 7;

wherein for B$_6$:

one R$_1$ for B$_6$ represents (CH$_2$)$_m$—ø, wherein —ø represents an attachment point to the rest of the compound, and m is 1, 2, 3, 4, 5, 6, or 7; and each remaining R$_1$ or R$_2$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$)NH (CH$_2$)$_m$CH$_3$, and OCF$_3$, wherein m is 1, 2, 3, 4, 5, 6, or 7;

wherein for Formula F7A:

Y8 is O; and wherein for Formula F8A:

Y8 is O; and i is 1, 2, 3, 4, or 5; and

— represents an attachment point to the rest of Z1c.

107. The compound of any one of embodiments 101-106, wherein the B$_1$, B$_2$ B$_3$, B$_4$, B$_5$ and B$_6$ are each independently Formula F7A, (F7A)

3044 wherein for B$_1$, B$_2$, and B$_3$:

R$_1$ at position 5' represents (C═O)—*, wherein —* represents the attachment point to the rest of Z1c; and each remaining R$_1$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$) NH(CH$_2$)$_m$CH$_3$, and OCF$_3$, wherein m is 1, 2, 3, 4, 5, 6, or 7;

wherein for B$_4$ and B$_5$:

one R$_1$ for B$_4$ represents (CH$_2$)$_m$—ø, wherein —ø represents an attachment point to the rest of Z1$_c$ and one R$_1$ for B$_5$ represents (C═O)—*, S(═O)(═O)—*, (CH$_2$)$_m$(C═O)—*, or (CH$_2$)$_m$—*, wherein —* represents an attachment point to the rest of Z1$_c$, and m is 1, 2, 3, 4, 5, 6, or 7; and each remaining R$_1$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$) NH(CH$_2$)$_m$CH$_3$, and OCF$_3$, wherein m is 1, 2, 3, 4, 5, 6, or 7;

wherein for B$_6$:

one R$_1$ for B$_6$ represents (CH$_2$)$_m$—ø, wherein —ø represents an attachment point to the rest of the compound, and m is 1, 2, 3, 4, 5, 6, or 7; and each remaining R$_1$ is independently selected from H, F, Cl, Br, OH, CH$_2$—NH$_2$, NH$_2$, (C═O)—NH$_2$, CH═O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH—CH$_3$, —(SO$_2$) NH(CH$_2$)$_m$CH$_3$, and OCF$_3$, wherein m is 1, 2, 3, 4, 5, 6, or 7;

Y8 is O; and

— represents an attachment point to the rest of Z1c.

108. The compound of any one of embodiments 101-107, wherein at least one Z1c is covalently conjugated indirectly via a linker to an amine of X1 or to NH$_2$ when X1 is NH$_2$ or to OH when X1 is OH or to an amine of Z1a, wherein the linker is represented by Formula (X")$_{n1}$, wherein each n1 is independently selected from 1, 2, 3, 4, and 5, and each X" is independently selected from:

a) an L- or D-amino acid, wherein an amine functional group of the L- or D-amino acid is covalently conjugated, directly or indirectly, to Z1c and an acid functional group of the L- or D- amino acid is conjugated, directly or indirectly, to X1 or to Z1a; and b) Formulae FL(IA), FL(IB), FL69, and FL70; wherein Formula FL(IA) and FL(IB) are:

FL(IA)

FL(IB)

and stereoisomers thereof;

wherein:

G is selected from a 3- to 6-membered cycloalkyl group, a 3- to 10-membered heterocyclyl group, a heteroaryl group, and an aryl group, wherein each group is optionally substituted with 1-3 groups independently selected from hydroxy, amino, halogen, cycloalkyl, alkoxy, and alkyl;

E is absent or is an alkylene group optionally substituted with 1-3 groups independently selected from halogen, hydroxy, and amino;

Q is absent or is selected from hydrogen, alkyl, halo, cyano, alkoxy, carboxylic acid, amino, hydroxy, amide, halo alkyl, cycloalkyl, heterocycle, heteroaryl, and aryl, wherein the alkyl, alkoxy, cycloalkyl, heterocycle, heteroaryl, and aryl is each optionally substituted with 1-5 groups independently selected from alkyl, amino, amide, halo, hydroxy, cyano, halo alkyl, and alkoxy;

Q' is selected from hydrogen, alkyl, and an acyl group;

Q and Q', together with the carbon and nitrogen atom to which they are attached, optionally form a 4-membered heterocyclyl, a 5-membered heterocyclyl, a 6-membered heterocyclyl, a 9-membered bicyclic heterocyclyl, or a 10-membered bicyclic heterocyclyl, wherein the 4-membered heterocyclyl, 5-membered heterocyclyl, 6-membered heterocyclyl, 9-membered bicyclic heterocyclyl, and 10-membered bicyclic heterocyclyl are each optionally substituted with 1-5 groups independently selected from alkyl, amino, halo, hydroxy, cyano, amide, halo alkyl, and alkoxy;

p is 0, 1, 2, 3, 4, or 5;

q is 0, 1, 2, 3, 4, or 5;

R" represents a covalent bond, directly or indirectly, to Z1c;

Z" represents a covalent bond, directly or indirectly, to X1 or to Z1a; and any primary amine is optionally acetylated or alkylated; wherein Formulae FL69 and FL70 are:

FL69

FL70 and stereoisomers thereof;

wherein:

R" represents a covalent bond, directly or indirectly, to Z1c;

Z" represents a covalent bond, directly or indirectly, to X1 or to Z1a;

A' is selected from H, an alkyl, a saturated fatty acid, an unsaturated fatty acid, a cycloalkyl, a haloalkyl, an aryl, and a heteroaryl; and A" is (i) a bile acid conjugated, directly or indirectly, via its acid group to the amine in FL69 or FL70; or (ii) a $C_2$-$C_{20}$ acyl group optionally terminating in an acid group, wherein one or more carbon atoms of the $C_2$-$C_{20}$ acyl group are optionally and independently replaced by a group selected from C(=O), O, NH, $NH_2$, S, S(O), $SO_2$, phenyl, 5-membered heterocyclyl, 6-membered heterocyclyl, 5-membered heteroaryl, 6-membered heteroaryl, and wherein the one or more carbon atoms of the $C_2$-$C_{20}$ acyl group, NH, $NH_2$, $SO_2$, phenyl, 5-membered heterocyclyl, 6-membered heterocyclyl, 5-membered heteroaryl, and 6-membered heteroaryl is each independently substituted with 0, 1, 2, 3, or 4 $R_x$, wherein $R_x$ is selected from $C_1$-$C_5$ alkyl, halogen, $C_1$-$C_5$ haloalkyl, carboxylic acid, hydroxyl, —O—$C_1$-$C_5$ alkyl, $NH_2$, and a substituted or unsubstituted 5-membered heterocyclyl, 6-membered heterocyclyl, 5-membered heteroaryl, and 6-membered heteroaryl;

p is 1, 2, 3, 4, or 5, q is 1, 2, 3, 4, or 5, and any primary amine is optionally acetylated or alkylated.

109. The compound of embodiment 108, wherein each A" is independently selected from:

AB-1

AB-2

AB-3

AB-4

AB-5

AB-6

AB-7

AB-8

3047

-continued

AB-9

AB-10

AB-11

AB-12

AB-13

AB-14

AB-15

AB-16

AB-17

AB-18

3048

-continued

AB-19

AB-20

AB-21

AB-22

AB-23

AB-24

AB-25

AB-26

AB-27

5

10

15

20

25

30

35

40

45

50

55

60

65

3049

-continued

AB-28

AB-29

AB-30

AB-31

AB-32

AB-33

AB-34

COOH, and

3050

-continued

AB-35

110. The compound of embodiment 102, wherein the compound comprises at least one Z1b selected from Formulae IIa-IIai and Formulae IIIa-IIIai, wherein Formulae IIa-IIai are:

Formula IIa

Formula IIb

Formula IIc

Formula IId

Formula IIe

Formula IIf

Formula IIg

Formula IIh

Formula IIi

Formula IIj

Formula IIk

3051

-continued

Formula Ill

Formula IIm

Formula IIn

Formula IIo

Formula IIp

Formula IIq

Formula IIr

Formula IIs

Formula IIt

Formula IIu

Formula IIv

Formula IIw

Formula IIx

Formula IIy

3052

-continued

Formula IIz

Formula IIaa

Formula IIab

Formula IIac

Formula IIad

Formula IIae

Formula IIaf

Formula IIag

Formula IIah

Formula IIai wherein:

r is 0, 1, 2, 3, 4, or 5;

s is 0, 1, 2, 3, 4, or 5;

W represents $CH_2$——~ or (C=O)——~, wherein ——~ is a covalent linkage to X1; and each $V_1$ is independently selected from NH—†, $CH_2$—†, and (C=O)—† and each $V_2$ is N—†, wherein —† is a covalent linkage towards successive Z1b, Z1a or Z1c, provided that $V_1$ is NH—† when connected to Z1c; and the covalent linkages between Z1a and Z1b units each independently comprise an amine linkage

3053 or an amide linkage; and when n'=0 and m'=1, Z1a is directly conjugated to X1 by an amine linkage or amide linkage, and wherein Formulae IIIa-IIIai are:

Formula IIIa

Formula IIIb

Formula IIIc

Formula IIId

Formula IIIe

Formula IIIf

Formula IIIg

Formula IIIh

Formula IIIi

Formula IIIj

Formula IIIk

Formula IIIl

3054

-continued

Formula IIIm

Formula IIIn

Formula IIIo

Formula IIIp

Formula IIIq

Formula IIIr

Formula IIIs

Formula IIIt

Formula IIIu

Formula IIIv

Formula IIIw

Formula IIIx

Formula IIIy

Formula IIIz

-continued

Formula IIIaa

Formula IIIab

Formula IIIac

Formula IIIad

Formula IIIae

Formula IIIaf

-continued

Formula IIIag

Formula IIIah and

Formula IIIai wherein:

r is 1, 2, 3, 4, or 5;

s is 1, 2, 3, 4, or 5; and each $V_1$ is independently selected from NH—†, $CH_2$—†, and (C=O)—† and each $V_2$ is N—†, wherein —† is a covalent linkage towards successive Z1b, Z1a or Z1c, provided that $V_1$ is NH—† when connected to Z1c; and the covalent linkages between Z1a and Z1b units each independently comprise an amine linkage or an amide linkage; and when n'=0 and m'=1, Z1a is directly conjugated to X1 by an amine linkage or amide linkage.

111. The compound of embodiment 101 or 102, wherein the at least one Z1c is covalently conjugated indirectly via a linker selected from (i) Formulae FL1-FL19:

(FL1)

(FL2)

(FL3)

(FL4)

(FL4A)

(FL5)

(FL6)

(FL7)

(FL7A)

(FL8)

-continued (FL9)

(FL8A)

(FL9A)

(FL10)

(FL11)

(FL12)

(FL13)

(FL14)

(FL15)

(FL16)

(FL17)

(FL18) and (FL19)

wherein, in Formulae FL1 to FL19:

Z" represents an attachment point toward X1;

R" represents an attachment point toward Z1c;

p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group directly conjugated to Z1c, wherein an acid functional group of the amino acid is conjugated toward X1.

112. The compound of embodiment 102, wherein n' is 1 and each of the Z1b is independently selected from (i) Formulae FL1-FL19:

(FL1)

(FL2)

(FL3)

(FL4)

(FL4A)

(FL5)

(FL6)

(FL7)

(FL7A)

(FL8)

(FL9)

(FL8A)

(FL9A)

(FL10)

(FL11)

(FL12)

(FL13)

(FL14)

(FL15)

-continued (FL16)

(FL17)

(FL18)

(FL19)

wherein, in Formulae FL1 to FL19:

Z" represents an attachment point toward X1;

R" represents an attachment point toward Z1c p is 1, 2, 3, 4, or 5, q is 1, 2, 3, 4, or 5, r is 1, 2, 3, 4, or 5; and any primary amine is optionally acetylated or alkylated; and (ii) an L- or D-amino acid comprising at least one amine group-directly conjugated to Z1c, wherein an acid functional group of the amino acid is conjugated toward X1.

113. The compound of embodiment 101 or 102, wherein the compound comprises a drug substance comprising a human polypeptide hormone of the human pancreas, insulin, glucagon, GLP-1, a somatostatin, a gastric inhibitory polypeptide, a glucose-dependent insulinotropic polypeptide, a hybrid peptide comprising sequences from two or more human polypeptide hormones, or an analogue thereof.

114. The compound of embodiment 101 or 102, wherein:

X1 comprises human insulin or a human insulin analogue comprising an A-chain and a B-chain, wherein the A-chain comprises a sequence selected from SEQ ID NOs 1 and 3 to 33, and the B-chain comprises a sequence selected from SEQ ID NOs 2 and 34 to 74, 24047, and 24048;

each Z1c is independently selected from FF1, FF10, FF12, FF14, FF15, FF114, FF115, FF116, FF163, FF193, FF194, FF203, FF221, FF231 and covalently conjugated either directly, or indirectly via the linker, to Z1a and/or Z1b, or to X1;

each Z1a is independently absent or independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKGSTK (SEQ ID NO:13205), GKHENK (SEQ ID NO:13271), GKNSHK (SEQ ID NO:13982), GKNSTK (SEQ ID NO:13989), GKQSSK (SEQ ID NO:14380), GKYQFK (SEQ ID NO:15128), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042);

each said linker is selected from FL1, FL3, FL4, and FL5;

each m' is independently 0 or 1;

each n' is independently 0, 1, 2, or 3;

each o' is independently 1, 2, 3, 4, or 5;

each p' is 1, 2, 3, 4, or 5; and q' is 1, 2, 3, or 4, wherein when any of n', o', p', or q' is 2 or more, the corresponding groups Z1a, Z1b, and Z1c are independently selected and may be the same or different; and wherein each Z1c is independently covalently conjugated, directly or indirectly, to an amine of Z1a, to an amine of Z1b, or to X1.

115. The compound of embodiment 113 or 114, wherein:

X1 comprises the human insulin or human insulin analogue comprising an A-chain and a B-chain, wherein the A-chain comprises SEQ ID NO:1; and the B-chain is selected from SEQ ID NOs 2, 36, 24047, and 24048;

each Z1c is independently selected from FF1, FF10, FF12, FF14, FF15, FF114, FF115, FF116, FF193, FF194, FF203, and FF221-FF231 and covalently conjugated either directly, or indirectly via the linker, to Z1a and/or Z1b, or to X1;

each Z1a independently comprises a sequence selected from K, GK, KGSH (SEQ ID NO:24049), KGSHK (SEQ ID NO:4238), KNSTK (SEQ ID NO:5085), GKASHK (SEQ ID NO:12414), GKEEEK (SEQ ID NO:12677), GKEEHK (SEQ ID NO:12680), GKGHSK (SEQ ID NO:13120), GKGSH (SEQ ID NO:24050), GKGSHK (SEQ ID NO:13198), GKGSTK (SEQ ID NO:13205), GKHENK (SEQ ID NO:13271), GKNSHK (SEQ ID NO:13982), GKNSTK (SEQ ID NO:13989), GKQSSK (SEQ ID NO:14380), GKYQFK (SEQ ID NO:15128), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042);

each said linker is independently absent or independently selected from FL3 and FL5;

each m' is independently 0 or 1;

each n' is independently 0 or 2;

each o' is independently 1, 2, or 3;

each p' is 1, 2, or 3; and q' is 1, 2, or 3, wherein when any of n', o', p', or q' is 2 or more, the corresponding groups Z1a, Z1b, and Z1c are independently selected and may be the same or different;

wherein each Z1c is independently covalently conjugated, directly or indirectly, to an amine of Z1a, to an amine of Z1b, or to X1.

116. The compound of embodiment 101 or 102, wherein each of the Z1a is independently absent or independently comprises a sequence selected from K, GK, KGSH (SEQ ID NO:24049), GKGSH (SEQ ID NO:24050), KGSHK (SEQ ID NO:4238), and GKGSHK (SEQ ID NO:13198).

117. The compound of embodiment 101 or 102, wherein each of the Z1c is independently selected from FF1, FF10, FF12, FF14, FF15, FF114, FF115, FF116, and FF221-FF231, and wherein the $B_1$ and the $B_2$ are independently selected from Formulae F1 and F2.

118. The compound of embodiment 103, wherein the $B_1$ and the $B_2$ are independently selected from F2 and F7.

119. The compound of embodiment 103, wherein at least one $R_1$ in $B_1$ or $B_2$ is F or $CF_3$.

120. The compound of embodiment 111 or 112, wherein Z1b is independently absent, FL3, or FL5.

121. The compound of embodiment 101 or 102, wherein each of the Z1c is independently selected from FF10, FF12, FF116, FF221, FF222, and FF224-FF231.

122. The compound of embodiment 101 or 102, wherein:

each $B_1$ and $B_2$ is independently selected from F2 and F7 and is covalently conjugated to Z1c using an amide linkage, each Z1b is independently absent; FL3 wherein p is 1, 2, or 3; or FL5 wherein p is 2, 3, or 4;

each FF is independently selected from FF10, FF12, FF116, FF134, FF163, FF193, FF203, FF221, FF222 and FF224-FF231; wherein each FF12 and FF222 has either (S,R) or (S,S) stereochemistry;

each Z1c is conjugated either directly or indirectly through FL3 or FL5 to the amine group in one or more lysine side chain in X1 or the N-terminus in X1; and X1 is a polypeptide drug substance and/or an insulin optionally having from 0 to 4 residues replaced, inserted, or mutated to lysines, and wherein the lysines are each conjugated directly or indirectly to a Z1c.

123. The compound of embodiment 101 or 102, wherein Z1c is FF224, n' is 0, and Z1a is an amine containing amino acid.

124. The compound of any one of embodiments 101-123, wherein the compound is selected from:

$$\left[[Z1c]_{p'}\!-\!\!\left[Z1a\!\frac{}{}\!\right]_{m'}\!\right]_{q'}\!\!-\!X1; \tag{IA}$$

$$\left[[Z1c]_{p'}\!-\!\!\left[Z1b\!\frac{}{}\!\right]_{n'}\!\right]_{q'}\!\!-\!X1; \quad \text{and} \tag{IB}$$

$$\left[[Z1c]_{p'}\!\frac{}{}\!\right]_{q'}\!\!-\!X1. \tag{IC}$$

125. The compound of any one of embodiments 101-123, wherein the compound is selected from:

$$\left[[Z1c]_1\!\frac{}{}\!\right]_1\!\!-\!X1; \quad \left[[Z1c]_1\!\frac{}{}\!\right]_2\!\!-\!X1; \quad \left[[Z1c]_1\!\frac{}{}\!\right]_3\!\!-\!X1; \quad \left[[Z1c]_1\!\frac{}{}\!\right]_4\!\!-\!X1;$$

$$\left[[Z1c]_1\!\frac{}{}\!\right]_5\!\!-\!X1; \quad \left[[Z1c]_2\!-\!\![Z1a]_1\!\frac{}{}\!\right]_2\!\!-\!X1;$$

$$\left[[Z1c]_2\!-\!\![Z1a]_1\!\frac{}{}\!\right]_2\!\!-\!X1\!-\!\!\left[[Z1c]_1\right]_1;$$

$$\left[[Z1c]_2\!-\!\![Z1a]_1\!\frac{}{}\!\right]_2\!\!-\!X1\!-\!\!\left[[Z1c]_1\right]_2;$$

$$\left[[Z1c]_2\!-\!\![Z1a\!\frac{}{}\!\frac{}{}\!Z1b]_1\!\frac{}{}\!\right]_1\!\!-\!X1;$$

-continued $$\left[[Z1c]_2\!-\!\![Z1a]_1\!-\!\![Z1b]_1\!\frac{}{}\!\right]_1\!\!-\!X1\!-\!\!\left[[Z1c]_1\right]_1;$$

$$\left[[Z1c]_1\!-\!\![Z1b]_1\!\frac{}{}\!\right]_1\!\!-\!X1; \quad \left[[Z1c]_2\!-\!\![Z1a]_1\!\frac{}{}\!\right]_1\!\!-\!X1\!-\!\!\left[[Z1c]_1\right]_1;$$

$$\left[[Z1c]_2\!-\!\![Z1a]_1\!\frac{}{}\!\right]_1\!\!-\!X1\!-\!\!\left[[Z1c]_1\right]_2; \quad \text{and}$$

$$\left[[Z1c]_2\!-\!\![Z1a]_1\!\frac{}{}\!\right]_1\!\!-\!X1\!-\!\!\left[[Z1c]_1\right]_2.$$

126. The compound of embodiment 125, wherein the compound is selected from $$\left[\left[Z1c\!\frac{}{}\!\right]_2\!(Z1a\!\frac{}{}\!)_1\!\!-\!X1\!-\!\!\left[Z1c\right]_1\right]_1 \quad \text{and} \quad \left[\left[Z1c\!\frac{}{}\!\right]_1\!\!-\!X1.\right]_1$$

127. The compound of embodiment 111 or 112; wherein Z1c is covalently conjugated directly to X1 via a linker, and wherein the linker is independently selected from gamma-glutamic acid, beta-alanine, and Formula FL3

$$\tag{FL3}$$

[chemical structure diagram]

wherein p is 1, 2, or 3; and

Formula FL5

$$\tag{FL5}$$

[chemical structure diagram]

wherein p is 2, 3, or 4.

128. The compound of embodiment 101 or 102, wherein X1 is OH or $NH_2$, and the compound further comprises a drug substance covalently conjugated directly or indirectly to the compound.

129. The compound of embodiment 101 or 102, wherein the compound is selected from:

3065 3066

Example 881

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 882

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

-continued

Example 883

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 884

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

-continued

Example 885

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 886

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH 3071           3072

-continued

H—G—K—P—G—G—G—G—S—G—G—G—G—S—G—G—G—G—S—F—V—N—Q—H—L—

Example 887

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 888

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

-continued

Example 889

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

890

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

-continued

891

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 892

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

-continued

Example 893

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 894

H—G—K—P—G—G—G—S—G—G—G—G—S—G—G—G—G—S—F—V—N—Q—H—L—

-continued

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 895

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 896

H—G—K—P—G—G—G—G—S—G—G—G—G—S—G—G—G—G—S—F—V—N—Q—H—L—

-continued

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 897

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH,

Example 898

H—G—K—P—G—G—G—G—S—G—G—G—G—S—G—G—G—G—S—F—V—N—Q—H—L—

-continued

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 899

H—G—K—P—G—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 900

H—G—K—P—G—G—G—G—S—G—G—G—G—S—G—G—G—G—S—F—V—N—Q—H—L—

-continued

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 901

H—G—K—P—G—G—G—S—G—G—G—G—S—G—G—G—G—S—F—V—N—Q—H—L—

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 902

H—G—K—P—G—G—G—S—G—G—G—G—S—G—G—G—G—S—F—V—N—Q—H—L—

-continued

H—G—I—V—E—Q—C—C—T—S—I—C—S—L—Y—Q—L—E—N—Y—C—N—OH

—C—G—S—H—L—V—E—A—L—Y—L—V—C—G—D—R—G—F—F—Y—T—P—K—OH

Example 903

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 904

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 905

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

-continued

Example 906

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 907

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 908

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 909

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

3091  3092

-continued

Example 910

H-G-I-V-E-Q-C-C-T-S-I-C-S-L-Y-Q-L-E-N-Y-C-N-OH
H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

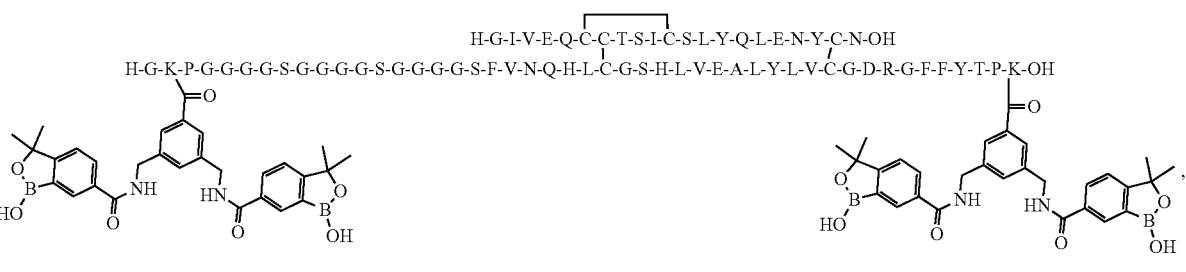

Example 911

H-G-I-V-E-Q-C-C-T-S-I-C-S-L-Y-Q-L-E-N-Y-C-N-OH
H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

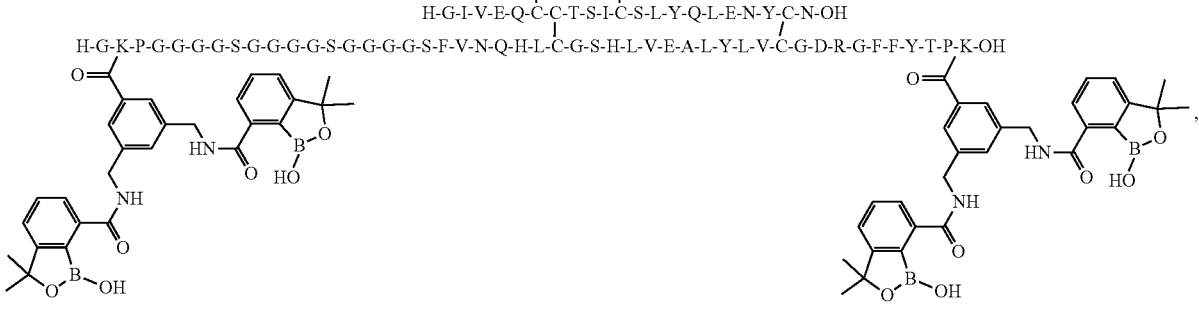

Example 912

H-G-I-V-E-Q-C-C-T-S-I-C-S-L-Y-Q-L-E-N-Y-C-N-OH
H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 913

H-G-I-V-E-Q-C-C-T-S-I-C-S-L-Y-Q-L-E-N-Y-C-N-OH
H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

Example 914

H-G-I-V-E-Q-C-C-T-S-I-C-S-L-Y-Q-L-E-N-Y-C-N-OH
H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

-continued

Example 915

H-G-I-V-E-Q-C-C-T-S-I-C-S-L-Y-Q-L-E-N-Y-C-N-OH

H-G-K-P-G-G-G-G-S-G-G-G-G-S-G-G-G-G-S-F-V-N-Q-H-L-C-G-S-H-L-V-E-A-L-Y-L-V-C-G-D-R-G-F-F-Y-T-P-K-OH

130. The compound of embodiment 101 or 102, wherein X1 is a polypeptide drug substance and/or an insulin optionally having from 0 to 4 residues replaced, inserted, or mutated to lysines, and wherein the lysines are each conjugated to a Z1c.

131. The compound of embodiment 101 or 102, wherein one or more amines are each independently acetylated and/or independently alkylated.

132. The compound of embodiment 101 or 102, wherein wherein X1 comprises a polypeptide drug substance and the covalent conjugation to X1 is to amino group(s) in one or more lysine residues and/or to the N-terminal amino groups in X1.

133. The compound of embodiment 101 or 102, wherein each $R_1$ is independently selected from a $C_1$-$C_{22}$ alkyl group, a $C_1$-$C_{22}$ acyl group, a $(C_3$-$C_8)$cycloalkyl group, a $C_1$-$C_{22}$ haloalkyl group, an aryl group, and a heteroaryl group, each $R_1$ optionally comprises one or more $C_1$-$C_{22}$ alkyl-halide, halide, sulfhydryl, aldehyde, amine, acid, hydroxyl, $C_1$-$C_{22}$ alkyl, or aryl groups.

134. The compound of embodiment 101 or 102, wherein X4 is selected from —COOH, —$(CH_2)_m$COOH, a $C_1$-$C_{22}$ alkyl group, a $C_1$-$C_{22}$acyl group, a $(C_3$-$C_8)$cycloalkyl group, a $C_1$-$C_{22}$ haloalkyl group, an aryl group, and a heteroaryl group, each X4 optionally comprises one or more $C_1$-$C_{22}$ alkyl-halide, halide, sulfhydryl, aldehyde, amine, acid, hydroxyl, $C_1$-$C_{22}$ alkyl, or aryl groups; wherein m is 1, 2, 3, 4, or 5.

135. The compound of embodiment 103, wherein the alkyl group of Y9 is a $C_1$-$C_{22}$ alkyl.

136. The compound of embodiment 135, wherein Y9 is $CH_3$.

137. The compound of embodiment 101, wherein the at least one primary or secondary amine in FF1-FF223 and FF225-FF231 is covalently conjugated to B6.

138. The compound of embodiment 101 or 102, wherein an amine in the compound is conjugated via an amide linkage to an aromatic boron-containing group.

139. The compound of embodiment 138, wherein the aromatic boron-containing group is selected from a phenylboronic acid, boroxole, and phenylboronate.

140. The compound of any one of embodiments 101-139, wherein the compound is formulated in a solution comprising one or more of a buffer, stabilizer, vasodilator, preservative, surfactant, salt, sugar, or compounds containing one or more hydroxyls, alcohols, diols, or phenols.

141. The compound of embodiment 140, wherein the solution comprises one or more of citrate, zinc, and/or cresol.

142. The compound of embodiment 101 or 102, wherein Z1c is conjugated to a cysteine.

143. The compound of embodiment 101 or 102, wherein the compound is covalently conjugated either directly or through a linker to a diol, sugar, carbohydrate or a diol containing molecule.

144. The compound of embodiment 101 or 102, wherein the compound is covalently conjugated to an antibody, albumin or a fragment thereof, or covalently conjugated either directly or through a linker to a molecule that can bind to at least one protein present in human plasma.

145. The compound of any one of embodiments 101-144, wherein the compound comprises at least one Z1c selected from:

(FF1)

(FF2)

(FF6)

(FF9)

(FF10)

3095

-continued (FF11)

(FF12)

(FF13)

(FF14)

(FF16)

(FF17)

(FF18)

(FF35)

5

10

15

20

25

30

35

40

45

50

55

60

65

3096

-continued (FF56)

(FF57)

(FF58)

(FF59)

(FF61)

(FF60)

(FF62)

(FF65)

(FF66)

3097

-continued (FF67)

(FF70)

(FF71)

(FF72)

(FF75)

(FF76)

(FF77)

5

10

15

20

25

30

35

40

45

50

55

60

65

3098

-continued (FF80)

(FF81)

(FF84)

(FF88)

(FF92)

(FF101)

3099

-continued (FF102)

(FF107)

(FF108)

(FF109)

(FF110)

5

10

15

20

25

30

35

40

45

50

55

60

65

3100

-continued (FF111)

(FF112)

(FF113)

(FF114)

(FF115)

(FF116)

3101

-continued (FF117)

5

(FF118)

10

(FF119) 20

(FF120)

30

(FF121)

40

(FF122) 45

(FF123)

55

60

65

3102

-continued (FF124)

(FF125)

(FF126)

(FF127)

(FF128)

(FF129)

(FF130)

-continued (FF131)

(FF132)

(FF133)

(FF134)

(FF135)

(FF136)

FF193

-continued

FF194

FF203

(FF225)

(FF226)

(FF227)

(FF228)

(FF229)

-continued (FF230)

(FF231)

146. The compound of embodiment 145, wherein the compound comprises at least one Z1c having at least one chiral center and selected from FF1, FF2, FF5, FF9, FF11-FF13, FF15-FF24, FF27, FF31, FF34-FF36, FF38, FF39, FF43-FF58, FF60-FF70, FF72-FF75, FF77-FF80, FF82-FF84, FF86-FF212, FF216-FF220, FF222, FF223, and combinations thereof.

147. The compound of embodiment 146, wherein the compound comprises at least one FF12 and/or FF116; and
  wherein the stereochemistry of FF12 and FF116 is independently selected from (S,S); (S,R); (R,R); and (R,S).

148. The compound of embodiment 101 or 102, wherein X1 comprises human insulin or a human insulin analogue comprising an A-chain and a B-chain, wherein the C-terminus of the A-chain of the human insulin analogue is optionally extended with a polypeptide of up to 20 residues, and/or the N-terminus of the B-chain of the human insulin analogue is optionally extended with a polypeptide of up to 10 residues.

149. The compound of embodiment 148, wherein X1 comprises at least one lysine having an amine side chain, and Z1c is covalently conjugated directly to the amine side chain.

150. The compound of embodiment 101 or 102, wherein X1 comprises a drug substance covalently conjugated to at least one Z1c through an acid containing linker.

151. A composition or a mixture comprising at least one compound of any one of embodiments 101-150, for use as a medicament for the treatment of diabetes, for control of blood sugar levels, or to control the release of a drug based on physiological levels of diol containing small molecules or sugars.

152. A method of administering the compound of any one of embodiments 101-150 to a human subject as a therapeutic or prophylactic agent.

153. A method of making a compound of any one of embodiments 101-150, wherein the method comprises at least one alkylation and/or amidation step.

154. A method of treating a subject by administering a device or formulation comprising a compound of any one of embodiments 101-150 and Examples 881-915.

155. A method of treatment or prevention of diabetes, impaired glucose tolerance, hyperglycemia, or metabolic syndrome, wherein the method comprises administering to a subject in need thereof a therapeutically effective amount of the compound of any one of embodiments 101-150 or the composition or the mixture of embodiment 151.

156. A compound selected from Formulae FF1-FF231:
  wherein Formulae FF1-FF48 are:

(FF1)

(FF2)

(FF3)

(FF4)

(FF5)

(FF6)

(FF7)

3107

-continued (FF8)

(FF9)

(FF10)

(FF11)

(FF12)

(FF13)

(FF14)

3108

-continued (FF15)

(FF16)

(FF17)

(FF18)

(FF19)

(FF20)

(FF21)

3109

-continued (FF22)

(FF23)

(FF24)

(FF25)

(FF26)

(FF27)

(FF28)

3110

-continued (FF29)

(FF30)

(FF31)

(FF32)

(FF33)

(FF34)

(FF35)

(FF36)

5

10

15

20

25

30

35

40

45

50

55

60

65

-continued (FF37)

(FF38)

(FF39)

(FF40)

(FF41)

(FF42)

(FF43)

(FF44)

(FF45)

-continued (FF46)

(FF47)

and (FF48)

wherein X is selected from an maleimide, amine, OH, and halogen; and i is 1, 2, 3, 4, 5, 6, or 7;

j is 1, 2, 3, 4, 5, 6, or 7; and $B_1$ and $B_2$, which may be identical or different, each independently represents an aromatic boron-containing group; and wherein Formulae FF49-FF88 are:

(FF49)

(FF50)

(FF51)

(FF52)

(FF53)

-continued (FF54)

(FF55)

(FF56)

(FF57)

(FF58)

(FF59)

(FF60)

(FF61)

(FF62)

-continued (FF63)

(FF64)

(FF65)

(FF66)

(FF67)

(FF68)

(FF69)

3115

-continued (FF70)

(FF71)

(FF72)

(FF73)

(FF74)

(FF75)

(FF76)

3116

-continued (FF77)

(FF78)

(FF79)

(FF80)

(FF81)

(FF82)

3117

-continued (FF83)

(FF84)

(FF85)

(FF86)

(FF87)

and (FF88)

wherein X is selected from maleimide, an amine, OH, and halogen;

i is 1, 2, 3, 4, 5, 6, or 7;

3118 j is 1, 2, 3, 4, 5, 6, or 7;

R₁a is selected from COOH, CH₃, H, and OH;

R₂, R₃, R₄ and R₅ is each independently selected from CH₃, H, OH, and COOH, and at least one of R₂, R₃, R₄ and R₅ is CH₃ or OH; and B₁ and B₂, which may be identical or different, are each independently an aromatic boron-containing group; and wherein Formulae FF89-FF112 are:

(FF89)

(FF90)

(FF91)

(FF92)

-continued (FF93)

(FF94)

(FF95)

(FF96)

(FF97)

(FF98)

-continued (FF99)

(FF100)

(FF101)

(FF102)

(FF103)

-continued (FF104)

(FF105)

(FF106)

(FF107)

(FF108)

-continued (FF109)

(FF110)

(FF111)

and (FF112)

wherein X is selected from maleimide, an amine, OH, and halogen;

i is 1, 2, 3, 4, 5, 6, or 7; and $B_1$, $B_2$ and $B_3$, which may be identical or different, each independently represents an aromatic boron-containing group, a carboxylic acid derivative, or a H, wherein at least two of B1, B2 and B3 in each FF structure are independently an aromatic boron-containing group; and

3123 wherein Formulae FF113-FF136 are:

(FF113)

(FF114)

(FF115)

(FF116)

(FF117)

(FF118)

(FF119)

3124

(FF120)

(FF121)

(FF122)

(FF123)

(FF124)

(FF125)

(FF126)

3125

-continued (FF127)

(FF128)

(FF129)

(FF130)

(FF131)

(FF132)

3126

-continued (FF133)

(FF134)

(FF135)

and (FF136)

wherein X is selected from maleimide, an amine, OH, and halogen;

i is 1, 2, 3, 4, 5, 6, or 7;

j is 1, 2, 3, 4, 5, 6, or 7 k is 1, 2, 3, 4, 5, 6, or 7;

m is 1, 2, 3, 4, 5, 6, or 7;

each $R_1$ is independently selected from H, an alkyl group, an acyl group, a cycloalkyl group, a haloalkyl group, an aryl group, and a heteroaryl group, each $R_1$ optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group; and wherein Formulae FF137-FF160 are:

(FF137)

3127

-continued (FF138)

(FF139)

(FF140)

(FF141)

(FF142)

(FF143)

(FF144)

3128

-continued (FF145)

(FF146)

(FF147)

(FF148)

(FF149)

(FF150)

(FF151)

3129

-continued (FF152)

(FF153)

(FF154)

(FF155)

(FF156)

(FF157)

3130

-continued (FF158)

(FF159)

and (FF160)

wherein X is selected from maleimide, an amine, OH, and halogen;

i is 1, 2, 3, 4, 5, 6, or 7;

j is 1, 2, 3, 4, 5, 6, or 7;

k is 1, 2, 3, 4, 5, 6, or 7;

m is 1, 2, 3, 4, 5, 6, or 7;

each $R_1$ is independently selected from H, an alkyl group, an acyl group, a cycloalkyl group, a haloalkyl group, an aryl group, and a heteroaryl group, each, R optionally comprises one or more alkyl-halide, halide, sulfhydryl, aldehyde, amine, acid, hydroxyl, alkyl or aryl groups; and $B_1$ and $B_2$, which may be identical or different, each independently represents an aromatic boron-containing group; and wherein Formulae FF161-FF164 are:

(FF161)

(FF162)

-continued (FF163)

(FF164)

wherein X is selected from maleimide, an amine, OH, and halogen;

i is 1, 2, 3, 4, or 5;

j is 1, 2, 3, 4, or 5;

each $R_6$, $R_7$, $R_8$, and $R_9$ for different values of j is independently selected from H, $CF_3$, $CH_3$, $CHF_2$, and $(CH_2)_m CH_3$, wherein m is 1, 2, 3, 4, or 5;

Y3, Y4, Y5, Y6 and Y7 are each independently selected from H, $CH_2$—X4, and Formulae IV-1 to IV-135;

wherein X4 is selected from —COOH, —$(CH_2)_m$COOH, an alkyl group, an acyl group, a cycloalkyl group, a haloalkyl group, an aryl group, and a heteroaryl group, each optionally comprising one or more alkyl-halide, halide, sulfhydryl, aldehyde, amine, acid, hydroxyl, alkyl or aryl groups; wherein m is 1, 2, 3, 4, or 5;

wherein at least one of Y5, Y6, and Y7 in Formulae FF162 and FF163 is not H and at least one of Y7, $R_8$ and $R_9$ in FF164 is not H; and wherein Formulae IV-1 to IV-135 are:

(IV-1)

(IV-2)

(IV-3)

(IV-4)

-continued (IV-5)

(IV-6)

(IV-7)

(IV-8)

(IV-9)

(IV-10)

(IV-11)

(IV-12)

(IV-13)

(IV-14)

3133

-continued (IV-15)

(IV-16)

(IV-17)

(IV-18)

(IV-19)

(IV-20)

(IV-21)

(IV-22)

(IV-23)

(IV-24)

(IV-25)

3134

-continued (IV-26)

(IV-27)

(IV-28)

(IV-29)

(IV-30)

(IV-31)

(IV-32)

(IV-33)

(IV-34)

(IV-35)

(IV-36)

(IV-37)

(IV-38)

5

10

15

20

25

30

35

40

45

50

55

60

65

3135

-continued (IV-39)

(IV-40)

(IV-41)

(IV-42)

(IV-43)

(IV-44)

(IV-45)

(IV-46)

(IV-47)

(IV-48)

3136

-continued (IV-49)

(IV-50)

(IV-51)

(IV-52)

(IV-53)

(IV-54)

(IV-55)

(IV-56)

3137

-continued (IV-57)

5

10

(IV-58)

15

20

(IV-59)

25

30

(IV-60)

35

40

(IV-61)

45

50

(IV-62)

55

(IV-63) 60

65

3138

-continued (IV-64)

(IV-65)

(IV-66)

(IV-67)

(IV-68)

(IV-69)

3139

-continued (IV-70)

(IV-71)

(IV-72)

(IV-73)

(IV-74)

(IV-75)

(IV-76)

3140

-continued (IV-77)

(IV-78)

(IV-79)

(IV-80)

(IV-81)

(IV-82)

(IV-83)

(IV-84)

(IV-85)

3141

-continued (IV-86)

5

(IV-87)

10

(IV-88)

15

20

(IV-89)

25

(IV-90)

30

35

(IV-91)

40

(IV-92)

45

(IV-93)

50

55

(IV-94)

60

65

3142

-continued (IV-95)

(IV-96)

(IV-97)

(IV-98)

(IV-99)

(IV-100)

(IV-101)

(IV-102)

(IV-103)

3143

-continued (IV-104)

(IV-105)

(IV-106)

(IV-107)

(IV-108)

(IV-109)

3144

-continued (IV-110)

(IV-111)

(IV-112)

(IV-113)

(IV-114)

(IV-115)

(IV-116)

(IV-117)

(IV-118)

(IV-119)

3145

-continued (IV-120)

(IV-121)

(IV-122)

(IV-123)

(IV-124)

(IV-125)

(IV-126)

(IV-127)

5

10

15

20

25

30

35

40

45

50

55

60

65

3146

-continued (IV-128)

(IV-129)

(IV-130)

(IV-131)

(IV-132)

(IV-133)

(IV-134)

and (IV-135)

wherein:

Xa represents CH=O, CHF$_2$, CF$_3$, CH$_2$SH, COOH, CH$_2$OH, CH$_2$NO$_2$, CH$_2$NH$_2$, CH$_3$, C(CH$_3$)$_3$, CH(CH$_3$)$_2$, CH((CH$_2$)$_3$CH$_3$)$_2$, or CH(CH$_2$CH$_3$)$_2$;

Xb represents O, NH, CH$_2$, or S

Xc represents CH or N;

each R$_{10}$ is independently selected from H, F, Cl, Br, CH$_3$, CF$_3$, CH=O, OH, COOH, and (CH$_2$)$_n$CH$_3$, m is 1, 2, 3, 4, or 5; and n is 1, 2, 3, 4, or 5;

B$_1$ and B$_2$, which may be identical or different, each independently represents an aromatic boron-containing group; and

* in Formulae IV-1 to IV-135 represents the point of attachment to corresponding Formulae FF161-164; and wherein Formulae FF165-FF166 are:

(FF165)

and (FF166)

wherein X is selected from maleimide, an amine, OH, and halogen;

m is 1, 2, 3, 4, 5, 6, or 7;

n is 1, 2, 3, 4, 5, 6, or 7;

X5 is S, O, or NH; and each R$_1$ is independently selected from H, F, Cl, Br, OH, CH$_2$—NH$_2$, NH$_2$, (C=O)—NH$_2$, CH=O, SO$_2$CH$_3$, SO$_2$CF$_3$, CF$_3$, CHF$_2$, NO$_2$, CH$_3$, OCH$_3$, O(CH$_2$)$_m$CH$_3$, —(SO$_2$)NH CH$_3$, —(SO$_2$)NH(CH$_2$)$_m$CH$_3$, and OCF$_3$, wherein m is 1, 2, 3, 4, 5, 6, or 7; and wherein Formulae FF167-FF192 are:

(FF167)

(FF168)

(FF169)

(FF170)

(FF171)

(FF172)

(FF173)

(FF174)

(FF175)

3149

-continued (FF176)

(FF177)

10

(FF178)

20

(FF179)

30

35

(FF180)

40

45

(FF181)

50

55

(FF182)

60

65

3150

-continued (FF183)

(FF184)

(FF185)

(FF186)

(FF187)

(FF188)

(FF189)

-continued (FF190)

(FF191)

and (FF192)

wherein X is selected from an maleimide, amine, OH, and halogen;

B₁ and B₂, which may be identical or different, each independently represents an aromatic boron-containing group, and wherein Formulae FF193-FF209 are:

FF193

FF194

FF195

-continued

FF196

FF197

FF198

FF199

FF200

FF201

FF202

FF203

3153

-continued

FF204

FF205

FF206

FF207

FF208

FF209 wherein R in FF208 and FF209 is an alkyl, aryl or halide that is covalently conjugated through at least one $CH_2$ group to the amino group in the side chain of FF208 or FF209; $R_1$ and $R_2$ are independently selected from H, $CH_3$, alkyl, and formulae IV-1 to IV-135;

i is 1, 2, 3, 4, or 5;

j is 1, 2, 3, 4, or 5; and wherein X is selected from maleimide, an amine, OH, and halogen; and $B_1$ and $B_2$, which may be identical or different, each independently represents an aromatic boron-containing group;

3154 wherein Formulae FF210-FF224 are:

FF210

FF211

FF212

FF213

FF214

FF215

FF216

FF217

FF218

3155

-continued

FF219

FF220

FF221

FF222

FF223 and

FF224 wherein $R_{11}$ in FF210 to FF212 is independently selected from Formulae IV-1 to IV-135 and $R_{12}$ is selected from an amine, a hydroxyl, an alkyl, and a halide group;

wherein each $R_{13}$ is independently selected from H, $CH_3$, alkyl, aryl, and formulae IV-1 to IV-135; $R_{14}$ is selected from H, $CH_3$, alkyl, aryl, and heteroaryl;

wherein X is independently selected from maleimide, an amine, OH, and halogen;

X" is an amine;

i is 1, 2, 3, 4, or 5;

j is 1, 2, 3, 4, or 5;

and $B_1$, $B_2$, $B_3$, $B_4$, $B_5$ and $B_6$ each independently represents an aromatic boron-containing group, wherein in each FF structure containing B1, B2 and B3 groups, at least two of the B1, B2 and B3 groups are independently an aromatic boron-containing group; and

3156 wherein Formulae FF225-FF231 are:

(FF225)

(FF226)

(FF227)

(FF228)

(FF229)

(FF230)

3157

-continued (FF231)

wherein X is selected from an maleimide, amine, OH, and halogen;

i is 1, 2, 3, 4, 5, 6, or 7;

$B_1$ and $B_2$, which may be identical or different, each independently represents an aromatic boron-containing group, wherein $B_1$ and $B_2$ in Formulae FF225-FF231 are not a boronic acid or an F2 or F6 aromatic boron-containing group, wherein Formulae F2 and F6 are:

(F2)

and (F6)

$R_1$ at position 5' represents (C=O)—*, wherein —* represents the attachment point to the rest of FF225-FF231;

zero, one, or two $R_1$ represents F, Cl, $CF_2$, $CF_3$, $SF_5$, $OCF_3$, $SO_2CH_3$, and/or $SO_2CF_3$, and each remaining $R_1$ represents H;

Y8 is O; and i is 1; and each remaining $R_1$ is H;

Y8 is O; and i is 1; and wherein at least one primary or secondary amine in FF1-FF223 and FF225-FF231 is optionally covalently conjugated to $B_6$; and when X is an amine in any one of Formulae FF1 to FF223 and FF225-FF231, X is optionally acetylated or alkylated.

157. The compound of embodiment 156, wherein the compound comprises at least one of $B_1$, $B_2$ and $B_3$ independently selected from Formulae F1-F11 or wherein the compound comprises at least one of $B_4$, $B_5$ and $B_6$ independently selected from Formulae F1-F11,

3158 wherein Formulae F1-F11 are:

(F1)

(F2)

(F3)

(F4)

(F5)

(F6)

(F7)

-continued (F8)

(F9)

(F10)

and (F11)

wherein for $B_1$, $B_2$, $B_3$:

one $R_1$ represents (C=O)—*, S(=O)(=O)—*, $(CH_2)_m$(C=O)—*, or $(CH_2)_m$—*, wherein —* represents an attachment point to the rest of Z1c, and m is 1, 2, 3, 4, 5, 6, or 7;

each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7;

wherein for $B_4$, $B_5$:

one $R_1$ for $B_4$ represents $(CH_2)_m$—ø, wherein —ø represents the attachment point (representing a covalent bond) to an amine in X1 and one $R_1$ for $B_5$ represents (C=O)—*, S(=O)(=O)—*, $(CH_2)_m(C=O)$—*, or $(CH_2)_m$—*, wherein —* represents the attachment point to the same amine in X1, and m is 1, 2, 3, 4, 5, 6, or 7;

each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7;

wherein for $B_6$:

one $R_1$ for $B_6$ represents $(CH_2)_m$—ø, wherein —ø represents the attachment point (representing a covalent bond) to the rest of the compound, and m is 1, 2, 3, 4, 5, 6, or 7;

each remaining $R_1$ or $R_2$ is independently selected from H, F, Cl, Br, OH, $CH_2$—$NH_2$, $NH_2$, (C=O)—$NH_2$, CH=O, $SO_2CH_3$, $SO_2CF_3$, $CF_3$, $CHF_2$, $NO_2$, $CH_3$, $OCH_3$, $O(CH_2)_mCH_3$, —$(SO_2)NH$ $CH_3$, —$(SO_2)NH$ $(CH_2)_mCH_3$, and $OCF_3$, wherein m is 1, 2, 3, 4, 5, 6, or 7; for Formulae F3-F4:

$R_w$ is O or S;

for Formulae F5-F10:

when Y8 is O, i is 2, 3, 4, or 5; or when Y8 is NR, R is an alkyl group or H, and i is 1, 2, 3, 4, or 5;

Y9 is H, $CH_3$, or an alkyl group, provided that when Y8 is O, Y9 is a $CH_3$ or an alkyl group; and each Y10 is independently selected from H, $CH_3$, F, $CF_3$, and $OCH_3$, with the proviso that at least one Y10 is not H.

158. The compound of embodiment 156 or 157, wherein the compound is selected from:

N-(3-(3-borono-5-nitrobenzamido)propyl)-N-(3-borono-5-nitrobenzoyl)glycine (DS01);

N-(4-((4-(3-borono-5-nitrobenzamido)cyclohexyl)methyl) cyclohexyl)-N-(3-borono-5-nitrobenzoyl)glycine (DS02);

N-(4-((3-borono-5-nitrobenzamido)methyl)benzyl)-N-(3-borono-5-nitrobenzoyl)glycine (DS03);

N-(3-((3-borono-5-nitrobenzamido)methyl)benzyl)-N-(3-borono-5-nitrobenzoyl)glycine (DS04);

N-(4-(3-borono-5-nitrobenzamido)butyl)-N-(3-borono-5-nitrobenzoyl)glycine (DS05);

N-(3-(3-borono-5-fluorobenzamido)propyl)-N-(3-borono-5-fluorobenzoyl)glycine (DS06);

N-(3-(3-borono-5-fluorobenzamido)-2,2-dimethylpropyl)-N-(3-borono-5-fluorobenzoyl)glycine (DS07);

bis(3-(3-borono-5-fluorobenzamido)propyl)glycine (DS08);

N-(4-((3-borono-5-fluorobenzamido)methyl)benzyl)-N-(3-borono-5-fluorobenzoyl)glycine (DS09);

N-(3-((3-borono-5-fluorobenzamido)methyl)benzyl)-N-(3-borono-5-fluorobenzoyl)glycine (DS10);

N-(2-(3-borono-5-fluorobenzamido)cyclohexyl)-N-(3-borono-5-fluorobenzoyl)glycine (DS11);

N-(3-(3-borono-4-fluorobenzamido)propyl)-N-(3-borono-4-fluorobenzoyl)glycine (DS12);

N-(4-((4-(3-borono-4-fluorobenzamido)cyclohexyl)methyl) cyclohexyl)-N-(3-borono-4-fluorobenzoyl)glycine (DS13);

N-(3-(3-borono-4-fluorobenzamido)-2,2-dimethylpropyl)-N-(3-borono-4-fluorobenzoyl)glycine (DS14);

N-(4-((3-borono-4-fluorobenzamido)methyl)benzyl)-N-(3-borono-4-fluorobenzoyl)glycine (DS15);

N-(3-((3-borono-4-fluorobenzamido)methyl)benzyl)-N-(3-borono-4-fluorobenzoyl)glycine (DS16);

N-((1S,2R)-2-(3-borono-4-fluorobenzamido)cyclohexyl)-N-(3-borono-4-fluorobenzoyl)glycine (DS17);

N-((1S,2S)-2-(3-borono-4-fluorobenzamido)cyclohexyl)-N-(3-borono-4-fluorobenzoyl)glycine (DS18);

N-(3-(3-borono-5-bromobenzamido)propyl)-N-(3-borono-5-bromobenzoyl)glycine (DS19);

N-(4-((4-(3-borono-5-bromobenzamido)cyclohexyl) methyl)cyclohexyl)-N-(3-borono-5-bromobenzoyl)glycine (DS20);

bis(3-(3-borono-5-bromobenzamido)propyl)glycine (DS21);

N-(4-((3-borono-5-bromobenzamido)methyl)benzyl)-N-(3-borono-5-bromobenzoyl)glycine (DS22);

N-(3-((3-borono-5-bromobenzamido)methyl)benzyl)-N-(3-borono-5-bromobenzoyl)glycine (DS23);

N-(2-(3-borono-5-bromobenzamido)cyclohexyl)-N-(3-borono-5-bromobenzoyl)glycine (DS24);

N-(3-(4-borono-3-fluorobenzamido)propyl)-N-(4-borono-3-fluorobenzoyl)glycine (DS25);

N-(4-((4-(4-borono-3-fluorobenzamido)cyclohexyl)methyl)cyclohexyl)-N-(4-borono-3-fluorobenzoyl)glycine (DS26);

N-(3-(4-borono-3-fluorobenzamido)-2,2-dimethylpropyl)-N-(4-borono-3-fluorobenzoyl)glycine (DS27);

bis(3-(4-borono-3-fluorobenzamido)propyl)glycine (DS28);

N-(4-((4-borono-3-fluorobenzamido)methyl)benzyl)-N-(4-borono-3-fluorobenzoyl)glycine (DS29);

N-(3-((4-borono-3-fluorobenzamido)methyl)benzyl)-N-(4-borono-3-fluorobenzoyl)glycine (DS30);

N-((1S,2R)-2-(4-borono-3-fluorobenzamido)cyclohexyl)-N-(4-borono-3-fluorobenzoyl)glycine (DS31);

N-(1-hydroxy-1,3-dihydrobenzo[c][1,2]oxaborole-6-carbonyl)-N-(3-(1-hydroxy-1,3-dihydrobenzo[c][1,2]oxaborole-6-carboxamido)propyl)glycine (DS32);

N-(1-hydroxy-1,3-dihydrobenzo[c][1,2]oxaborole-6-carbonyl)-N-(5-(1-hydroxy-1,3-dihydrobenzo[c][1,2]oxaborole-6-carboxamido)pentyl)glycine (DS33);

N-(1-hydroxy-1,3-dihydrobenzo[c][1,2]oxaborole-6-carbonyl)-N-(3-(1-hydroxy-1,3-dihydrobenzo[c][1,2]oxaborole-6-carboxamido)-2,2-dimethylpropyl)glycine (DS34);

bis(3-(1-hydroxy-1,3-dihydrobenzo[c][1,2]oxaborole-6-carboxamido)propyl)glycine (DS35);

N-(1-hydroxy-1,3-dihydrobenzo[c][1,2]oxaborole-6-carbonyl)-N-(3-((1-hydroxy-1,3-dihydrobenzo[c][1,2]oxaborole-6-carboxamido)methyl)benzyl)glycine (DS36);

N-(1-hydroxy-1,3-dihydrobenzo[c][1,2]oxaborole-6-carbonyl)-N-((1S,2R)-2-(1-hydroxy-1,3-dihydrobenzo[c][1,2]oxaborole-6-carboxamido)cyclohexyl)glycine (DS37);

N-(1-hydroxy-1,3-dihydrobenzo[c][1,2]oxaborole-6-carbonyl)-N-(4-(1-hydroxy-1,3-dihydrobenzo[c][1,2]oxaborole-6-carboxamido)butyl)glycine (DS38);

N-(1-hydroxy-1,3-dihydrobenzo[c][1,2]oxaborole-6-carbonyl)-N-((1S,2S)-2-(1-hydroxy-1,3-dihydrobenzo[c][1,2]oxaborole-6-carboxanido)cyclohexyl)glycine (DS39);

(R)—N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)propyl)glycine (DS40);

(S)—N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)propyl)glycine (DS41);

N-(1-hydroxy-1,3-dihydrobenzo[c][1,2]oxaborole-6-carbonyl)-N-(2-(1-hydroxy-1,3-dihydrobenzo[c][1,2]oxaborole-6-carboxamido)cyclohexyl)glycine (DS42);

N-(3-(4-borono-3,5-difluorobenzamido)propyl)-N-(4-borono-3,5-difluorobenzoyl)glycine (DS43);

N-(3-(4-borono-2-fluorobenzanido)propyl)-N-(4-borono-2-fluorobenzoyl)glycine (DS44);

N-(2-(N-ethyl-1-hydroxy-1,3-dihydrobenzo[c][1,2]oxaborole-6-carboxamido)ethyl)-N-(1-hydroxy-1,3-dihydrobenzo[c][1,2]oxaborole-6-carbonyl)glycine (DS45);

N-(1-hydroxy-1,3-dihydrobenzo[c][1,2]oxaborole-6-carbonyl)-N-(2-(1-hydroxy-N-(2-hydroxyethyl)-1,3-dihydrobenzo[c][1,2]oxaborole-6-carboxamido)ethyl)glycine (DS46);

N-(1-hydroxy-1,3-dihydrobenzo[c][1,2]oxaborole-6-carbonyl)-N-(5-(1-hydroxy-1,3-dihydrobenzo[c][1,2]oxaborole-6-carboxamido)hexyl)glycine (DS47);

N-(1-hydroxy-1,3-dihydrobenzo[c][1,2]oxaborole-6-carbonyl)-N-(4-((4-(1-hydroxy-1,3-dihydrobenzo[c][1,2]oxaborole-6-carboxamido)cyclohexyl)methyl)cyclohexyl)glycine (DS48);

((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)glycine (DS49);

((2S,4S)-4-(3-borono-4-fluorobenzamido)-1-(3-borono-4-fluorobenzoyl)pyrrolidine-2-carbonyl)glycine (DS50);

((2S,4S)-4-(3-borono-5-nitrobenzamido)-1-(3-borono-5-nitrobenzoyl)pyrrolidine-2-carbonyl)glycine (DS51);

((2S,4S)-4-(5-borono-2-fluorobenzamido)-1-(5-borono-2-fluorobenzoyl)pyrrolidine-2-carbonyl)glycine (DS52);

(S)-(1,4-bis(1-hydroxy-1,3-dihydrobenzo[c][1,2]oxaborole-6-carbonyl)piperazine-2-carbonyl)glycine (DS53);

(S)—N-(3-amino-2-(1-hydroxy-1,3-dihydrobenzo[c][1,2]oxaborole-6-carboxamido)-3-oxopropyl)-N-benzyl-1-hydroxy-1,3-dihydrobenzo[c][1,2]oxaborole-6-carboxamide (DS54);

(S)—N-(3-amino-2-(1-hydroxy-1,3-dihydrobenzo[c][1,2]oxaborole-6-carboxamido)-3-oxopropyl)-1-hydroxy-N-(4-(trifluoromethyl)benzyl)-1,3-dihydrobenzo[c][1,2]oxaborole-6-carboxamide (DS55);

(S)—N-(3-amino-2-(1-hydroxy-1,3-dihydrobenzo[c][1,2]oxaborole-6-carboxamido)-3-oxopropyl)-N-ethyl-1-hydroxy-1,3-dihydrobenzo[c][1,2]oxaborole-6-carboxamide (DS56);

(S)—N-(3-amino-2-(1-hydroxy-1,3-dihydrobenzo[c][1,2]oxaborole-6-carboxamido)-3-oxopropyl)-1-hydroxy-N-propyl-1,3-dihydrobenzo[c][1,2]oxaborole-6-carboxamide (DS57);

(S)—N-(3-amino-2-(1-hydroxy-1,3-dihydrobenzo[c][1,2]oxaborole-6-carboxamido)-3-oxopropyl)-1-hydroxy-N-isobutyl-1,3-dihydrobenzo[c][1,2]oxaborole-6-carboxamide (DS58);

(S)—N-(3-amino-2-(1-hydroxy-1,3-dihydrobenzo[c][1,2]oxaborole-6-carboxamido)-3-oxopropyl)-1-hydroxy-N-((5-(thiophen-2-yl)pyridin-2-yl)methyl)-1,3-dihydrobenzo[c][1,2]oxaborole-6-carboxamide (DS59);

(S)—N-(3-amino-2-(1-hydroxy-1,3-dihydrobenzo[c][1,2]oxaborole-6-carboxamido)-3-oxopropyl)-1-hydroxy-N-isopentyl-1,3-dihydrobenzo[c][1,2]oxaborole-6-carboxamide (DS60);

(S)—N-(3-amino-2-(1-hydroxy-1,3-dihydrobenzo[c][1,2]oxaborole-6-carboxamido)-3-oxopropyl)-1-hydroxy-N-(quinolin-5-ylmethyl)-1,3-dihydrobenzo[c][1,2]oxaborole-6-carboxamide (DS61);

(S)—N-(3-amino-2-(1-hydroxy-1,3-dihydrobenzo[c][1,2]oxaborole-6-carboxamido)-3-oxopropyl)-1-hydroxy-N-(2-(trifluoromethoxy)benzyl)-1,3-dihydrobenzo[c][1,2]oxaborole-6-carboxamide (DS62);

(S)—N-(3-amino-2-(1-hydroxy-1,3-dihydrobenzo[c][1,2]oxaborole-6-carboxamido)-3-oxopropyl)-1-hydroxy-N-(4-(methylsulfonyl)benzyl)-1,3-dihydrobenzo[c][1,2]oxaborole-6-carboxamide (DS63);

(3-((2S,4S)-4-(5-borono-2-(methylsulfonyl)benzamido)-2-carbamoylpyrrolidine-1-carbonyl)-4-(methylsulfonyl)phenyl)boronic acid (DS64);

(4-(((3S,5S)-1-(4-borono-2,6-difluorobenzoyl)-5-carbamoylpyrrolidin-3-yl)carbamoyl)-3,5-difluorophenyl)boronic acid (DS65);

(R,E)-4,5-bis(1-hydroxy-1,3-dihydrobenzo[c][1,2]oxaborole-6-carboxamido)pent-2-enoic acid (DS66);

(2S,4S)-1-(1-hydroxy-4-(trifluoromethyl)-1,3-dihydrobenzo[c][1,2]oxaborole-6-carbonyl)-4-(1-hydroxy-4-

(trifluoromethyl)-1,3-dihydrobenzo[c][1,2]oxaborole-6-carboxamido)pyrrolidine-2-carboxamide (DS67);

N,N'-((2S,3S)-1-amino-1-oxobutane-2,3-diyl)bis(1-hydroxy-1,3-dihydrobenzo[c][1,2]oxaborole-6-carboxamide) (DS68);

(R)-3,4-bis(1-hydroxy-1,3-dihydrobenzo[c][1,2]oxaborole-6-carboxamido)butanoic acid (DS69);

3-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid (DS70);

(S)-3-(1-hydroxy-1,3-dihydrobenzo[c][1,2]oxaborole-5-carboxamido)-4-(1-hydroxy-1,3-dihydrobenzo[c][1,2]oxaborole-6-carboxamido)butanoic acid (DS71);

(R)-4-(1-hydroxy-1,3-dihydrobenzo[c][1,2]oxaborole-5-carboxamido)-5-(1-hydroxy-1,3-dihydrobenzo[c][1,2]oxaborole-6-carboxamido)pentanoic acid (DS72);

(2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxylic acid (DS73);

(2S,4R)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carboxylic acid (DS74);

(2S,3S)-3-(1-hydroxy-4-(trifluoromethyl)-1,3-dihydrobenzo[c][1,2]oxaborole-6-carboxamido)-2-(1-hydroxy-7-(trifluoromethyl)-1,3-dihydrobenzo[c][1,2]oxaborole-5-carboxamido)butanoic acid (DS75);

(R)-5-(1-hydroxy-4-(trifluoromethyl)-1,3-dihydrobenzo[c][1,2]oxaborole-6-carboxamido)-4-(1-hydroxy-7-(trifluoromethyl)-1,3-dihydrobenzo[c][1,2]oxaborole-5-carboxamido)pentanoic acid (DS76);

((2S,4S)-1-(5-borono-2-nitrobenzoyl)-4-(1-hydroxy-1,3-dihydrobenzo[c][1,2]oxaborole-6-carboxamido)pyrrolidine-2-carbonyl)glycine (DS77);

((2S,4S)-1-(5-borono-2-(methylsulfonyl)benzoyl)-4-(1-hydroxy-1,3-dihydrobenzo[c][1,2]oxaborole-6-carboxamido)pyrrolidine-2-carbonyl)glycine (DS78);

((2S,4S)-1-(3-borono-2,6-difluorobenzoyl)-4-(1-hydroxy-1,3-dihydrobenzo[c][1,2]oxaborole-6-carboxamido)pyrrolidine-2-carbonyl)glycine (DS79);

(S)-(3-((3-borono-4-fluorobenzyl)(5,6-diamino-6-oxohexyl)carbamoyl)-5-nitrophenyl)boronic acid (DS80);

(S)-(3-((4-borono-3,5-difluorobenzyl)(5,6-diamino-6-oxohexyl)carbamoyl)-5-nitrophenyl)boronic acid (DS81);

(S)-(3-((3-boronobenzyl)(5,6-diamino-6-oxohexyl)carbamoyl)-5-nitrophenyl)boronic acid (DS82);

(S)-(3-((4-borono-2-methoxybenzyl)(5,6-diamino-6-oxohexyl)carbamoyl)-5-nitrophenyl)boronic acid (DS83);

(S)-(3-((4-borono-2-(trifluoromethyl)benzyl)(5,6-diamino-6-oxohexyl)carbamoyl)-5-nitrophenyl)boronic acid (DS84);

(S)-(5-((3-borono-N-(5,6-diamino-6-oxohexyl)-4-fluorobenzamido)methyl)-2-fluorophenyl)boronic acid (DS85);

(S)-(5-((4-borono-3,5-difluorobenzyl)(5,6-diamino-6-oxohexyl)carbamoyl)-2-fluorophenyl)boronic acid (DS86);

(S)-(3-((3-borono-N-(5,6-diamino-6-oxohexyl)-4-fluorobenzamido)methyl) phenyl)boronic acid (DS87);

(S)-(5-((4-borono-2-methoxybenzyl)(5,6-diamino-6-oxohexyl)carbamoyl)-2-fluorophenyl)boronic acid (DS88);

(S)-(5-((4-borono-3-(trifluoromethyl)benzyl)(5,6-diamino-6-oxohexyl)carbamoyl)-2-fluorophenyl)boronic acid (DS89);

(S)-(4-((3-borono-4-fluorobenzyl)(5,6-diamino-6-oxohexyl)carbamoyl)-2-fluorophenyl)boronic acid (DS90);

(S)-(4-((4-borono-3,5-difluorobenzyl)(5,6-diamino-6-oxohexyl)carbamoyl)-2-fluorophenyl)boronic acid (DS91);

(S)-(4-((3-boronobenzyl)(5,6-diamino-6-oxohexyl)carbamoyl)-2-fluorophenyl)boronic acid (DS92);

(S)-(4-((4-borono-2-methoxybenzyl)(5,6-diamino-6-oxohexyl)carbamoyl)-2-fluorophenyl)boronic acid (DS93);

(S)-(4-((4-borono-2-(trifluoromethyl)benzyl)(5,6-diamino-6-oxohexyl)carbamoyl)-2-fluorophenyl)boronic acid (DS94);

(S)-(5-((3-borono-5-bromo-N-(5,6-diamino-6-oxohexyl)benzamido)methyl)-2-fluorophenyl)boronic acid (DS95);

(S)-(3-((4-borono-3,5-difluorobenzyl)(5,6-diamino-6-oxohexyl)carbamoyl)-5-bromophenyl)boronic acid (DS96);

(S)-(3-((3-borono-5-bromo-N-(5,6-diamino-6-oxohexyl)benzamido)methyl) phenyl)boronic acid (DS97);

(S)-(3-((3-borono-5-bromo-N-(5,6-diamino-6-oxohexyl)benzamido)methyl)-5-methoxyphenyl)boronic acid (DS98);

(S)-(3-((4-borono-2-(trifluoromethyl)benzyl)(5,6-diamino-6-oxohexyl)carbamoyl)-5-bromophenyl)boronic acid (DS99);

(S)-(3-((3-borono-4-fluorobenzyl)(5,6-diamino-6-oxohexyl)carbamoyl)-5-fluorophenyl)boronic acid (DS100);

(S)-(3-((4-borono-3-methoxybenzyl)(5,6-diamino-6-oxohexyl)carbamoyl)-5-fluorophenyl)boronic acid (DS101);

(S)-(3-((4-borono-2-(trifluoromethyl)benzyl)(5,6-diamino-6-oxohexyl)carbamoyl)-5-fluorophenyl)boronic acid (DS102);

(S)-(4-((N-(5,6-diamino-6-oxohexyl)-1-hydroxy-1,3-dihydrobenzo[c][1,2]oxaborole-6-carboxamido)methyl)-2-fluorophenyl)boronic acid (DS103);

(S)-(4-((N-(5,6-diamino-6-oxohexyl)-1-hydroxy-1,3-dihydrobenzo[c][1,2]oxaborole-6-carboxamido)methyl)-2,6-difluorophenyl)boronic acid (DS104);

(S)-(3-((N-(5,6-diamino-6-oxohexyl)-1-hydroxy-1,3-dihydrobenzo[c][1,2]oxaborole-6-carboxamido)methyl)phenyl)boronic acid (DS105);

(S)-(4-((N-(5,6-diamino-6-oxohexyl)-1-hydroxy-1,3-dihydrobenzo[c][1,2]oxaborole-6-carboxamido)methyl)-3-methoxyphenyl)boronic acid (DS106);

(S)—N-(5,6-diamino-6-oxohexyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide (DS107);

(S)—N-(4-amino-3-(1-hydroxy-1,3-dihydrobenzo[c][1,2]oxaborole-6-carboxamido)-4-oxobutyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide (DS108);

(S)—N-(6-amino-5-(1-hydroxy-1,3-dihydrobenzo[c][1,2]oxaborole-6-carboxamido)-6-oxohexyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide (DS109);

(2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxylic acid (DS110);

(2S,3S)-2-(1-hydroxy-1,3-dihydrobenzo[c][1,2]oxaborole-5-carboxamido)-3-(1-hydroxy-1,3-dihydrobenzo[c][1,2]oxaborole-6-carboxamido)butanoic acid (DS111);

(2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxylic acid (DS112);

N-(1-hydroxy-3,3-dimethyl-1,3-dihydrobenzo[c][1,2]oxa-borole-6-carbonyl)-N-(2-(1-hydroxy-3,3-dimethyl-1,3-dihydrobenzo[c][1,2]oxaborole-6-carboxamido)ethyl) glycine (DS113);

N-(1-hydroxy-3,4-dihydro-1H-benzo[c][1,2]oxaborinine-7-carbonyl)-N-(2-(1-hydroxy-3,4-dihydro-1H-benzo[c][1, 2]oxaborinine-7-carboxamido)ethyl)glycine (DS114);

N-(2-(2-(1-hydroxy-1,3-dihydrobenzo[c][1,2]oxaborol-7-yl)acetamido)ethyl)-N-(2-(1-hydroxy-1,3-dihydrobenzo [c][1,2]oxaborol-7-yl)acetyl)glycine (DS115);

N-(1-hydroxy-3,3-dimethyl-1,3-dihydrobenzo[c][1,2]oxa-borole-7-carbonyl)-N-(2-(1-hydroxy-3,3-dimethyl-1,3-dihydrobenzo[c][1,2]oxaborole-7-carboxamido)ethyl) glycine (DS116);

N-(1-hydroxy-1,3-dihydrobenzo [c][1,2]oxaborole-3-carbo-nyl)-N-(2-(1-hydroxy-1,3-dihydrobenzo[c][1,2]oxa-borole-3-carboxamido)ethyl)glycine (DS117);

3,5-bis((1-hydroxy-3,3-dimethyl-1,3-dihydrobenzo[c][1,2] oxaborole-6-carboxamido)methyl)benzoic acid (DS118);

3,5-bis((1-hydroxy-3,4-dihydro-1H-benzo[c][1,2]oxabori-nine-7-carboxamido)methyl)benzoic acid (DS119);

3,5-bis((2-(1-hydroxy-1,3-dihydrobenzo[c][1,2]oxaborol-7-yl)acetamido)methyl)benzoic acid (DS120);

3,5-bis((1-hydroxy-3,3-dimethyl-1,3-dihydrobenzo[c][1,2] oxaborole-7-carboxamido)methyl) benzoic acid (DS121);

3,5-bis((1-hydroxy-1,3-dihydrobenzo[c][1,2]oxaborole-3-carboxamido)methyl)benzoic acid (DS122);

(S)-3-(2,3-bis(1-hydroxy-3,3-dimethyl-1,3-dihydrobenzo[c] [1,2]oxaborole-6-carboxamido) propanamido)propanoic acid (DS123);

(S)-3-(2,3-bis(1-hydroxy-3,4-dihydro-1H-benzo[c][1,2] oxaborinine-7-carboxamido) propanamido)propanoic acid (DS124);

(S)-3-(2,3-bis(2-(1-hydroxy-1,3-dihydrobenzo[c][1,2]oxa-borol-7-yl)acetamido) propanamido)propanoic acid (DS125);

(S)-3-(2,3-bis(1-hydroxy-3,3-dimethyl-1,3-dihydrobenzo[c] [1,2]oxaborole-7-carboxamido) propanamido)propanoic acid (DS126);

3-((2S)-2,3-bis(1-hydroxy-1,3-dihydrobenzo[c][1,2]oxa-borole-3-carboxamido) propanamido)propanoic acid (DS127);

(3,5-bis((1-hydroxy-3,3-dimethyl-1,3-dihydrobenzo[c][1,2] oxaborole-6-carboxamido) methyl)benzoyl)glutamic acid (DS128);

(3,5-bis((1-hydroxy-3,4-dihydro-1H-benzo[c][1,2]oxabori-nine-7-carboxamido) methyl)benzoyl)glutamic acid (DS129);

(3,5-bis((2-(1-hydroxy-1,3-dihydrobenzo[c][1,2]oxaborol-7-yl)acetamido)methyl)benzoyl) glutamic acid (DS130);

(3,5-bis((1-hydroxy-3,3-dimethyl-1,3-dihydrobenzo[c][1,2] oxaborole-7-carboxamido)methyl) benzoyl)glutamic acid (DS131);

(3,5-bis((1-hydroxy-1,3-dihydrobenzo[c][1,2]oxaborole-3-carboxamido)methyl)benzoyl) glutamic acid (DS132);

4-(3,4-bis(1-hydroxy-3,3-dimethyl-1,3-dihydrobenzo[c][1, 2]oxaborole-6-carboxamido) pyrrolidin-1-yl)-4-oxobu-tanoic acid (DS133);

4-(3,4-bis(1-hydroxy-3,4-dihydro-1H-benzo[c][1,2]oxa-borinine-7-carboxamido)pyrrolidin-1-yl)-4-oxobutanoic acid (DS134);

4-(3,4-bis(2-(1-hydroxy-1,3-dihydrobenzo[c][1,2]oxaborol-7-yl)acetamido)pyrrolidin-1-yl)-4-oxobutanoic acid (DS135);

4-(3,4-bis(1-hydroxy-3,3-dimethyl-1,3-dihydrobenzo[c][1, 2]oxaborole-7-carboxamido)pyrrolidin-1-yl)-4-oxobu-tanoic acid (DS136);

4-(3,4-bis(1-hydroxy-1,3-dihydrobenzo[c][1,2]oxaborole-3-carboxamido)pyrrolidin-1-yl)-4-oxobutanoic acid (DS137);

((S)-2,3-bis(1-hydroxy-3,3-dimethyl-1,3-dihydrobenzo[c] [1,2]oxaborole-6-carboxamido)propanoyl)-L-glutamic acid (DS138);

((S)-2,3-bis(1-hydroxy-3,4-dihydro-1H-benzo[c][1,2]oxa-borinine-7-carboxamido)propanoyl)-L-glutamic acid (DS139);

((S)-2,3-bis(2-(1-hydroxy-1,3-dihydrobenzo[c][1,2]oxa-borol-7-yl)acetamido)propanoyl)-L-glutamic acid (DS140);

((S)-2,3-bis(1-hydroxy-3,3-dimethyl-1,3-dihydrobenzo[c] [1,2]oxaborole-7-carboxamido) propanoyl)-L-glutamic acid (DS141);

((2S)-2,3-bis(1-hydroxy-1,3-dihydrobenzo[c][1,2]oxa-borole-3-carboxamido)propanoyl)-L-glutamic acid (DS142);

(4-(3,4-bis(1-hydroxy-3,3-dimethyl-1,3-dihydrobenzo[c][1, 2]oxaborole-6-carboxamido)pyrrolidin-1-yl)-4-oxobu-tanoyl)-L-glutamic acid (DS143);

(4-(3,4-bis(1-hydroxy-3,4-dihydro-1H-benzo[c][1,2]oxa-borinine-7-carboxamido)pyrrolidin-1-yl)-4-oxobu-tanoyl)-L-glutamic acid (DS144);

(4-(3,4-bis(2-(1-hydroxy-1,3-dihydrobenzo[c][1,2]oxa-borol-7-yl)acetamido)pyrrolidin-1-yl)-4-oxobutanoyl)-L-glutamic acid (DS145);

(4-(3,4-bis(1-hydroxy-3,3-dimethyl-1,3-dihydrobenzo[c][1, 2]oxaborole-7-carboxamido) pyrrolidin-1-yl)-4-oxobu-tanoyl)-L-glutamic acid (DS146);

(4-(3,4-bis(1-hydroxy-1,3-dihydrobenzo[c][1,2]oxaborole-3-carboxamido)pyrrolidin-1-yl)-4-oxobutanoyl)-L-gluta-mic acid (DS147);

(S)-2,3-bis(1-hydroxy-3,4-dihydro-1H-benzo[c][1,2]oxa-borinine-7-carboxamido)propanoic acid (DS149);

(S)-2,3-bis(2-(1-hydroxy-1,3-dihydrobenzo[c][1,2]oxa-borol-7-yl)acetamido)propanoic acid (DS150);

(S)-2,3-bis(1-hydroxy-3,3-dimethyl-1,3-dihydrobenzo[c][1, 2]oxaborole-7-carboxamido)propanoic acid (DS151); and (2S)-2,3-bis(1-hydroxy-1,3-dihydrobenzo[c][1,2]oxa-borole-3-carboxamido)propanoic acid (DS152).

159. The compound of any one of embodiments 101-150 and 156-158, wherein the compound is used as an interme-diate in the manufacture of a drug substance or a therapeutic of a prophylactic compound.

160. A human insulin analog, comprising an A-chain and a B-chain, wherein the sequence of the A-chain comprises:

$X_{aa}X_{bb}X_{cc}X_{dd}X_{ee}X_{ff}X_{gg}$VEQCCX$_{hh}X_{ii}$ICSLYQLE-NYCNX$_{jj}X_{kk}X_{ll}X_{mm}X_{nn}X_{oo}X_{pp}$(SEQ ID NO:24015); and wherein the sequence of the B-chain comprises:

(i)

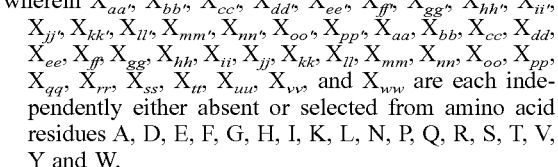

(SEQ ID NO: 24016)

$X_{aa}X_{bb}X_{cc}X_{dd}$KX$_{ee}X_{ff}X_{gg}X_{hh}X_{ii}X_{jj}$KX$_{kk}X_{ll}X_{mm}X_{nn}$QHLCGSHLVEALYLV CX$_{oo}X_{pp}X_{qq}$GFFYTX$_{rr}X_{ss}X_{tt}X_{uu}X_{vv}X_{ww}$, wherein $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each inde-pendently either absent or selected from amino acid residues A, D, E, F, G, H, I, K, L, N, P, Q, R, S, T, V, Y and W, (ii)

(SEQ ID NO: 24017)

$X_{aa'}X_{bb'}X_{cc'}X_{dd'}$KPX$_{ee'}X_{ff'}X_{gg'}X_{hh'}X_{ii'}X_{jj'}X_{kk'}X_{ll'}X_{mm'}X_{nn'}$QHLCGSHLVEALYLV CX$_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and wherein $X_{ee}$ is selected from amino acid residues A, E, F, H, I, K, L, N, P, Q, R, S, T, V, Y and W, (iii)

(SEQ ID NO: 24018)

$X_{aa'}X_{bb'}X_{cc'}X_{dd'}$KX$_{ee'}X_{ff'}X_{gg'}X_{hh'}X_{ii'}X_{jj'}$KX$_{kk'}X_{ll'}X_{mm'}X_{nn'}$QHLCGSHLVEALYLV CX$_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is G, (iv)

(SEQ ID NO: 24019)

$X_{aa'}X_{bb'}X_{cc'}X_{dd'}$KX$_{ee'}X_{ff'}X_{gg'}X_{hh'}X_{ii'}X_{jj'}$KX$_{kk'}X_{ll'}X_{mm'}X_{nn'}$QHLCGSHLVEALYLV CX$_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ is present and at least one of $X_{ee}$, $X_{ff}$, $X_{gg}$, $X_{hh}$, $X_{ii}$, $X_{jj}$ is S, or (v)

(SEQ ID NO: 24020)

$X_{aa'}X_{bb'}X_{cc'}X_{dd'}$KX$_{ee'}X_{ff'}X_{gg'}X_{hh'}X_{ii'}X_{jj'}$KX$_{kk'}X_{ll'}X_{mm'}X_{nn'}$QHLCGSHLVEALYLV CX$_{oo'}X_{pp'}X_{qq'}$GFFYTX$_{rr'}X_{ss'}X_{tt'}X_{uu'}X_{vv'}X_{ww'}$, wherein $X_{aa'}$, $X_{bb'}$, $X_{cc'}$, $X_{dd'}$, $X_{ee'}$, $X_{ff'}$, $X_{gg'}$, $X_{hh'}$, $X_{ii'}$, $X_{jj'}$, $X_{kk'}$, $X_{ll'}$, $X_{mm'}$, $X_{nn'}$, $X_{oo'}$, $X_{pp'}$, $X_{aa}$, $X_{bb}$, $X_{cc}$, $X_{dd}$, $X_{ee}$, $X_{ff}$, $X_{gg}$, $X_{hh}$, $X_{ii}$, $X_{jj}$, $X_{kk}$, $X_{ll}$, $X_{mm}$, $X_{nn}$, $X_{oo}$, $X_{pp}$, $X_{qq}$, $X_{rr}$, $X_{ss}$, $X_{tt}$, $X_{uu}$, $X_{vv}$, and $X_{ww}$ are each independently either absent or selected from amino acid residues A, D, E, F, G, H, I, K, L, N, P, Q, R, S, T, V, Y and W, and at least one of $X_{ee}$, $X_{ff}$, $X_{gg}$, $X_{hh}$, $X_{ii}$, $X_{jj}$ are present and at least one of $X_{ee}$, $X_{ff}$, $X_{gg}$, $X_{hh}$, $X_{ii}$, $X_{jj}$ is S, and another is G.

161. The insulin of embodiment 160, wherein the A-chain comprises a sequence selected from SEQ ID NOs 1 and 3 to 33, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, KGSH (SEQ ID NO:24049), GKGSH (SEQ ID NO:24050), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042); and Wherein the B-chain comprises a sequence selected from SEQ ID NOs 2 and 34 to 74, 24047, and 24048, and is optionally appended at the N-terminus and/or at the C-terminus by at least one selected from KA, KD, KE, KF, KG, KH, KI, KL, KN, KP, KQ, KR, KS, KT, KY, KAA, KAD, KAE, KAF, KAG, KAH, KAI, KAL, KAN, KAQ, KAR, KAS, KAT, KAY, KDA, KDD, KDE, KDF, KDG, KDH, KDI, KDL, KDN, KDQ, KDR, KDS, KDT, KDY, KEA, KED, KEE, KEF, KEG, KEH, KEI, KEL, KEN, KEQ, KER, KES, KET, KEY, KFA, KFD, KFE, KFF, KFG, KFH, KFI, KFL, KFN, KFQ, KFR, KFS, KFT, KFY, KGA, KGD, KGE, KGF, KGG, KGH, KGI, KGL, KGN, KGQ, KGR, KGS, KGT, KGY, KHA, KHD, KHE, KHF, KHG, KHH, KHI, KHL, KHN, KHQ, KHR, KHS, KHT, KHY, KIA, KID, KIE, KIF, KIG, KIH, KII, KIL, KIN, KIQ, KIR, KIS, KIT, KIY, KLA, KLD, KLE, KLF, KLG, KLH, KLI, KLL, KLN, KLQ, KLR, KLS, KLT, KLY, KNA, KND, KNE, KNF, KNG, KNH, KNI, KNL, KNN, KNQ, KNR, KNS, KNT, KNY, KPA, KPD, KPE, KPF, KPG, KPH, KPI, KPL, KPN, KPQ, KPR, KPS, KPT, KPY, KQA, KQD, KQE, KQF, KQG, KQH, KQI, KQL, KQN, KQQ, KQR, KQS, KQT, KQY, KRA, KRD, KRE, KRF, KRG, KRH, KRI, KRL, KRN, KRQ, KRR, KRS, KRT, KRY, KSA, KSD, KSE, KSF, KSG, KSH, KSI, KSL, KSN, KSQ, KSR, KSS, KST, KSY, KTA, KTD, KTE, KTF, KTG, KTH, KTI, KTL, KTN, KTQ, KTR, KTS, KTT, KTY, KYA, KYD, KYE, KYF, KYG, KYH, KYI, KYL, KYN, KYQ, KYR, KYS, KYT, KYY, SEQ ID NOs 75 to 24014, KGSH (SEQ ID NO:24049), GKGSH (SEQ ID NO:24050), GKGSKK (SEQ ID NO:24045), GKKPGKK (SEQ ID NO:24046), GKGPSK (SEQ ID NO:24044), GKPSHKP (SEQ ID NO:24043), and GSHKGSHK (SEQ ID NO:24042).

162. The insulin of embodiment 160, wherein no more than 4 residues are added or deleted from the A-chain and/or the B-chain.

163. The insulin of embodiment 160, wherein a K residue is present at the N-terminus of the A-chain and/or the B-chain, and/or wherein no more than three K residues are present at the N-terminus of the A-chain and/or the B-chain, and/or
    wherein (i) the tyrosine at A14 is replaced with glutamic acid, and/or (ii) the tyrosine at B16 is replaced with histidine, and/or (iii) the phenylalanine at B25 is replaced with a histidine, and/or wherein one to three residues selected from residues B20, B21, and B22-B29 of the B-chain, residues A4 or A8 of the A-chain, and residues of an optionally extended polypeptide, are lysine residues, and/or wherein only one K residue is present within 10 residues of the N-terminus of B-chain.

164. The compound of any one of embodiments 101-150 and 156-159, wherein X1 comprises the insulin of any one of embodiments 160-163.

165. The insulin of any one of embodiments 160-163, wherein an amino group of the side chain(s) of one to four lysine residues is each independently covalently conjugated as described by the formula of embodiment 102.

166. The insulin of any one of embodiments 160-163, wherein the insulin is covalently conjugated as described by the formula of embodiment 102, n'=0 and the C-terminus of Z1a is directly conjugated to the N-terminus of the B-chain of insulin through a peptide bond;

Z1a comprises at least one amino acid selected from K, P, E, G, S, T, A, and R, such that the sequence comprises at least one lysine, at least one proline, and at least one amino acid selected from H, R, A and T; and the amino group of least one lysine side chain in Z1a is covalently conjugated as described by the formula.

167. The insulin of any one of embodiments 160-163, wherein the insulin is covalently conjugated as described by the formula of embodiment 102, Z1a comprises a polypeptide comprising the sequence $(XA1A_2A3X)_m$(SEQ ID NO:24022), wherein:

$A_1$, $A_2$, and $A_3$ are each independently an L- or D-amino acid;

m is an integer in the range of 1 to 4;

each X is K or KP; and the epsilon amine group of at least one lysine side chain in Z1a is covalently conjugated as described by the formula.

168. The insulin of any one of embodiments 160-163, wherein the insulin is covalently conjugated as described by the formula of embodiment 102, Z1a comprises a polypeptide comprising a sequence selected from $(XA1X)_m$(GGGGS)$_n$ (SEQ ID NO:24023), $(XAIA2X)_m$ (GGGGS)n (SEQ ID NO:24024), $(XA1A2A3X)_m$(GGGGS)n (SEQ ID NO:24025), $(XA1X)_m$(GGGGS)n (XA2X)o (SEQ ID NO:24026), and $(XA1A2X)_m$(GGGGS)n (XA3A4X)o (SEQ ID NO:24027), wherein:

$A_1$, $A_2$, $A_3$, and $A_4$ are each independently an L- or D-amino acid;

m is an integer in the range of 1 to 4;

n is an integer in the range of 1 to 4;

is an integer in the range of 1 to 4;

each X is K or KP; and the epsilon amine group of each lysine side chain of at least one lysine side chain in Z1a is further covalently conjugated as described by the formula.

169. The insulin of any one of embodiments 160-163, wherein the insulin is covalently conjugated as described by the formula of embodiment 102, Z1a comprises a polypeptide comprising the sequence $(GX)_m$, wherein:

X is KV;

m is an integer in the range of 1 to 4, and the epsilon amine group of at least one lysine side chain in Z1a is further covalently conjugated as described by the formula.

170. The insulin of any one of embodiments 160-163, wherein the insulin is covalently conjugated as described by the formula of embodiment 102, Z1a comprises a polypeptide comprising a sequence selected from: $(GXA1KGEA2XT)_m$(GGSGSSS)n (GXGXA3GSSSGSSSXT)o (SEQ ID NO:24028), $(GXA1ESA2LYL)_m$ (SEQ ID NO:24029), $(TXEX)_m$ (GPGS)n (SEQ ID NO:24030), $(GXESA1VA)_m$ (KA2K)n (SEQ ID NO:24031), $(GXEA1A2)_m$(GGS)n (TYA3XXT)o (SEQ ID NO:24032), and $(TXAXYT)_m$ (TSSS)n (SEQ ID NO:24033), wherein:

each X is KV or KP;

$A_1$, $A_2$, $A_3$ are each independently an L- or D-amino acid;

m is an integer in the range of 1 to 4;

n is an integer in the range of 1 to 4; and is an integer in the range of 1 to 4; and the epsilon amine group of at least one lysine side chain in Z1a is further covalently conjugated as described by the formula.

171. The insulin of any one of embodiments 160-163, wherein the insulin is covalently conjugated as described by the formula of embodiment 102, Z1a comprises a polypeptide comprising a sequence selected from $(TKPYA1KEVETA2GSGS)_m$ (GGGGS)n (SEQ ID NO:24034), $(YTPLEA1KPYSTSYKPYSEA1L)_m$ (GKPTSLEA2FLVEA2LYTKP)n (SEQ ID NO:24035), and $(GKEALYLTPLESALYKP)_m$(TKPL-EALYLKPEILSLKPESLA)n (GKPGSSSKPDTSSSGTP KTAAGS)o (SEQ ID NO:24036), wherein:

$A_1$ and $A_2$ are each independently an L- or D-amino acid;

m is an integer in the range of 1 to 4;

n is an integer in the range of 1 to 4; and the epsilon amine group of at least one lysine side chain in Z1a is further covalently conjugated as described by the formula.

172. The insulin of embodiment 160, wherein (i) the A- and/or B-chain sequence of the insulin is appended at the N-terminus or C-terminus by KX'K, KX', or X'K wherein X' represents a continuous sequence of 2, 3, 4, or 5 residues selected from within wild-type A-chain (SEQ ID NO:1) and wild-type B-chain (SEQ ID NO:2), or (ii) wherein X' is a polypeptide of up to 30 residues with amino acids independently selected from: K, G, S, E, H, E, N, Q, D, A, P, R and C, and wherein in (i) and (ii) each K residue is optionally and independently covalently conjugated as described by the formula of embodiment 102.

EXAMPLES

The following examples and experimental data are provided for illustrative purposes only, and do not limit the scope of the embodiments of the present disclosure.

The following abbreviations have the definitions set forth below:

| Abbreviation | Full Name |
|---|---|
| Acm | s-Acetamidomethyl group |
| ACN | Acetonitrile |
| ARS | Alizarin Red S |
| Boc | tert-Butyloxycarbonyl |
| DCM | Dichloromethane |
| Dde | 1-(4,4-dimethyl-2,6-dioxocyclohex-1-ylidene)ethyl |
| DIPEA, DIEA | N,N-Diisopropylethylamine |
| DMF | Dimethylformamide |
| DMSO | Dimethyl Sulfoxide |
| DTDP | 2,2,-Dithiopyridine |
| EDC | 3-(Ethyliminomethyleneamino)-N,N-dimethylpropan-1-amine |
| Fmoc | Fluorenylmethyloxycarbonyl Chloride |
| GLP-1 | Glucagon-Like Peptide 1 |
| HATU | Hexafluorophosphate Azabenzotriazole Tetramethyl Uronium |
| HCl | Hydrochloric Acid |
| IGF1 | Insulin-like Growth Factor 1 |
| IPTG | Isopropylthio-β-galactoside |
| IBs | Inclusion Bodies |
| LC-MS | Liquid Chromatography-Mass Spectrometry |
| MeOH | Methanol |
| MIDA | N-methyliminodiacetic acid |
| MODY | Maturity Onset Diabetes of the Young |
| NHS | N-Hydroxysuccinimide |
| Oxyma | Ethyl cyanohydroxyiminoacetate |
| RAM | Rink Amide Matrix |
| PEG | Polyethylene Glycol |
| SDS | Sodium Dodecyl Sulfate |
| tBu | tert-Butyl |
| TFA | Trifluoroacetic Acid |
| TFP | 2,3,5,6-tetrafluorophenol |
| TMB | 3,3',5,5'-tetramethybenzidine |
| Pfp | pentafluorophenol |
| $CaCl_2$ | Calcium Chloride |
| HFIP | 1,1,1,3,3,3-Hexafluoro-2-propanol |
| $SnCl_2$ | Tin Chloride |

A. Preparation of Aromatic Boron-Containing Compounds

The disclosed compounds can be prepared according to the following schemes. The following schemes represent the general methods used in preparing these compounds. However, the synthesis of these compounds is not limited to these representative methods, as they can also be prepared through various other methods by those skilled in the art of synthetic chemistry.

Method A1: Synthesis of Diboronates DS01-DS48:

Chlorotrityl resin (300 mg, 0.45 mmol) was swelled in dry DCM (5 mL) for 30 mins. Solvent was removed with nitrogen and a solution of bromo acetic acid (0.139 g, 1M, 1 mL) in DCM with DIPEA (1M, 0.13 g 1 mL) was added immediately and gently mixed for 1 hr. The mixture was washed with DCM and unreacted sites were capped with a solution of 20% MeOH in a solution of DCM and DIEA (1M) and mixed for 1 hr. The resin was washed with DCM (3×5 mL) then DMF (3×5 mL). A solution of FF-diamine linker propane-1,3-diamine (0.37 g, 1M) in DMF (5 mL) was added to the resin and heated at 50° C. for 10 minutes. The resin was washed with DMF (3×5 mL) and a solution of 3-borono-5-nitrobenzoic acid (0.2M, 0.21 mg, 5 mL) in DMF with N, N'-diisopropylcarbodiimide (DIC) (0.126 g, 1M, 1 mL), Oxyma (0.5 M, 0.142 g, 2 mL) in DMF and heated at 50° C. for 30 min. The resin was washed with DMF (3×5 mL) then DCM (3×5 mL). A solution of trifluoroacetic acid with triisopropyl silane and water (95:2.5:2.5, 5 mL) was added to the resin and mixed for 90 minutes. The solution was collected and dried under vacuum, dissolved in DMSO (100 uL) and fractionated by reverse-phase (RP)

flash chromatography on a C18 column with a gradient of 20% ACN in water with 0.1% TFA to 60% ACN in water with 0.1% TFA over 10 minutes. Pure fractions were isolated, combined, frozen, and lyophilized to yield N-(3-(3-borono-5-nitrobenzamido)propyl)-N-(3-borono-5-nitrobenzoyl)glycine (DS01) as a white powder (7 mg).

Similar procedures are followed for the synthesis of aromatic boron-containing groups DS02-DS48.

Method A2: Synthesis of Symmetric Diboronates with C-Terminus Linker DS49-DS53

Tentagel-S—NH₂ resin (250 mg, 0.05 mmol) was swelled in DMF (5 mL) for 2 hr. The solution was removed under a stream of nitrogen and a solution of Boc-Gly-HMBA (0.2 mmol) was coupled using 1-[Bis(dimethylamino)methylene]-1H-1,2,3-triazolo[4,5-b]pyridinium 3-oxide hexafluorophosphate (HATU, 76 mg, 0.2 mmol), and DIPEA (70 ul) in DMF (2 mL) was added to the resin and mixed at room temperature for 45 minutes. The resin was washed with DMF (3×5 mL) and DCM (3×5 mL). A solution of 50% trifluoroacetic acid in DCM (5 mL) was added to the resin and mixed for 20 minutes to remove the Boc protecting group. This step was repeated twice. The resin was washed with DCM (3×5 mL) and DMF (3×5 mL) and was treated with a solution of 10% DIEA in DMF (5 mL) for 10 minutes, the cycle was repeated twice, and resin was washed with DMF(3×5 mL). A solution of 1-(((9H-fluoren-9-yl)methoxy)carbonyl)-4-((((9H-fluoren-9-yl)methoxy)carbonyl)amino)pyrrolidine-2-carboxylic acid (0.115 g, 0.2 mmol) with 1-[Bis(dimethylamino)methylene]-1H-1,2,3-triazolo[4,5-b]pyridinium 3-oxide hexafluorophosphate (HATU, 0.2 mmol), and DIPEA (70 ul) in DMF (2 mL) was added to the resin and mixed for 45 minutes. The resin was washed with DMF (3×5 mL) and a solution of 20% piperidine in DMF (5 mL×3) was added to resin and mixed for 5 minutes. The resin was washed with DMF (3×5 mL) and a solution of 1-hydroxy-1,3-dihydrobenzo[c][1,2]oxaborole-6-carboxylic acid (0.078 g, 0.4 mmol) with HATU (0.4 mmol) and DIPEA (140 uL) in DMF (2 mL) was added to the resin and mixed for 45 minutes. The resin was washed with DMF (3×5 mL) then DCM (3×5 mL). A solution of 0.1 M NaOH in 1:5 water:THF was added to the resin and mixed for 90 minutes. The solution was filtered and adjusted the pH-2 using 1.0 M HCl and fractionated by reverse-phase (RP) flash chromatography on a C18 column with a gradient of 20% ACN in water with 0.1% TFA to 60% ACN in water with 0.1% TFA over 10 minutes. Pure fractions were isolated, combined, frozen, and lyophilized to yield ((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)glycine (DS49) as a white powder (10 mg).

Similar procedures are followed for the synthesis of aromatic boron-containing groups DS50-DS53.

Method A3: Synthesis of Diboronates with Reductive Alkylation on Side Chain Amine DS54-DS63

Rink-amide resin (0.05 mmol, 263 mg) was swelled in DMF (5 mL) for 20 minutes. The solution was removed under a stream of nitrogen and a solution of 20% piperidine in DMF (5 mL) was added to resin and mixed for 5 minutes. The resin was washed with DMF (3×5 mL). A solution of ((S)-2-((((9H-fluoren-9-yl)methoxy)carbonyl)amino)-3-((diphenyl(p-tolyl)methyl)amino) propanoic acid (116 mg, 0.2 mmol) with 1-[Bis(dimethylamino)methylene]-1H-1,2,3-triazolo[4,5-b]pyridinium 3-oxide hexafluorophosphate (HATU, 76 mg, 0.2 mmol), and DIPEA (70 ul) in DMF (2 mL) was added to the resin and mixed at room temperature for 45 minutes. The resin was washed with DMF (3×5 mL)

and DCM (3×5 mL). A solution of 0.2% trifluoroacetic acid in DCM (5 mL) was added to the resin and mixed for 10 minutes to remove Mtt protecting group. This step was repeated twice. The resin was washed with DCM (3×5 mL) and DMF (3×5 mL) and was treated with a solution of 10% DIEA in DMF (5 mL) for 10 minutes, the cycle was repeated twice, and resin was washed with DMF(3×5 mL). A solution of benzaldehyde (0.053 g, 0.5 mol) in trimethyl orthoformate (TMOF) (2 mL) was added to the resin and mixed for 1 hr. The solution was filtered, and resin was washed with DMF (3×5 mL) and 10% acetic acid in methanol (2×5 mL). The solution of NaCNBH₃ (10 equivalents) in 10% acetic acid in methanol was added to the resin and mixed for 1 hr, washed with DMF (3×5 mL). The resin was treated with 20% piperidine in DMF (3×5 mL) to deprotect the Fmoc, washed with DMF (3×5 mL) and coupled with 1-hydroxy-1,3-dihydrobenzo[c][1,2]oxaborole-6-carboxylic acid (0.078 g, 0.4 mmol) using 1-[Bis(dimethylamino)methylene]-1H-1,2,3-triazolo[4,5-b]pyridinium 3-oxide hexafluorophosphate (HATU, 152 mg, 0.4 mmol), and DIPEA (140 ul) in DMF (2 mL) for 45 minutes. After coupling reaction, the resin was washed with DMF (3×5 mL) then with DCM (2×5 mL). A solution of trifluoroacetic acid with triisopropyl silane and water (95:2.5:2.5, 5 mL) was added to the resin and mixed for 90 minutes. The solution was collected and dried under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes. Pure fractions were isolated, combined, frozen, and lyophilized to yield (S)—N-(3-amino-2-(1-hydroxy-1,3-dihydrobenzo[c][1,2]oxaborole-6-carboxamido)-3-oxopropyl)-N-benzyl-1-hydroxy-1,3-dihydrobenzo[c][1,2]oxaborole-6-carboxamide (DS54) as a white powder (7 mg).

Similar procedures are followed for the synthesis of aromatic boron-containing groups DS55-DS63.

Method A4: Synthesis of Symmetric Diboronates Based on Amino Acids DS64-DS76, DS109-DS111

Rink-amide resin (0.05 mmol, 263 mg) was swelled in DMF (5 mL) for 20 minutes. The solution was removed under a stream of nitrogen and a solution of 20% piperidine in DMF (5 mL) was added to resin and mixed for 5 minutes. The resin was washed with DMF (3×5 mL). A solution of 1-(((9H-fluoren-9-yl)methoxy)carbonyl)-4-((((9H-fluoren-9 yl)methoxy) carbonyl) amino) pyrrolidine-2-carboxylic acid (0.115 g, 0.2 mmol) with 1-[Bis(dimethylamino)methylene]-1H-1,2,3-triazolo[4,5-b]pyridinium 3-oxide hexafluorophosphate (HATU, 0.2 mmol), and DIPEA (70 ul) in DMF (2 mL) was added to the resin and mixed at 50° C. for 20 minutes. The resin was washed with DMF (3×5 mL) and a solution of 20% piperidine in DMF (5 mL) was added to the resin and mixed for 5 minutes. The resin was washed with DMF (3×5 mL) and a solution of 1-hydroxy-1,3-dihydrobenzo[c][1,2]oxaborole-6-carboxylic acid (0.078 g, 0.4 mmol) with HATU (0.4 mmol) and DIPEA (140 uL) in DMF (2 mL) was added to the resin and mixed at 50° C. for 30 minutes. The resin was washed with DMF (3×5 mL) then with DCM (3×5 mL). A solution of trifluoroacetic acid with triisopropyl silane and water (95:2.5:2.5, 5 mL) was added to the resin and mixed for 90 minutes. The solution was collected and dried under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes. Pure fractions were isolated, combined, frozen, and lyophilized to yield (3-((2S,4S)-4-(5-borono-2-

(methylsulfonyl)benzamido)-2-carbamoylpyrrolidine-1-carbonyl)-4-(methylsulfonyl)phenyl)boronic acid (DS64) as a white powder (10 mg).

Similar procedures are followed for the synthesis of aromatic boron-containing groups DS65-DS76. Similar procedure can be followed for the synthesis of diboronate sensors DS109-DS111 noting that the resin used is 2-chlorotrityl resin and not the Amine Rink-amide resin.

Method A5: Asymmetric Diboronate Synthesis DS77-DS79

Tentagel-S—NH₂ resin (250 mg, 0.05 mmol) was swelled in DMF (5 mL) for 2 hr. The solution was removed under a stream of nitrogen and a solution of Boc-Gly-HMBA (0.2 mmol) was coupled using 1-[Bis(dimethylamino)methylene]-1H-1,2,3-triazolo[4,5-b]pyridinium 3-oxide hexafluorophosphate (HATU, 76 mg, 0.2 mmol), and DIPEA (70 ul) in DMF (2 mL) was added to the resin and mixed at room temperature for 45 minutes. The resin was washed with DMF (3×5 mL) and DCM (3×5 mL). A solution of 50% trifluoroacetic acid in DCM (5 mL) was added to the resin and mixed for 20 minutes. To remove Boc protecting group. This step was repeated twice. The resin was washed with DCM (3×5 mL) and DMF (3×5 mL) and was treated with a solution of 10% DIEA in DMF (5 mL) for 10 minutes, the cycle was repeated twice, and resin was washed with DMF (3×5 mL). A solution of 1-(((9H-fluoren-9-yl)methoxy)carbonyl)-4-((tert-butoxycarbonyl)amino)pyrrolidine-2-carboxylic acid (0.09 g, 0.2 mmol) with 1-[Bis(dimethylamino)methylene]-1H-1,2,3-triazolo[4,5-b]pyridinium 3-oxide hexafluorophosphate (HATU, 0.2 mmol), and DIPEA (70 ul) in DMF (2 mL) was added to the resin and mixed for 45, minutes. The resin was washed with DMF (3×5 mL) and a solution of 20% piperidine in DMF (5 mL×3) was added to resin and mixed for 5 minutes. The resin was washed with DMF (3×5 mL) and a solution of 1-hydroxy-1,3-dihydrobenzo[c][1,2]oxaborole-6-carboxylic acid (0.039 g, 0.2 mmol) with HATU (0.076 g, 0.2 mmol) and DIPEA (140 uL) in DMF (2 mL) was added to the resin and mixed for 45 minutes and DCM (3×5 mL). A solution of 50% trifluoroacetic acid in DCM (5 mL) was added to the resin and mixed for 20 minutes, to remove Boc protecting group. This step was repeated twice. The resin was washed with DCM (3×5 mL) and DMF (3×5 mL) and was treated with a solution of 10% DIEA in DMF (5 mL) for 10 minutes, the cycle was repeated twice, and resin was washed with DMF(3×5 mL). A solution of 5-borono-2-nitrobenzoic acid (0.042 g, 0.2 mmol) with HATU (0.076 g, 0.2 mmol) and DIPEA (140 uL) in DMF (2 mL) was added to the resin and mixed for 45 minutes. The resin was washed with DMF (3×5 mL) then DCM (3×5 mL). A solution of 0.1M NaOH in 1:5 water:THF was added to the resin and mixed for 90 minutes. The solution was filtered and adjusted the pH-2 using 1.0 M HCl and fractionated by reverse-phase (RP) flash chromatography on a C18 column with a gradient of 20% ACN in water with 0.1% TFA to 60% ACN in water with 0.1% TFA over 10 minutes. Pure fractions were isolated, combined, frozen, and lyophilized to yield ((2S,4S)-1-(5-borono-2-nitrobenzoyl)-4-(1-hydroxy-1,3-dihydrobenzo[c][1,2]oxaborole-6-carboxamido)pyrrolidine-2-carbonyl)glycine (DS77) as a white powder (8 mg).

Similar procedures are followed for the synthesis of aromatic boron-containing groups DS78-DS79.

Method A6: Synthesis of Diboronates with Reductive Alkylation on Side Chain DS80-DS109

Amine Rink-amide resin (0.05 mmol, 263 mg) was swelled in DMF (5 mL) for 20 minutes. The solution was removed under a stream of nitrogen and a solution of 20% piperidine in DMF (5 mL) was added to resin and mixed for 5 minutes. The resin was washed with DMF (3×5 mL). A solution of N6-(((9H-fluoren-9-yl)methoxy)carbonyl)-N2-(tert-butoxycarbonyl)lysine (93.6 mg, 0.2 mmol) with 1-[Bis(dimethylamino)methylene]-1H-1,2,3-triazolo[4,5-b]pyridinium 3-oxide hexafluorophosphate (HATU, 76 mg, 0.2 mmol), and DIPEA (70 ul) in DMF (2 mL) was added to the resin and mixed at room temperature for 45 minutes. The resin was washed with DMF (3×5 mL). The Fmoc was removed with 20% piperidine in DMF (2×5 mL) and then washed with additional DMF (3×10 mL) A solution of 4-methyl-3-(4,4,5,5-tetramethyl-1,3,2-dioxaborolan-2-yl)benzaldehyde (123 mg, 0.5 mol) in trimethyl orthoformate (TMOF) (2 mL) was added to the resin and mixed for 1 hr. The solution was filtered, and resin was washed with DMF (3×5 mL) and a solution of NaBH$_4$ (10 equivalents) in 20% methanol in DMF was added to the resin and mixed for 1 hr, washed with DMF (3×5 mL). The reduced amine was then coupled with 3-nitro-5-(4,4,5,5-tetramethyl-1,3,2-dioxaborolan-2-yl)benzoic acid (117 mg, 0.4 mmol) using 1-[Bis(dimethylamino)methylene]-1H-1,2,3-triazolo[4,5-b]pyridinium 3-oxide hexafluorophosphate (HATU, 152 mg, 0.4 mmol), and DIPEA (140 ul) in DMF (2 mL) for 45 minutes. After coupling reaction, the resin was washed with DMF (3×5 mL) then with DCM (2×5 mL). A solution of trifluoroacetic acid with triisopropyl silane and water (95:2.5:2.5, 5 mL) was added to the resin and mixed for 90 minutes. The solution was collected and dried under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes. Pure fractions were isolated, combined, frozen, and lyophilized to yield diboronate sensor DS80 as a white powder (10 mg). Similar procedure was followed for the synthesis of diboronate sensors DS81-DS109.

Method A7: Synthesis of Diboronated Sensors DS139 and DS139A

On Resin Synthesis of Diboronated Sensor:

2-Chlorotrityl resin 1 (0.30 g, 0.3 mmol) was swelled in dry DCM (5 mL) for 30 mins. Solvent was removed with nitrogen and a solution of (S)-4-((((9H-fluoren-9yl)methoxy)carbonyl)amino)-5-(tert-butoxy)-5-oxopentanoic acid 2 (127 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of (S)-2,3-bis((((9H-fluoren-9-yl)methoxy)carbonyl)amino)propanoic acid 4 (0.219 g, 0.4 mmol), DIPEA (0.14 ml, 0.8 mmol) and HATU (0.152 g, 0.4 mmol) in DMF (5 mL) was added to the resin and heated at 50° C. for 30 min, washed with DMF (4×5 mL) to obtain 5. Resin was treated with 20% piperidine in DMF for 5 minutes (3×5 mL) and washed with DMF (4×5 mL). Solution of 1-hydroxy-3,4-dihydro-1H-benzo[c][1,2]oxaborinine-7-carboxylic acid 6 (0.192 g, 1 mmol), HATU (0.380 g, 1 mmol) and DIPEA (0.35 mL, 2 mmol) were added to the resin and heated at 50° C. for 30 min to get 7. The resin was washed with DMF (4×5 mL) and DCM (3×5 mL).

Cleavage of Diboronated Sensor from Resin

Compound 7 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DS139-OtBu which was used in the next step without purification. The Boc protecting group of DS139 can be removed under acidic conditions to give DS139.

Figure 11:
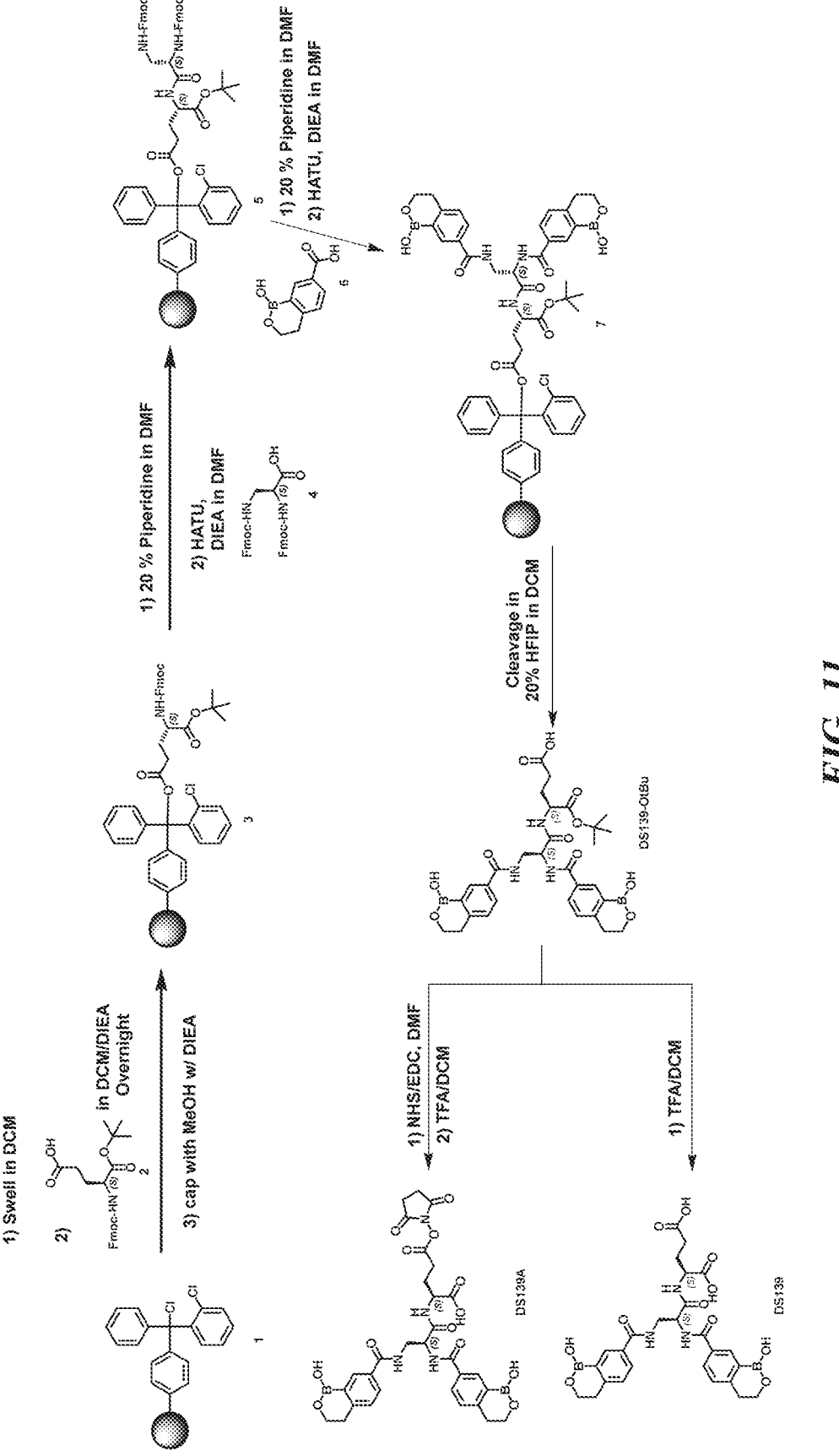

NHS-Activation of Diboronated Sensor:

Crude diboronated sensor acid DS139-OtBu was dissolved in DMF (2 mL) and treated with 3-(3-Dimethylaminopropyl)-1-ethyl-carbodiimide hydrochloride (EDC) (0.096 g, 0.5 mmol), N-hydroxysuccinimide (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and evaporated under vacuum. The tert-butyl protecting group was removed with TFA in DCM (50%), allowed to mix for 1 hour, reduced under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DS139A as a white powder. The foregoing synthesis is illustrated in FIG. 11.

Method 8: Synthesis of Diboronated Sensors DS149 and DS149A

2-Chlorotrityl resin 1 (0.30 g, 0.3 mmol) was swelled in dry DCM (5 mL) for 30 mins. Solvent was removed with nitrogen and a solution of (S)-2,3-bis((((9H-fluoren-9-yl)methoxy)carbonyl)amino)propanoic acid 2 (164 mg, 0.3 mmol) in DCM with DIPEA (0.3 mL, 1.7 mmol) was added immediately and gently mixed for overnight. The mixture was washed with DCM and unreacted sites were capped with a solution of 20% MeOH in a solution of DCM and DIPEA (1M) and mixed for 1 hr to yield 3. The resin was washed with DCM (3×5 mL), then DMF (3×5 mL) and treated with 20% piperidine in DMF for 5 minutes (3×5 mL), washed with DMF (4×5 mL). Solution of 1-hydroxy-3,4-dihydro-1H-benzo[c][1,2]oxaborinine-7-carboxylic acid 4 (0.192 g, 1 mmol), HATU (0.380 g, 1 mmol) and DIPEA (0.35 mL, 2 mmol) were added to the resin and heated at 50° C. for 30 min to get 5. The resin was washed with DMF (4×5 mL) and DCM (3×5 mL).

Cleavage of Diboronated Sensor from Resin

Compound 5 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DS149 which was used in the next step without purification.

NHS-Activation of Diboronated Sensor:

Crude diboronated sensor acid DS149 was dissolved in DMF (2 mL) and treated with 3-(3-Dimethylaminopropyl)-1-ethyl-carbodiimide hydrochloride (EDC) (0.096 g, 0.5 mmol), N-hydroxysuccinimide (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and evaporated under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give DS149A as a white powder.

Figure 12:
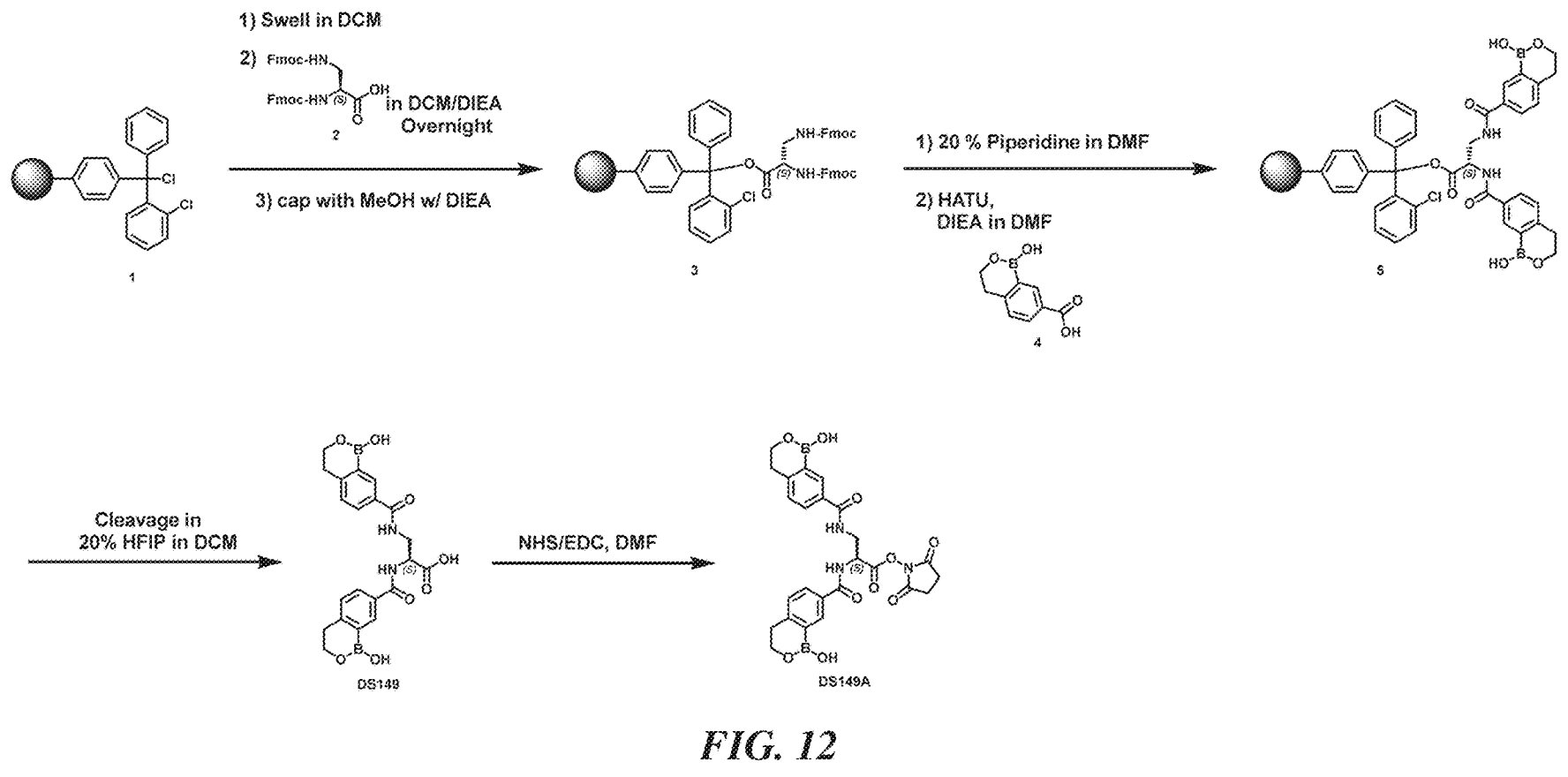

Similar procedures can be followed for the synthesis of aromatic boron-containing groups DS118-DS122 and DS148-DS152. The foregoing synthesis is illustrated in FIG. 12.

The chemical structure and IUPAC name of DS1 to DS109 and DS113 to DS152 are summarized in Table 1 below.

TABLE 1

| Compd # | FF | F | Structure/IUPAC Name |
|---|---|---|---|
| DS01 | FF10 | F1 | N-(3-(3-borono-5-nitrobenzamido)propyl)-N-(3--borono-5-nitrobenzoyl)glycine |
| DS02 | FF217 | F1 | N-(4-((4-(3-borono-5-nitrobenzamido)cyclohexyl)methyl)cyclohexyl)-N-(3-borono-5-nitrobenzoyl)glycine |
| DS03 | FF8 | F1 | N-(4-((3-borono-5-nitrobenzamido)methyl)benzyl)-N-(3-borono-5-nitrobenzoyl)glycine |

TABLE 1-continued

| Compd # | FF | F | Structure/IUPAC Name |
|---------|-----|-----|----------------------|

DS04    FF14    F1

N-(3-((3-borono-5-nitrobenzamido)methyl)benzyl)-N-(3-borono-5-
nitrobenzoyl)glycine

DS05    FF10    F1

N-(4-(3-borono-5-nitrobenzamido)butyl)-N-(3-borono-5-
nitrobenzoyl)glycine

DS06    FF10    F1

N-(3-(3-borono-5-fluorobenzamido)propyl)-N-(3-borono-5-
fluorobenzoyl)glycine

TABLE 1-continued

| Compd # | FF | F | Structure/IUPAC Name |
|---|---|---|---|
| DS07 | FF213 | F1 | <br>N-(3-(3-borono-5-fluorobenzamido)-2,2-dimethylpropyl)-N-(3-borono-5-fluorobenzoyl)glycine |
| DS08 | FF214 | F1 | <br>bis(3-(3-borono-5-fluorobenzamido)propyl)glycine |
| DS09 | FF8 | F1 | <br>N-(4-((3-borono-5-fluorobenzamido)methyl)benzyl)-N-(3-borono-5-fluorobenzoyl)glycine |
| DS10 | FF14 | F | |

TABLE 1-continued

| Compd # | FF | F | Structure/IUPAC Name |
|---------|----|----|----------------------|

N-(3-((3-borono-5-fluorobenzamido)methyl)benzyl)-N-(3-borono-5-fluorobenzoyl)glycine

| DS11 | FF1 | F1 | |

N-(2-(3-borono-5-fluorobenzamido)cyclohexyl)-N-(3-borono-5-fluorobenzoyl)glycine

| DS12 | FF10 | F1 | |

N-(3-(3-borono-4-fluorobenzamido)propyl)-N-(3-borono-4-fluorobenzoyl)glycine

| DS13 | FF217 | F1 | |

N-(4-((4-(3-borono-4-fluorobenzamido)cyclohexyl)methyl)cyclohexyl)-N-(3-borono-4-fluorobenzoyl)glycine TABLE 1-continued

| Compd # | FF | F | Structure/IUPAC Name |
|---|---|---|---|
| DS14 | FF213 | F1 | N-(3-(3-borono-4-fluorobenzamido)-2,2-dimethylpropyl)-N-(3-borono-4-fluorobenzoyl)glycine |
| DS15 | FF8 | F1 | N-(4-((3-borono-4-fluorobenzamido)methyl)benzyl)-N-(3-borono-4-fluorobenzoyl)glycine |
| DS16 | FF14 | F1 | N-(3-((3-borono-4-fluorobenzamido)methyl)benzyl)-N-(3-borono-4-fluorobenzoyl)glycine |
| DS17 | FF1 | F1 | N-((1S,2R)-2-(3-borono-4-fluorobenzamido)cyclohexyl)-N-(3-borono-4-fluorobenzoyl)glycine |

TABLE 1-continued

| Compd # | FF | F | Structure/IUPAC Name |
|---------|-----|-----|---------------------|

DS18　FF1　F1

N-((1S,2S)-2-(3-borono-4-fluorobenzamido)cyclohexyl)-N-(3-
borono-4-fluorobenzoyl)glycine

DS19　FF10　F1

N-(3-(3-borono-5-bromobenzamido)propyl)-N-(3-borono-5-
bromobenzoyl)glycine

DS20　FF217　F1

N-(4-((4-(3-borono-5-
bromobenzamido)cyclohexyl)methyl)cyclohexyl)-N-(3-borono-5-
bromobenzoyl)glycine TABLE 1-continued

| Compd # | FF | F | Structure/IUPAC Name |
|---|---|---|---|

DS21 FF214 F1 bis(3-(3-borono-5-bromobenzamido)propyl)glycine

DS22 FF8 F1

N-(4-((3-borono-5-bromobenzamido)methyl)benzyl)-N-(3-borono-5-bromobenzoyl)glycine

DS23 FF14 F1

N-(3-((3-borono-5-bromobenzamido)methyl)benzyl)-N-(3-borono-5-bromobenzoyl)glycine

DS24 FF1 F1

N-(2-(3-borono-5-bromobenzamido)cyclohexyl)-N-(3-borono-5-bromobenzoyl)glycine

TABLE 1-continued

| Compd # | FF | F | Structure/IUPAC Name |
|---------|-----|-----|----------------------|

DS25 FF10 F1

N-(3-(4-borono-3-fluorobenzamido)propyl)-N-(4-borono-3-
fluorobenzoyl)glycine

DS26 FF217 F1

N-(4-((4-(4-borono-3-
fluorobenzamido)cyclohexyl)methyl)cyclohexyl)-N-(4-borono-3-
fluorobenzoyl)glycine

DS27 FF213 F1

N-(3-(4-borono-3-fluorobenzamido)-2,2-dimethylpropyl)-N-(4-
borono-3-fluorobenzoyl)glycine TABLE 1-continued

| Compd # | FF | F | Structure/IUPAC Name |
|---------|-----|-----|----------------------|

DS28　FF214　F1 bis(3-(4-borono-3-fluorobenzamido)propyl)glycine

DS29　FF8　F1

N-(4-((4-borono-3-fluorobenzamido)methyl)benzyl)-N-(4-borono-
3-fluorobenzoyl)glycine

DS30　FF14　F1

N-(3-((4-borono-3-fluorobenzamido)methyl)benzyl)-N-(4-borono-
3-fluorobenzoyl)glycine

DS31　FF1　F1

N-((1S,2R)-2-(4-borono-3-fluorobenzamido)cyclohexyl)-N-(4-
borono-3-fluorobenzoyl)glycine TABLE 1-continued

| Compd # | FF | F | Structure/IUPAC Name |
|---|---|---|---|
| DS32 | FF10 | F2 | |

N-(1-hydroxxy-1,3-dihydrobenzo[c][1,2]oxaborole-6-carbonyl)-N-
(3-(1-hydroxy-1,3-dihydrobenzo[c][1,2]oxaborole-6-
carboxamido)propyl)glycine

| DS33 | FF10 | F2 | |
|---|---|---|---|

N-(1-hydroxy-1,3-dihydrobenzo[c][1,2]oxaborole-6-carbonyl)-N-
(5-(1-hydroxy-1,3-dihydrobenzo[c][1,2]oxaborole-6-
carboxamido)pentyl)glycine

| DS34 | FF213 | F2 | |
|---|---|---|---|

N-(1-hydroxy-1,3-dihydrobenzo[c][1,2]oxaborole-6-carbonyl)-N-
(3-(1-hydroxy-1,3-dihydrobenzo[c][1,2]oxaborole-6-
carboxamido)-2,2-dimethylpropyl)glycine TABLE 1-continued

| Compd # | FF | F | Structure/IUPAC Name |
|---------|-----|-----|---------------------|
| DS35 | FF214 | F2 | <br>bis(3-(1-hydroxy-1,3-dihydrobenzo[c][1,2]oxaborole-6-carboxamido)propyl)glycine |
| DS36 | FF14 | F2 | <br>N-(1-hydroxy-1,3-dihydrobenzo[c][1,2]oxaborole-6-carbonyl)-N-(3-((1-hydroxy-1,3-dihydrobenzo[c][1,2]oxaborole-6-carboxamido)methyl)benzyl)glycine |
| DS37 | FF1 | F2 | <br>N-(1-hydroxy-1,3-dihydrobenzo[c][1,2]oxaborole-6-carbonyl)-N-((1S,2R)-2-(1-hydroxy-1,3-dihydrobenzo[c][1,2]oxaborole-6-carboxamido)cyclohexyl)glycine |

TABLE 1-continued

| Compd # | FF | F | Structure/IUPAC Name |
|---|---|---|---|
| DS38 | FF10 | F2 | |

N-(1-hydroxy-1,3-dihydrobenzo[c][1,2]oxaborole-6-carbonyl)-N-
(4-(1-hydroxy-1,3-dihydrobenzo[c][1,2]oxaborole-6-
carboxamido)butyl)glycine

| DS39 | FF1 | F2 | |

N-(1-hydroxy-1,3-dihydrobenzo[c][1,2]oxaborole-6-carbonyl)-N-
((1S,2S)-2-(1-hydroxy-1,3-dihydrobenzo[c][1,2]oxaborole-6-
carboxamido)cyclohexyl)glycine

| DS40 | FF15 | F2 | |

(R)-N-(1-hydroxy-1,3-dihydrobenzo[c][1,2]oxaborole-6-carbonyl)-
N-(2-(1-hydroxy-1,3-dihydrobenzo[c][1,2]oxaborole-6-
carboxamido)propyl)glycine TABLE 1-continued

| Compd # | FF | F | Structure/IUPAC Name |
|---------|-----|-----|----------------------|

DS41    FF15    F2

(S)-N-(1-hydroxy-1,3-dihydrobenzo[c][1,2]oxaborole-6-carbonyl)-
N-(2-(1-hydroxy-1,3-dihydrobenzo[c][1,2]oxaborole-6-
carboxamido)propyl)glycine

DS42    FF1    F2

N-(1-hydroxy-1,3-dihydrobenzo[c][1,2]oxaborole-6-carbonyl)-N-
(2-(1-hydroxy-1,3-dihydrobenzo[c][1,2]oxaborole-6-
carboxamido)cyclohexyl)glycine

DS43    FF10    F1

N-(3-(4-borono-3,5-difluorobenzamido)propyl)-N-(4-borono-3,5-
difluorobenzoyl)glycine TABLE 1-continued

| Compd # | FF | F | Structure/IUPAC Name |
|---|---|---|---|
| DS44 | FF10 | F1 |  N-(3-(4-borono-2-fluorobenzamido)propyl)-N-(4-borono-2-fluorobenzoyl)glycine |
| DS45 | FF215 | F2 |  N-(2-(N-ethyl-1-hydroxy-1,3-dihydrobenzo[c][1,2]oxaborole-6-carboxamido)ethyl)-N-(1-hydroxy-1,3-dihydrobenzo[c][1,2]oxaborole-6-carbonyl)glycine |
| DS46 | FF215 | F2 |  N-(1-hydroxy-1,3-dihydrobenzo[c][1,2]oxaborole-6-carbonyl)-N-(2-(1-hydroxy-N-(2-hydroxyethyl)-1,3-dihydrobenzo[c][1,2]oxaborole-6-carboxamido)ethyl)glycine |

TABLE 1-continued

| Compd # | FF | F | Structure/IUPAC Name |
|---|---|---|---|
| DS47 | FF216 | F2 | |

N-(1-hydroxy-1,3-dihydrobenzo[c][1,2]oxaborole-6-carbonyl)-N-
(5-(1-hydroxy-1,3-dihydrobenzo[c][1,2]oxaborole-6-
carboxamido)hexyl)glycine

| DS48 | FF217 | F2 | |
|---|---|---|---|

N-(1-hydroxy-1,3-dihydrobenzo[c][1,2]oxaborole-6-carbonyl)-N-
(4-((4-(1-hydroxy-1,3-dihydrobenzo[c][1,2]oxaborole-6-
carboxamido)cyclohexyl)methyl)cyclohexyl)glycine

| DS49 | FF12 | F2 | |
|---|---|---|---|

((2S,4S)-1-(1-hydroxy-1,3-dihydrobenzo[c][1,2]oxaborole-6-
carbonyl)-4-(1-hydroxy-1,3-dihydrobenzo[c][1,2]oxaborole-6-
carboxamido)pyrrolidine-2-carbonyl)glycine TABLE 1-continued

| Compd # | FF | F | Structure/IUPAC Name |
|---|---|---|---|

DS50 FF12 F1

((2S,4S)-4-(3-borono-4-fluorobenzamido)-1-(3-borono-4-
fluorobenzoyl)pyrrolidine-2-carbonyl)glycine

DS51 FF12 F1

((2S,4S)-4-(3-borono-5-nitrobenzamido)-1-(3-borono-5-
nitrobenzoyl)pyrrolidine-2-carbonyl)glycine

DS52 FF12 F1

((2S,4S)-4-(5-borono-2-fluorobenzamido)-1-(5-borono-2-
fluorobenzoyl)pyrrolidine-2-carbonyl)glycine TABLE 1-continued

| Compd # | FF | F | Structure/IUPAC Name |
|---|---|---|---|
| DS53 | FF9 | F2 |
(S)-(1,4-bis(1-hydroxy-1,3-dihydrobenzo[c][1,2]oxaborole-6-carbonyl)piperazine-2-carbonyl)glycine |
| DS54 | FF208 | F2 |
(S)-N-(3-amino-2-(1-hydroxy-1,3-dihydrobenzo[c][1,2]oxaborole-6-carboxamido)-3-oxopropyl)-N-benzyl-1-hydroxy-1,3-dihydrobenzo[c][1,2]oxaborole-6-carboxamido |
| DS55 | FF208 | F2 |
(S)-N-(3-amino-2-(1-hydroxy-1,3-dihydrobenzo[c][1,2]oxaborole-6-carboxamido)-3-oxopropyl)-1-hydroxy-N-(4-(trifluoromethyl)benzyl)-1,3-dihydrobenzo[c][1,2]oxaborole-6-carboxamide |

TABLE 1-continued

| Compd # | FF | F | Structure/IUPAC Name |
|---|---|---|---|
| DS56 | FF208 | F2 | (S)-N-(3-amino-2-(1-hydroxy-1,3-dihydrobenzo[c][1,2]oxaborole-6-carboxamido)-3-oxopropyl)-N-ethyl-1-hydroxy-1,3-dihydrobenzo[c][1,2]oxaborole-6-carboxamide |
| DS57 | FF208 | F2 | (S)-N-(3-amino-2-(1-hydroxy-1,3-dihydrobenzo[c][1,2]oxaborole-6-carboxamido)-3-oxopropyl)-1-hydroxy-N-propyl-1,3-dihydrobenzo[c][1,2]oxaborole-6-carboxamide |
| DS58 | FF208 | F2 | (S)-N-(3-amino-2-(1-hydroxy-1,3-dihydrobenzo[c][1,2]oxaborole-6-carboxamido)-3-oxopropyl)-1-hydroxy-N-isobutyl-1,3-dihydrobenzo[c][1,2]oxaborole-6-carboxamide |

TABLE 1-continued

| Compd # | FF | F | Structure/IUPAC Name |
|---|---|---|---|
| DS59 | FF208 | F2 | |

(S)-N-(3-amino-2-(1-hydroxy-1,3-dihydrobenzo[c][1,2]oxaborole-
6-carboxamido)-3-oxopropyl)-1-hydroxy-N-((5-(thiophen-2-
yl)pyridin-2-yl)methyl)-1,3-dihydrobenzo[c][1,2]oxaborole-6-
carboxamide

| DS60 | FF208 | F2 | |

(S)-N-(3-amino-2-(1-hydroxy-1,3-dihydrobenzo[c][1,2]oxaborole-
6-carboxamido)-3-oxopropyl)-1-hydroxy-N-isopentyl-1,3-
dihydrobenzo[c][1,2]oxaborole-6-carboxamide

| DS61 | FF208 | F2 | |

TABLE 1-continued

| Compd # | FF | F | Structure/IUPAC Name |
|---------|-----|-----|----------------------|

(S)-N-(3-amino-2-(1-hydroxy-1,3-dihydrobenzo[c][1,2]oxaborole-6-carboxamido)-3-oxopropyl)-1-hydroxy-N-(quinolin-5-ylmethyl)-1,3-dihydrobenzo[c][1,2]oxaborole-6-carboxamide

| DS62 | FF208 | F2 |

(S)-N-(3-amino-2-(1-hydroxy-1,3-dihydrobenzo[c][1,2]oxaborole-6-carboxamido)-3-oxopropyl)-1-hydroxy-N-(2-(trifluoromethoxy)benzyl)-1,3-dihydrobenzo[c][1,2]oxaborole-6-carboxamide

| DS63 | FF208 | F2 |

(S)-N-(3-amino-2-(1-hydroxy-1,3-dihydrobenzo[c][1,2]oxaborole-6-carboxamido)-3-oxopropyl)-1-hydroxy-N-(4-(methylsulfonyl)benzyl)-1,3-dihydrobenzo[c][1,2]oxaborole-6-carboxamide

| DS64 | FF12 | F1 |

TABLE 1-continued

| Compd # | FF | F | Structure/IUPAC Name |
|---|---|---|---|

(3-((2S,4S)-4-(5-borono-2-(methylsulfonyl)benzamido)-2-
carbamoylpyrrolidine-1-carbonyl)-4-
(methylsulfonyl)phenyl)boronic acid

| DS65 | FF12 | F1 | |

(4-(((3S,5S)-1-(4-borono-2,6-difluorobenzoyl)-5-
carbamoylpyrrolidin-3-yl)carbamoyl)-3,5-difluorophenyl)benzoic
acid

| DS66 | FF20 | F2 | |

(R,E)-4,5-bis(1-hydroxy-1,3-dihydrobenzo[c][1,2]oxaborole-6-
carboxamido)pent-2-enoic acid TABLE 1-continued

| Compd # | FF | F | Structure/IUPAC Name |
|---------|-----|-----|---------------------|

DS67   FF12   F2

(2S,4S)-1-(1-hydroxy-4-(trifluoromethyl)-1,3-
dihydrobenzo[c][1,2]oxaborole-6-carbonyl)-4-(1-hydroxy-4-
(trifluoromethyl)-1,3-dihydrobenzo[c][1,2]oxaborole-6-
carboxamido)pyrrolidine-2-carboxamide

DS68   FF116   F2

N,N'-((2S,3S)-1-amino-1-oxobutane-2,3-diyl)bis(1-hydroxy-1,3-
dihydrobenzo[c][1,2]oxaborole-6-carboxamide)

DS69   FF115   F2

TABLE 1-continued

| Compd # | FF | F | Structure/IUPAC Name |
|---------|-----|-----|---------------------|

(R)-3,4-bis(1-hydroxy-1,3-dihydrobenzo[c][1,2]oxaborole-6-carboxamido)butanoic acid

DS70    FF12    F2

3-((2S,4S)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)propanoic acid

DS71    FF115    F2

(S)-3-(1-hydroxy-1,3-dihydrobenzo[c][1,2]oxaborole-5-carboxamido)-4-(1-hydroxy-1,3-dihydrobenzo[c][1,2]oxaborole-6-carboxamido)butanoic acid

DS72    FF14    F2

(R)-4-(1-hydroxy-1,3-dihydrobenzo[c][1,2]oxaborole-5-carboxamido)-5-(1-hydroxy-1,3-dihydrobenzo[c][1,2]oxaborole-6-carboxamido)pentanoic acid TABLE 1-continued

| Compd # | FF | F | Structure/IUPAC Name |
|---|---|---|---|
| DS73 | FF12 | F2 | (2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxylic acid |
| DS74 | FF12 | F2 | (2S,4R)-1-(1-hydroxy-4-(trifluoromethyl)-1,3-dihydrobenzo[c][1,2]oxaborole-6-carbonyl)-4-(1-hydroxy-4-(trifluoromethyl)-1,3-dihydrobenzo[c][1,2]oxaborole-6-carboxamido)pyrrolidine-2-carboxylic acid |
| DS75 | FF16 | F2 | (2S,3S)-3-(1-hydroxy-4-(trifluoromethyl)-1,3-dihydrobenzo[c][1,2]oxaborole-6-carboxamido)-2-(1-hydroxy-7-(trifluoromethyl)-1,3-dihydrobenzo[c][1,2]oxaborole-5-carboxamido)butanoic acid |

TABLE 1-continued

| Compd # | FF | F | Structure/IUPAC Name |
|---------|-----|-----|----------------------|

DS76    FF114    F2

(R)-5-(1-hydroxy-4-(trifluoromethyl)-1,3-
dihydrobenzo[c][1,2]oxaborole-6-carboxamido)-4-(1-hydroxy-7-
(trifluoromethyl)-1,3-dihydrobenzo[c][1,2]oxaborole-5-
carboxamido)pentanoic acid DS77    FF12    F1
and
F2

((2S,4S)-1-(5-borono-2-nitrobenzoyl)-4-(1-hydroxy-1,3-
dihydrobenzo[c][1,2]oxaborole-6-carboxamido)pyrrolidine-2-
carbonyl)glycine DS78    FF12    F1
and
F2

((2S,4S)-1-(5-borono-2-(methylsulfonyl)benzoyl)-4-(1-hydroxy-
1,3-dihydrobenzo[c][1,2]oxaborole-6-carboxamido)pyrrolidine-2-
carbonyl)glycine TABLE 1-continued

| Compd # | FF | F | Structure/IUPAC Name |
|---|---|---|---|
| DS79 | FF12 | F1 and F2 | ((2S,4S)-1-(3-borono-2,6-difluorobenzoyl)-4-(1-hydroxy-1,3-dihydrobenzo[c][1,2]oxaborole-6-carboxamido)pyrrolidine-2-carbonyl)glycine |
| DS80 | FF221 | F1 | (S)-(3-((3-borono-4-fluorobenzyl)(5,6-diamino-6-oxohexyl)carbamoyl)-5-nitrophenyl)boronic acid |
| DS81 | FF221 | F1 | (S)-(3-((4-borono-3,5-difluorobenzyl)(5,6-diamino-6-oxohexyl)carbamoyl)-5-nitrophenyl)boronic acid |
| DS82 | FF221 | F1 | |

TABLE 1-continued

| Compd # | FF | F | Structure/IUPAC Name |
|---------|-----|-----|---------------------|

(S)-(3-((3-boronobenzyl)(5,6-diamino-6-oxohexyl)carbamoyl)-5-nitrophenyl)boronic acid

DS83    FF221    F1

(S)-(3-((4-borono-2-methoxybenzyl)(5,6-diamino-6-oxohexyl)carbamoyl)-5-nitrophenyl)boronic acid

DS84    FF21    F1

(S)-(3-((4-borono-2-(trifluoromethyl)benzyl)(5,6-diamino-6-oxohexyl)carbamoyl)-5-nitrophenyl)boronic acid

DS85    FF221    F1

(S)-(5-((3-borono-N-(5,6-diamino-6-oxohexyl)-4-fluorobenzamido)methyl)-2-fluorophenyl)boronic acid

DS86    FF221    F1

TABLE 1-continued

| Compd # | FF | F | Structure/IUPAC Name |
|---------|-----|-----|----------------------|
| | | | (S)-(5-((4-borono-3,5-difluorobenzyl)(5,6-diamino-6-oxohexyl)carbamoyl)-2-fluorophenyl)boronic acid |
| DS87 | FF221 | F1 | |
| | | | (S)-(3-((3-borono-N-(5,6-diamino-6-oxohexyl)-4-fluorobenzamido)methyl)phenyl)boronic acid |
| DS88 | FF21 | F1 | |
| | | | (S)-(5-((4-borono-2-methoxybenzyl)(5,6-diamino-6-oxohexyl)carbamoyl)-2-fluorophenyl)boronic acid |
| DS89 | FF221 | F1 | |
| | | | (S)-(5-((4-borono-3-(trifluoromethyl)benzyl)(5,6-diamino-6-oxohexyl)carbamoyl)-2-fluorophenyl)boronic acid |
| DS90 | FF221 | F1 | |

TABLE 1-continued

| Compd # | FF | F | Structure/IUPAC Name |
|---|---|---|---|
| | | | (S)-(4-((3-borono-4-fluorobenzyl)(5,6-diamino-6-oxohexyl)carbamoyl)-2-fluorophenyl)boronic acid |
| DS91 | FF221 | F1 | |
| | | | (S)-(4-((4-borono-3,5-difluorobenzyl)(5,6-diamino-6-oxohexyl)carbamoyl)-2-fluorophenyl)boronic acid |
| DS92 | FF221 | F1 | |
| | | | (S)-(4-((3-boronobenzyl)(5,6-diamino-6-oxohexyl)carbamoyl)-2-fluorophenyl)boronic acid |
| DS93 | FF221 | F1 | |
| | | | (S)-(4-((4-borono-2-methoxybenzyl)(5,6-diamino-6-oxohexyl)carbamoyl)-2-fluorophenyl)boronic acid |
| DS94 | FF221 | F1 | |

TABLE 1-continued

| Compd # | FF | F | Structure/IUPAC Name |
|---------|-----|-----|----------------------|
| | | | (S)-(4-((4-borono-2-(trifluoromethyl)benzyl)(5,6-diamino-6-oxohexyl)carbamoyl)-2-fluorophenyl)boronic acid |
| DS95 | FF221 | F1 | |
| | | | (S)-(5-((3-borono-5-bromo-N-(5,6-diamino-6-oxohexyl)benzamido)methyl)-2-fluorophenyl)boronic acid |
| DS96 | FF221 | F1 | |
| | | | (S)-(3-((4-borono-3,5-difluorobenzyl)(5,6-diamino-6-oxohexyl)carbamoyl)-5-bromophenyl)boronic acid |
| DS97 | FF221 | F1 | |
| | | | (S)-(3-((3-borono-5-bromo-N-(5,6-diamino-6-oxohexyl)benzamido)methyl)phenyl)boronic acid |
| DS98 | FF221 | F1 | |

TABLE 1-continued

| Compd # | FF | F | Structure/IUPAC Name |
|---------|-----|-----|-----|

(S)-(3-((3-borono-5-bromo-N-(5,6-diamino-6-oxohexyl)benzamido)methyl)-5-methoxyphenyl)boronic acid

DS99  FF221  F1

(S)-(3-((4-borono-2-(trifluoromethyl)benzyl)(5,6-diamino-6-oxohexyl)carbamoyl)-5-bromophenyl)boronic acid

DS100  FF221  F1

(S)-(3-((3-borono-4-fluorobenzyl)(5,6-diamino-6-oxohexyl)carbamoyl)-5-fluorophenyl)boronic acid

DS101  FF221  F1

(S)-(3-((4-borono-3-methoxybenzyl)(5,6-diamino-6-oxohexyl)carbamoyl)-5-fluorophenyl)boronic acid

DS102  FF221  F1

TABLE 1-continued

| Compd # | FF | F | Structure/IUPAC Name |
|---------|-----|-----|----------------------|

(S)-(3-((4-borono-2-(trifluoromethyl)benzyl)(5,6-diamino-6-
oxohexyl)carbamoyl)-5-fluorophenyl)boronic acid DS103   FF221   F1 and F2

(S)-(4-((N-(5,6-diamino-6-oxohexyl)-1-hydroxy-1,3-
dihydrobenzo[c][1,2]oxaborole-6-carboxamido)methyl)-2-
fluorophenyl)boronic acid DS104   FF221   F1 and F2

(S)-(4-((N-(5,6-diamino-6-oxohexyl)-1-hydroxy-1,3-
dihydrobenzo[c][1,2]oxaborole-6-carboxamido)methyl)-2,6-
difluorophenyl)boronic acid DS105   FF221   F1 and F2

(S)-(3-((N-(5,6-diamino-6-oxohexyl)-1-hydroxy-1,3-
dihydrobenzo[c][1,2]oxaborole-6-
carboxamido)methyl)phenyl)boronic acid TABLE 1-continued

| Compd # | FF | F | Structure/IUPAC Name |
|---|---|---|---|
| DS106 | FF221 | F1 and F2 | <br><br>(S)-(4-((N-(5,6-diamino-6-oxohexyl)-1-hydroxy-1,3-dihydrobenzo[c][1,2]oxaborole-6-carboxamido)methyl)-3-methoxyphenyl)boronic acid |
| DS107 | FF221 | F2 | <br><br>(S)-N-(5,6-diamino-6-oxohexyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide |
| DS108 | FF221 | F2 | <br><br>(S)-N-(4-amino-3-(1-hydroxy-1,3-dihydrobenzo[c][1,2]oxaborole-6-carboxamido)-4-oxobutyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide |

TABLE 1-continued

| Compd # | FF | F | Structure/IUPAC Name |
|---------|-----|-----|----------------------|
| DS109 | FF221 | F2 | <br><br>(S)-N-(6-amino-5-(1-hydroxy-1,3-dihydrobenzo[c][1,2]oxaborole-6-carboxamido)-6-oxohexyl)-1-hydroxy-N-((1-hydroxy-1,3-dihydrobenzo[c][1,2]oxaborol-6-yl)methyl)-1,3-dihydrobenzo[c][1,2]oxaborole-6-carboxamide |
| DS113 | FF225 | F7 | <br><br>N-(1-hydroxy-3,3-dimethyl-1,3-dihydrobenzo[c][1,2]oxaborole-6-carbonyl)-N-(2-(1-hydroxy-3,3-dimethyl-1,3-dihydrobenzo[c][1,2]oxaborole-6-carboxamido)ethyl)glycine |
| DS114 | FF225 | F6 | <br><br>N-(1-hydroxy-3,4-dihydro-1H-benzodihydrobenzo[c][1,2]oxaborinine-7-carbonyl)-N-(2-(1-hydroxy-3,4-dihydro-1H-benzodihydrobenzo[c][1,2]oxaborinine-7-carboxamido)ethyl)glycine |

TABLE 1-continued

| Compd # | FF | F | Structure/IUPAC Name |
|---------|-----|-----|----------------------|

DS115    FF225    F2

N-(2-(2-(1-hydroxy-1,3-dihydrobenzo[c][1,2]oxaborol-7-
yl)acetamido)ethyl)-N-(2-(1-hydroxy-1,3-
dihydrobenzo[c][1,2]oxaborol-7-yl)acetyl)glycine

DS116    FF225    F7

N-(1-hydroxy-3,3-dimethyl-1,3-dihydrobenzo[c][1,2]oxaborole-7-
carbonyl)-N-(2-(1-hydroxy-3,3-dimethyl-1,3-
dihydrobenzo[c][1,2]oxaborole-7-carboxamido)ethyl)glycine

DS117    FF225    F11

N-(1-hydroxy-1,3-dihydrobenzo[c][1,2]oxaborole-3-carbonyl)-N-
(2-(1-hydroxy-1,3-dihydrobenzo[c][1,2]oxaborole-3-
carboxamido)ethyl)glycine TABLE 1-continued

| Compd # | FF | F | Structure/IUPAC Name |
|---|---|---|---|
| DS118 | FF226 | F7 |

3,5-bis((1-hydroxy-3,3-dimethyl-1,3-dihydrobenzo[c][1,2]oxaborole-6-carboxamido)methyl)benzoic acid |
| DS119 | FF226 | F6 |

3,5-bis((1-hydroxy-3,4-dihydro-1H-benzo[c][1,2]oxaborinine-7-carboxamido)methyl)benzoic acid |
| DS120 | FF26 | F2 |

3,5-bis((2-(1-hydroxy-1,3-dihydrobenzo[c][1,2]oxaborol-7-yl)acetamido)methyl)benzoic acid |
| DS121 | FF226 | F7 |

3,5-bis((1-hydroxy-3,3-dimethyl-1,3-dihydrobenzo[c][1,2]oxaborole-7-carboxamido)methyl)benzoic acid |

TABLE 1-continued

| Compd # | FF | F | Structure/IUPAC Name |
|---|---|---|---|
| DS122 | FF226 | F11 | <br>3,5-bis((1-hydroxy-1,3-dihydrobenzo[c][1,2]oxaborole-3-carboxamido)methyl)benzoic acid |
| DS123 | FF227 | F7 | <br>(S)-3-(2,3-bis(1-hydroxy-3,3-dimethyl-1,3-dihydrobenzo[c][1,2]oxaborole-6-carboxamido)propanamido)propanoic acid |
| DS124 | FF227 | F6 | <br>(S)-3-(2,3-bis(1-hydroxy-3,4-dihydro-1H-benzo[c][1,2]oxaborinine-7-carboxamido)propanamido)propanoic acid |

TABLE 1-continued

| Compd # | FF | F | Structure/IUPAC Name |
|---|---|---|---|
| DS125 | FF227 | F2 | |

(S)-3-(2,3-bis(2-(1-hydroxy-1,3-dihydrobenzo[c][1,2]oxaborol-7-yl)acetamido)propanamido)propanoic acid

| DS126 | FF227 | F7 | |

(S)-3-(2,3-bis(1-hydroxy-3,3-dimethyl-1,3-dihydrobenzo[c][1,2]oxaborole-7-carboxamido)propanamido)propanoic acid TABLE 1-continued

| Compd # | FF | F | Structure/IUPAC Name |
|---|---|---|---|
| DS127 | FF227 | F11 |  3-((2S)-2,3-bis(1-hydroxy-1,3-dihydrobenzo[c][1,2]oxaborole-3-carboxamido)propanamido)propanoic acid |
| DS128 | FF229 | F7 |  (3,5-bis((1-hydroxy-3,3-dimethyl-1,3-dihydrobenzo[c][1,2]oxaborole-6-carboxamido)methyl)benzoyl)glutamic acid |
| DS129 | FF229 | F6 |  (3,5-bis((1-hydroxy-3,4-dihydro-1H-benzo[c][1,2]oxaborinine-7-carboxamido)methyl)benzoyl)glutamic acid |

TABLE 1-continued
| Compd # | FF | F | Structure/IUPAC Name |
|---|---|---|---|
DS130   FF229   F2
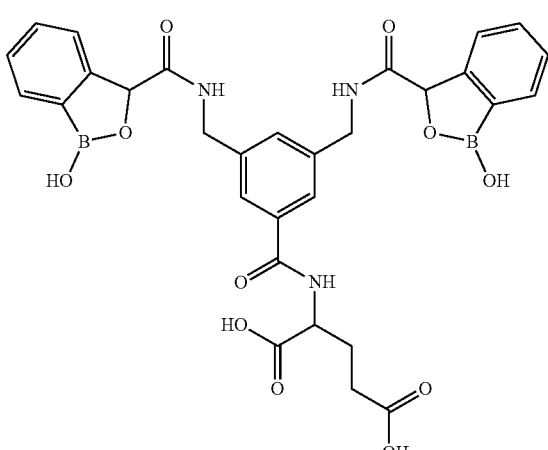
(3,5-bis((2-(1-hydroxy-1,3-dihydrobenzo[c][1,2]oxaborol-7-yl)acetamido)methyl)benzoyl)glutamic acid
DS131   FF229   F7
(3,5-bis((1-hydroxy-3,3-dimethyl-1,3-dihydrobenzo[c][1,2]oxaborole-7-carboxamido)methyl)benzoyl)glutamic acid
DS132   FF229   F11
(3,5-bis((1-hydroxy-1,3-dihydrobenzo[c][1,2]oxaborole-3-carboxamido)methyl)benzoyl)glutamic acid TABLE 1-continued

| Compd # | FF | F | Structure/IUPAC Name |
|---------|-----|-----|----------------------|

DS133 FF228 F7

4-(3,4-bis(1-hydroxy-3,3-dimethyl-1,3-
dihydrobenzo[c][1,2]oxaborole-6-carboxamido)pyrrolidin-1-yl)-4-
oxobutanoic acid

DS134 FF228 F6

4-(3,4-bis(1-hydroxy-3,4-dihydro-1H-benzo[c][1,2]oxaborinine-7-
carboxamido)pyrrolidin-1-yl)-4-oxobutanoic acid

DS135 FF228 F2

4-(3,4-bis(2-(1-hydroxy-1,3-dihydrobenzo[c][1,2]oxaborol-7-
yl)acetamido)pyrrolidin-1-yl)-4-oxobutanoic acid TABLE 1-continued

| Compd # | FF | F | Structure/IUPAC Name |
|---|---|---|---|
| DS136 | FF228 | F7 | <br>4-(3,4-bis(1-hydroxy-3,3-dimethyl-1,3-dihydrobenzo[c][1,2]oxaborole-7-carboxamido)pyrrolidin-1-yl)-4-oxobutanoic acid |
| DS137 | FF228 | F11 | <br>4-(3,4-bis(1-hydroxy-1,3-dihydrobenzo[c][1,2]oxaborole-3-carboxamido)pyrrolidin-1-yl)-4-oxobutanoic acid |
| DS138 | FF230 | F7 | <br>((S)-2,3-bis(1-hydroxy-3,3-dimethyl-1,3-dihydrobenzo[c][1,2]oxaborole-6-carboxamido)propanoyl)-L-glutamic acid |

TABLE 1-continued

| Compd # | FF | F | Structure/IUPAC Name |
|---|---|---|---|

DS139   FF230   F6

((S)-2,3-bis(1-hydroxy-3,4-dihydro-1H-benzo[c][1,2]oxaborinine-
7-carboxamido)propanoyl)-L-glutamic acid

DS140   FF230   F2

((S)-2,3-bis(2-(1-hydroxy-1,3-dihydrobenzo[c][1,2]oxaborol-7-
yl)acetamido)propanoyl)-L-glutamic acid TABLE 1-continued

| Compd # | FF | F | Structure/IUPAC Name |
|---|---|---|---|
| DS141 | FF230 | F7 | ((S)-2,3-bis(1-hydroxy-3,3-dimethyl-1,3-dihydrobenzo[c][1,2]oxaborole-7-carboxamido)propanoyl)-L-glutamic acid |
| DS142 | FF230 | F11 | ((2S)-2,3-bis(1-hydroxy-1,3-dihydrobenzo[c][1,2]oxaborole-3-carboxamido)propanoyl)-L-glutamic acid |
| DS143 | FF231 | F7 | |

TABLE 1-continued

| Compd # | FF | F | Structure/IUPAC Name |
|---|---|---|---|

(4-(3,4-bis(1-hydroxy-3,3-dimethyl-1,3-
dihydrobenzo[c][1,2]oxaborole-6-carboxamido)pyrrolidin-1-yl)-4-
oxobutanoyl)-L-glutamic acid

DS144   FF231   F6

(4-(3,4-bis(1-hydroxy-3,4-dihydro-1H-benzo[c][1,2]oxaborinine-
7-carboxamido)pyrrolidin-1-yl)-4-oxobutanoyl)-L-glutamic acid

DS145   FF231   F2

(4-(3,4-bis(2-(1-hydroxy-1,3-dihydrobenzo[c][1,2]oxaborol-7-
yl)acetamido)pyrrolidin-1-yl)-4-oxobutanoyl)-L-glutamic acid

DS146   FF231   F7

(4-(3,4-bis(1-hydroxy-3,3-dimethyl-1,3-
dihydrobenzo[c][1,2]oxaborole-7-carboxamido)pyrrolidin-1-yl)-4-
oxobutanoyl)-L-glutamic acid TABLE 1-continued

| Compd # | FF | F | Structure/IUPAC Name |
|---|---|---|---|
| DS147 | FF231 | F11 | (4-(3,4-bis(1-hydroxy-1,3-dihydrobenzo[c][1,2]oxaborole-3-carboxamido)pyrrolidin-1-yl)-4-oxobutanoyl)-L-glutamic acid |
| DS148 | FF227 | F7 | (S)-2,3-bis(1-hydroxy-3,3-dimethyl-1,3-dihydrobenzo[c][1,2]oxaborole-6-carboxamido)propanoic acid |
| DS149 | FF227 | F6 | (S)-2,3-bis(1-hydroxy-3,4-dihydro-1H-benzo[c][1,2]oxaborinine-7-carboxamido)propanoic acid |

TABLE 1-continued

| Compd # | FF | F | Structure/IUPAC Name |
|---|---|---|---|
| DS150 | FF227 | F2 | |

(S)-2,3-bis(2-(1-hydroxy-1,3-dihydrobenzo[c][1,2]oxaborol-7-yl)acetamido)propanoic acid

| DS151 | FF27 | F7 | |

(S)-2,3-bis(1-hydroxy-3,3-dimethyl-1,3-dihydrobenzo[c][1,2]oxaborole-7-carboxamido)propanoic acid TABLE 1-continued

| Compd # | FF | F | Structure/IUPAC Name |
|---|---|---|---|
| DS152 | FF227 | F11 | (2S)-2,3-bis(1-hydroxy-1,3-dihydrobenzo[c][1,2]oxaborole-3-carboxamido)propanoic acid |

Synthesis of Compounds of Formula I

Illustrative syntheses protocols are provided that can be used to synthesize any of the examples described.

The lines connecting cysteine residues are disulfide bonds. For the sake of clarity, the H— at the N-terminus of the A- and B-chain of insulin is not histidine, it is the hydrogen of the N-terminus. The —OH shown at the C-terminal end of the A- and B-chain is the C-terminus of the respective chain.

B. Synthesis of Modified Insulins

1. Chain Synthesis:

Cl-MPA resin

Sequence: GIVKQC(Acm)C(Acm)TSIC(Acm)SLYQLE-NYCN (SEQ ID NO:24065)

Synthesis of A-Chain and Modified A-Chain of Example 870 was Accomplished Using Conventional Solid-Phase Peptide Synthesis (SPPS)

MPA resin (0.22 mmol/eq) was swelled in a mixture of DMF:DCM (50:50, v:v). A solution of Potassium Iodide with DIPEA (1 M) in DMF was Added to the Reaction Vessel Along with Fmoc-Asn(Trt)-OH (0.2 M). The reaction vessel was heated to 75° C. Each amino acid coupling step involved i) deprotection with 20% piperidine in DMF at 90° C.; ii) washing with DMF; iii) activation and coupling of Fmoc protected amino acids with 0.5 M N,N'-diisopropyl-carbodiimide (DIC, 1 mL), 0.5 M Oxyma, and 0.2 M Fmoc-amino acid in DMF at 90° C.; iv) washing with DMF. Global Deprotection and Isolation.

Crude peptide was globally deprotected in TFA:TIPS: H₂O (95:2.5:2.5) and gently agitated for 2 h. Crude solution was filtered and peptide was precipitated in cold ether, centrifuged and washed with additional cold ether. Supernatant was decanted and the crude peptide was dried under a gentle stream of nitrogen gas. Crude peptide was dissolved in 20% ACN in water and fractionated by RP-HPLC on a C18 column.

B-chain synthesis:

Sequence: GKFVNQHLC(Acm)GSHLVEALYLVC(DTDP)GERGFFYTPK (SEQ ID NO:24066)

Synthesis of Modified B-Chain Insulins Using Solid-Phase Peptide Synthesis (SPPS)

MPA resin (0.22 mmol/eq) was swelled in a mixture of DMF:DCM (50:50, v:v). A solution of potassium iodide (125 mM) with DIPEA (1 M) in DMF was added to the reaction vessel along with Fmoc-Lys(ivDde)-OH (0.2 M). The reaction vessel was heated to 75° C. Each amino acid coupling step involved i) deprotection with 20% piperidine in DMF at 90° C.; ii) washing with DMF; iii), activation and coupling of Fmoc protected amino acids with 0.5 M N,N'-diisopropylcarbodiimide (DIC), 0.5 M Oxyma, and 0.2 M Fmoc-amino acid in DMF at 90° C.; iv) washing with DMF. Fmoc-Arg(Pbf)-OH was coupled twice using the methods described above.

Deprotection IVdde and Add Diboronates to B Chain.

The ivDde protecting group on the lysine residue was removed with 4% hydrazine in DMF, then washed with DMF. A solution of bromo acetic acid (0.2 M, 2 mL) in DMF with DIC (0.5 M, 2 mL) was added immediately and gently mixed for 4 hr. The resin was washed with DMF (3×5 mL). A solution of 1,3-phenylenedimethanamine (1M) in DMF (5 mL) was added to the resin and heated at 50 C for 10 minutes. The resin was washed with DMF (3×5 mL) and a Cl-MPA resin

SPPS

H—G—K—F—V—N—Q—H—L—C—G—S—H—L—V—E—A—L—Y—L—V—C—G—K—R—G—F—F—Y—T—P—K—T

IVdde ... IVdde 1. 4% Hydrazine/DMF
2. bromo acetic acid/DIEA
3. Diamine
4. Boronation
5. cleavage with DTDP Acm

H—G—K—F—V—N—Q—H—L—C—G—S—H—L—V—E—A—L—Y—L—V—C—G—K—R—G—F—F—Y—T—P—K—T—OH solution of 1-hydroxy-1,3-dihydrobenzo[c][1,2]oxaborole-6-carboxylic acid (0.2 M, 5 mL) in DMF with 1 M N,N'-diisopropylcarbodiimide (DIC, 1M, 1 mL), Oxyma (0.5 M, 2 mL) in DMF and heated at 50 C for 30 min.

Cleavage and Addition of DTDP to B-Chain.

Crude peptide was globally deprotected with 2,2'-Dithio-pyridine (DTDP) in TFA:TIPS:H$_2$O (95:2.5:2.5) and gently agitated. Crude solution was filtered and peptide was precipitated in cold ether, centrifuged, decanted, washed with additional cold ether, and centrifuged again. Supernatant was decanted and the crude peptide was dried under a gentle stream of nitrogen gas. Crude peptide was dissolved in 20% ACN in water and fractionated by RP-HPLC on a C18 column.

Combination of A and B Chains of Insulin and Modified Insulins.

A chain of insulin was combined with B chain in 0.2 M NH$_4$HCO$_3$ with 6M urea and at pH 8. Mixture was gently agitated, diluted with water and fractionated by RP-HPLC on a C18 column.

Deprotection of Acm Protecting Groups and Final Oxidation.

The combined intermediate was dissolved in glacial acetic acid and water and vortexed vigorously. A solution of iodine in glacial acetic acid (20 equiv) was added to the reaction mixture and gently agitated. A solution of ascorbic acid (5 mM) was added directly to the reaction mixture. The mixture was diluted in 20% ACN in water and fractionated by RP-HPLC on a Higgins C18 column to give Example 870.

+

0.2 M NH$_4$HCO$_3$, 6M Urea

-continued

12/AcPOH

Example B70

Similar procedures can be followed for the synthesis of Examples 1 to 869 and 871 to 876.

C. Alternative Synthesis of Modified Insulins

Conjugation of Diboronate Sensor with Proinsulin

Figure 9A:
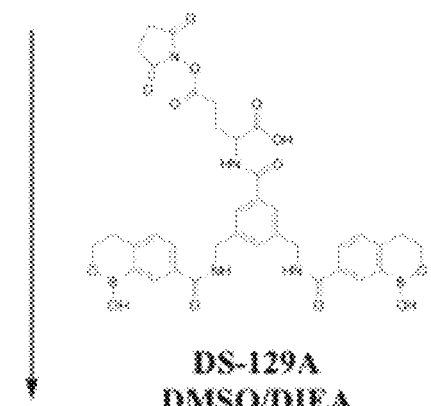
Figure 9B:
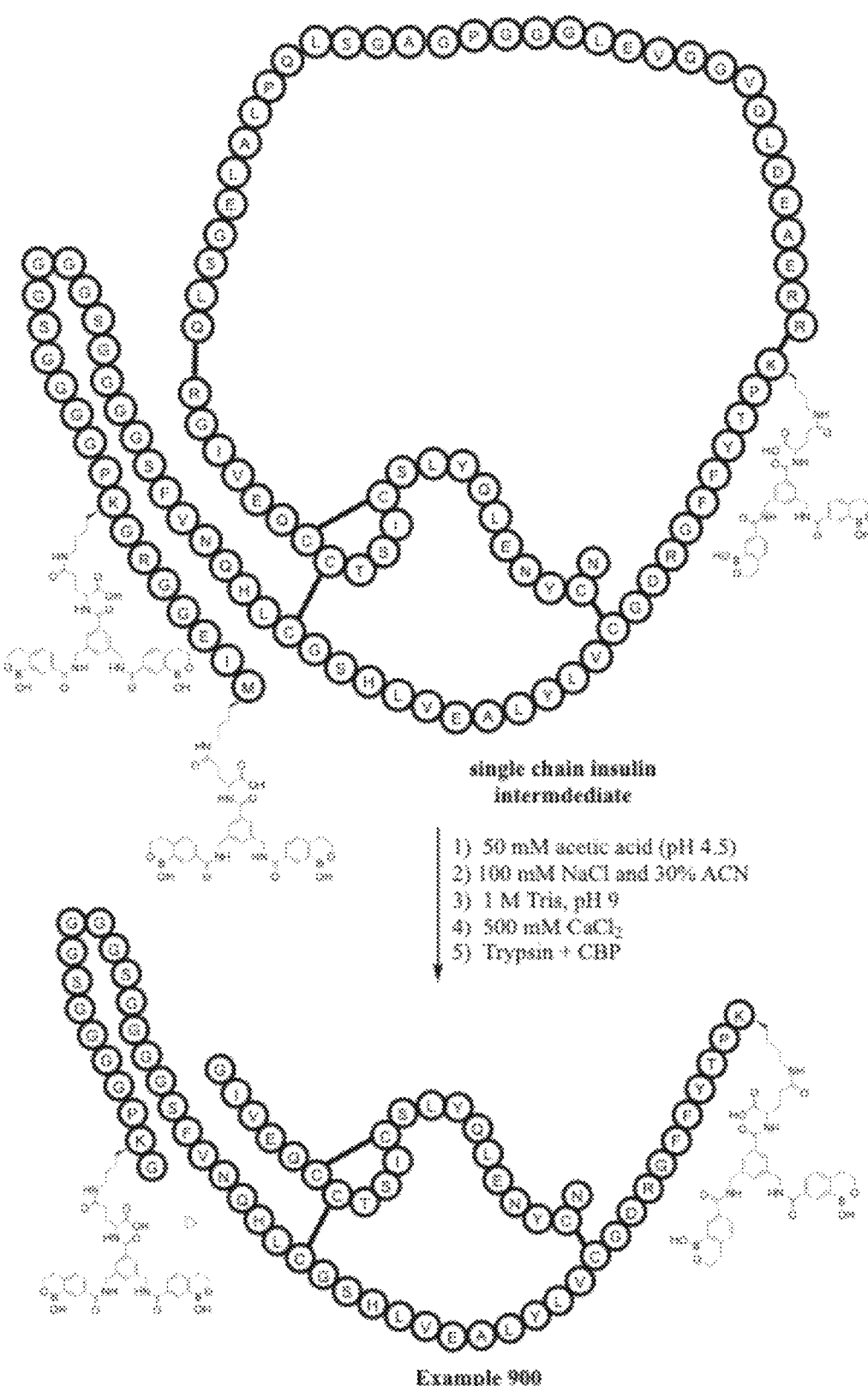

To a solution of single-chain proinsulin (20 mg, the amino acids on the single-chain proinsulin (SEQ ID NO:24067) are depicted in FIG. 9A) in DMSO (200 uL) was added 2-(3, 5-bis((1-hydroxy-3,4-dihydro-1H-benzo[c][1,2]oxabori-nine-7-carboxamido)methyl)benzamido)-5-((2,5-dioxopyr-rolidin-1-yl)oxy)-5-oxopentanoic acid (11, DS-129A 4 mg) in DMSO (50 uL) and diisopropylethylamine (DIPEA, 20 uL). The reaction was stirred at room temperature for 1 hr. Trifluoroacetic acid (TFA, 40 uL) was added to the reaction mixture to precipitate the proinsulin conjugate intermediate (i.e., "single chain insulin intermediate") (SEQ ID NO:24068) (FIG. 9B). The reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 µL of 500 mM CaCl$_2$ (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) and carboxy peptidase (CBP, 1:1000 carboxy peptidase to insulin mass) was added was added. Crude solution was allowed to stir at r.t for 16 hours. The crude conjugated insulin conjugate was precipitated with TFA (~200 uL), centrifuged, decanted. Then crude precipitate was washed with water (2×500 uL) then dissolved in DMSO (100-200 uL), diluted with 20% ACN/Water (5-10 mL), and purified by reverse-phase HPLC. Fractions were collected, frozen, and lyophilized to yield a white powder (5-10 mg) of Example 900 (SEQ ID NO:24069 for the A-chain, SEQ ID NO:24074 for the B-chain) (FIG. 9B).

Similar procedures can be followed for the synthesis of Examples 881 to 915.

D. Testing of Compounds for Activity in Biological Assays

Exemplary compounds DS01-DS152 can be tested using an alizarin red S (ARS) displacement assay. DS01-DS109 were tested using an ARS displacement assay.
Procedure for Determination of the Glucose, Fructose, and Lactate Binding (Kd) Using ARS Displacement Assay The association constant for the binding event between ARS and the exemplary compounds tested was determined using standard methods in the art. Triplicate titrations of 10$^{-5}$ M ARS in 0.1 M phosphate buffer, pH 7.4, were performed in a 96-well plate against serial dilutions of example compounds, ranging in concentration from 0-0.1M at 25° C. The example compound-ARS solution was incubated for 5-45 minutes at 25° C., and fluorescence intensity was measured using excitation wavelength 468 nm and emission wavelength 585 nm. Changes in intensity were plotted against the concentration of the example compound, and the intensity data was fitted to yield an association constant for ARS binding.

The association constant for the binding between a target sugar compound (e.g., glucose) and the tested aromatic boron-containing groups was determined via the displacement of ARS bound to the example compounds. Triplicate wells of 10$^{-5}$ M ARS and 0.1 M example compounds in 0.1 M phosphate buffer, pH 7.4, were titrated in a 96-well plate against serial dilutions of the target sugar compound, ranging in concentration from 0-2.0 M at 25° C. The boron-ARS-carbohydrate solution was incubated for 30-60 minutes at 25° C. and the intensity of each well was measured in a plate reader at excitation wavelength 468 nm and emission wavelength 585 nm.

Changes in intensity were plotted against concentration of the target sugar compound, and the data was fitted to a one-site competition equation:

$$y = \min(y) + (\max(y) - \min(y))/\left(1 + 10^{x - logEC50}\right)$$

to yield an association constant for the boron compound-target sugar compound binding event.

The binding constants of DS compounds, such as DS01-DS152, to glucose, fructose, and/or lactate can be tested and calculated. The binding constants of DS01-DS109 to glucose, fructose, and/or lactate were tested and were calculated, except DS76 was not tested for glucose binding, DS57 and DS75 were not tested for fructose or lactate binding. The tested compounds had Kd values ranging from ~0.8 mM to ~486 mM for glucose, ~0.9 mM to ~52 mM for fructose, and ~24 to ~425 mM for lactate. Some exemplary DS compounds disclosed herein have binding affinity to glucose with a Kd value ranging from about 0.01 mM to about 5 mM. Some exemplary DS compounds disclosed herein have binding affinity to glucose with a Kd value ranging from about 0.5 mM to about 2.5 mM.

In Vitro Demonstration of Activity for Compounds of Formula I

CHO cells constitutively expressing Human Insulin Receptor Isoform B were plated in a 96-well tissue culture microplate at 35,000 cells/well and grown overnight in RPMI media supplemented with Glutamine and 10% Fetal Bovine Serum (growth media). The next morning, growth media was replaced with fresh growth media.

A separate microplate was prepared with a stepwise serial dilution of glucose-responsive insulin in DMEM media, without glucose, without phenol red, with 4% w/v serum albumin; wells of serially diluted compoundsof Formula I were prepared in triplicate with an appropriate "high" and "low" concentration of glucose to determine change in potency of compounds of Formula I at various potential blood glucose levels.

Growth media on cells was then replaced with DMEM media, no glucose, no phenol red for 5 minutes. The media was aspirated and replaced with the contents of the prepared plate (spiking media) for 10 minutes. The spiking media was aspirated and the cells were fixed with 10% neutral buffered formalin for 10 minutes. The neutral buffered formalin was aspirated, and the microplate was stringently washed with PBS, pH 7.4. The microplate was then blocked with PBS, pH 7.4 supplemented with 10% v/v Fetal Bovine Serum and 0.1% Triton X-100 for 30 minutes. The plate was then stained at 4° C. overnight with 5% FBS in PBS+1:680 v:v of Rb α-phospho-Y1150/Y1151 IR antibody (Cell Signaling Technologies #3024). After stringent washes with PBS, pH 7.4, the microplate was incubated at 37° C. in 5% FBS in PBS+1:1000 of 2° Ab, HRP α-Rabbit (Cell Signaling Technologies, #7074) for 100 minutes. The plate was stringently washed with PBS, pH 7.4, and colorimetric readout was developed for 15 minutes at 37° C. using TMB substrate. Color development was stopped with the addition of 0.1 M hydrochloric acid and absorbance measured at 450 nm. Triplicate absorbance values were plotted in GraphPad Prism and analyzed using a four-parameter logistic regression to generate dose-response curves, and the EC50 of the dose-response curves were compared to assess fold activation of the exemplary compounds of Formula I from low to high glucose concentration.

Examples 25A, 28A, 315, 318, 320, 565, 590, 606, 611, and 803-880 had an insulin receptor phosphorylation (IR Phosphorylation) (fold change) ranging from ≥1.2 to 45. Some examples disclosed herein have an insulin receptor phosphorylation (IR Phosphorylation) (fold change) ranging from ≥1.2 to 10. For examples, Examples 25 A and 28A disclosed herein have an insulin receptor phosphorylation (IR Phosphorylation) (fold change) ranging from ≥2 to 8, such as from 2.5 to 6, or 2.8 to 4.

In Vivo Demonstration of Activity for Compounds of Formula I

Diabetes was induced in 12-week-old B6 mice using streptozocin (STZ) treatment. Three weeks after the final STZ treatment, blood glucose of the mice was sampled from lateral tail vein to confirm diabetes. Mice with blood glucose of >200 mg/dl were deemed to be diabetic and fasted for 1-6 hours prior to injection. Human insulin and a compound of Formula I in sterile phosphate buffered saline, pH 7.4 were injected either subcutaneously via neck scruff or intraperitoneally, depending on the experiment. Blood glucose was sampled with a glucometer via lateral tail vein at 15-minute intervals. After one hour of initial stabilization of blood glucose levels post-insulin injection, mice were challenged with an intraperitoneal injection of glucose (e.g., 2 g/kg, 4 g/kg, or 6 g/kg; the actual dose depends on the example and experiment) in sterile phosphate buffered saline. The exemplary compound activated to lower blood glucose upon the introduction of a glucose bolus, while human insulin did not activate in a glucose-dependent manner.

The above experiment showed in vivo preferential activity response of an exemplary compound of the disclosure to glucose.

Streptozotocin-treated mice (55 mg/kg, 5 days) undergo surgical catheterization of a carotid artery and jugular vein for blood sampling and infusions. After a recovery period of 3-4 days, mice are placed in an experimental chamber, connected to sampling/infusion lines, and briefly fasted. Somatostatin (5 mg/kg/min) is continuously infused throughout the study. At time 0 min, biosynthetic human insulin (BHI) or a compound of Formula I are infused at 4 mU/kg/min and glucose is infused at variable rates to achieve steady state ("clamped") at pre-determined glycemic levels. Blood glucose (BG) is clamped in windows of stepwise increasing blood glucose concentration. Steady-state Glucose Infusion Rate (GIR) is measured for each step increase in clamped blood glucose and plotted to assess the increase in GIR as a function of increasing blood glucose. As BG increases, compounds of Formula I require greater GIR to maintain clamped BG than does BHI, demonstrating a glucose-responsive increase in compound glucose-lowering action with increased BG concentrations.

It is also observed in cell-based experiments on compounds containing formulae FF50-FF62, FF116, and FF121-FF134 that sensors with geminal alkyl substituent on the same carbon as the nitrogen conjugated to the boroxole or boronates provided between 5-56% higher glucose responsiveness in the range of 3-20 mM glucose in comparison to variants that do not have the geminal alkyl substituents. For example, when a Z C represented by one of formulae FF50-FF62, FF116, and FF121-134 is conjugated to lysine residues in insulin wherein the boronates (B1,B2) in formulae FF50-FF62, FF116, and FF121-134 are represented by F2, the resulting insulin is observed to be between 11-56% more responsive to changes in glucose levels between 3-20 mM glucose than if instead of one of formulae FF50-FF62, FF116, and FF121-134, one uses 2,3-diaminopropionic acid. This data shows that the presence of the geminal alkyl substituent on the same carbon as the nitrogen conjugated to the boroxole or boronates improves glucose responsiveness of the resulting insulin conjugate, and in tested variations in the 3-20 mM glucose range. Without wishing to be bound by theory, it is believed that this general principle extends to other formulae FF50-FF62, FF116, and FF121-FF134 providing a framework for enhancement of glucose responsiveness by at least 5%, at least 10%, at least 20%, or at least 40% in the 3-20 mM or 2-50 mM glucose ranges. Without wishing to be bound by theory, it is believed based on observations of glucose responsiveness trends, that the presence of the carbonyl group adjacent to- or within less than two carbon centers away from the amine groups in FF formulae (to which aromatic boron-containing groups are conjugated) enhances glucose responsiveness through impacting ability to turn off activity of drug substance through plasma protein interactions such as with albumin and that this is independent of glucose affinity such that glucose affinity is not impacted by the position of this carbonyl group. Without wishing to be bound by theory, it is believed that the pharmacokinetics of the molecules and potential albumin or blood proteins binding is impacted by the position of this carbonyl group, and thereby enhances overall glucose responsiveness whilst the absolute glucose affinity is maintained or nearly identical. Therefore, in certain embodiments of the present invention, the carbonyl group (as part of an acid, amid or linkage to X in FF formulae) is placed within less than three-, or within less than two-carbon center away from one of the two amines to which the boron-containing compounds are conjugated. In certain embodiments, the placement of amines within two carbon centers from each other enables the spatial and geometric constraining of the aromatic boron containing groups to enhance glucose binding and selectively, and furthermore the presence of a carbonyl group (for example, as part of an amide linkage) which is within less than two carbon centers, from one of the two amines (to which aromatic boron containing groups are attached) ensures differential albumin binding in a manner that results in the compound exhibiting glucose responsiveness in the blood and in the body. In some embodiments, the combination of geometrical constraining of the two amines to which the aromatic boron containing groups are conjugated, as well as the presence of the carbonyl within one to two carbon centers from one of the amines provides the necessary requirements for glucose responsiveness in physiological blood and plasma glucose levels. Experiments on cell-based assays of insulins with lysines conjugated with one of formulae FF50-FF62, FF116, and FF121-134 demonstrated that the enhanced glucose responsiveness of the insulins is increased when one or more lysines are modified as described by Formula I using one of formulae FF50-FF62, FF116, and FF121-134, and wherein the lysines are present in insulin (as insertions or mutations) or in a polypeptide that is appended to the N- or C-terminus of the B-chain of insulin or the C-terminus of the A-chain of insulin, and wherein there are additional lysine residues within the insulin sequence that are similarly modified. The results are further corroborated by testing of the compounds of Formula I in STZ diabetic mouse models wherein the activity of the insulin is measured through bolus injections of the compounds of Formula I followed by glucose challenges and measurements of blood glucose, or through glucose clamp assays in which activity of the insulins is measured as a function of blood glucose levels. The results further showed that exemplary compounds of Formula I disclosed herein function in the body and are responsive to physiological changes in blood glucose and provide dynamic insulin action in the body in response to changes in blood glucose levels.

E. Preparation of Aromatic Boron-Containing Compounds

The disclosed compounds can be prepared according to the following schemes. The following schemes represent the general methods used in preparing these compounds. However, the synthesis of these compounds is not limited to these representative methods, as they can also be prepared through various other methods by those skilled in the art of synthetic chemistry.

DSL Synthesis Method 1:

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy) carbonyl) amino)propanoic acid 2 (94 mg, 0.3 mmol) in DCM with DIEA (0.3 mL, 1.7 mmol) was added immediately and gently mixed for overnight. The mixture was washed with DCM and unreacted sites were capped with a solution of 20% MeOH in a solution of DCM and DIEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of $N^2$-(((9H-fluoren-9-yl) methoxy)carbonyl)-$N^6$-((allyloxy)carbonyl)-L-lysine 4 (0.181 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 5 followed by treatment with 20% piperidine in DMF for 5 minutes (3×5 mL) and washed with DMF (4×5 mL). Solution of (2S,4R)-1-(((9H-fluoren-9-yl)methoxy) carbonyl)-4-((((9H-fluoren-9-yl)methoxy)carbonyl)amino) pyrrolidine-2-carboxylic acid, 6 (0.229 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 7. Resin was treated with 20% piperidine in DMF for 5 minutes (3×5 mL) and washed with DMF (4×5 mL). Solution of 1-hydroxy-3H-2,1-benzoxaborole-6-carboxylic acid 8 (0.178 g, 1 mmol), HATU (0.380 g, 1 mmol) and DIEA (0.35 mL, 2 mmol) were added to the resin and heated at 50° C. for 30 min to get 9. The resin was washed with DMF (4×5 mL) and DCM (3×5 mL) and treated with Tetrakis(triphenylphosphine)palladium (20 mol %, 46 mg) and phenylsilane (493 ul, 4 mmol) in 6 mL DCM was agitated at room temperature for 1 h and washed with DCM (3×5 mL) and DMF (3×5 mL). Solution of hexanoic acid 10 (50 ul, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 11.

Cleavage of Diboronated Sensor from Resin

Compound 11 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-2A which was used in the next step without purification.

Figure 13:
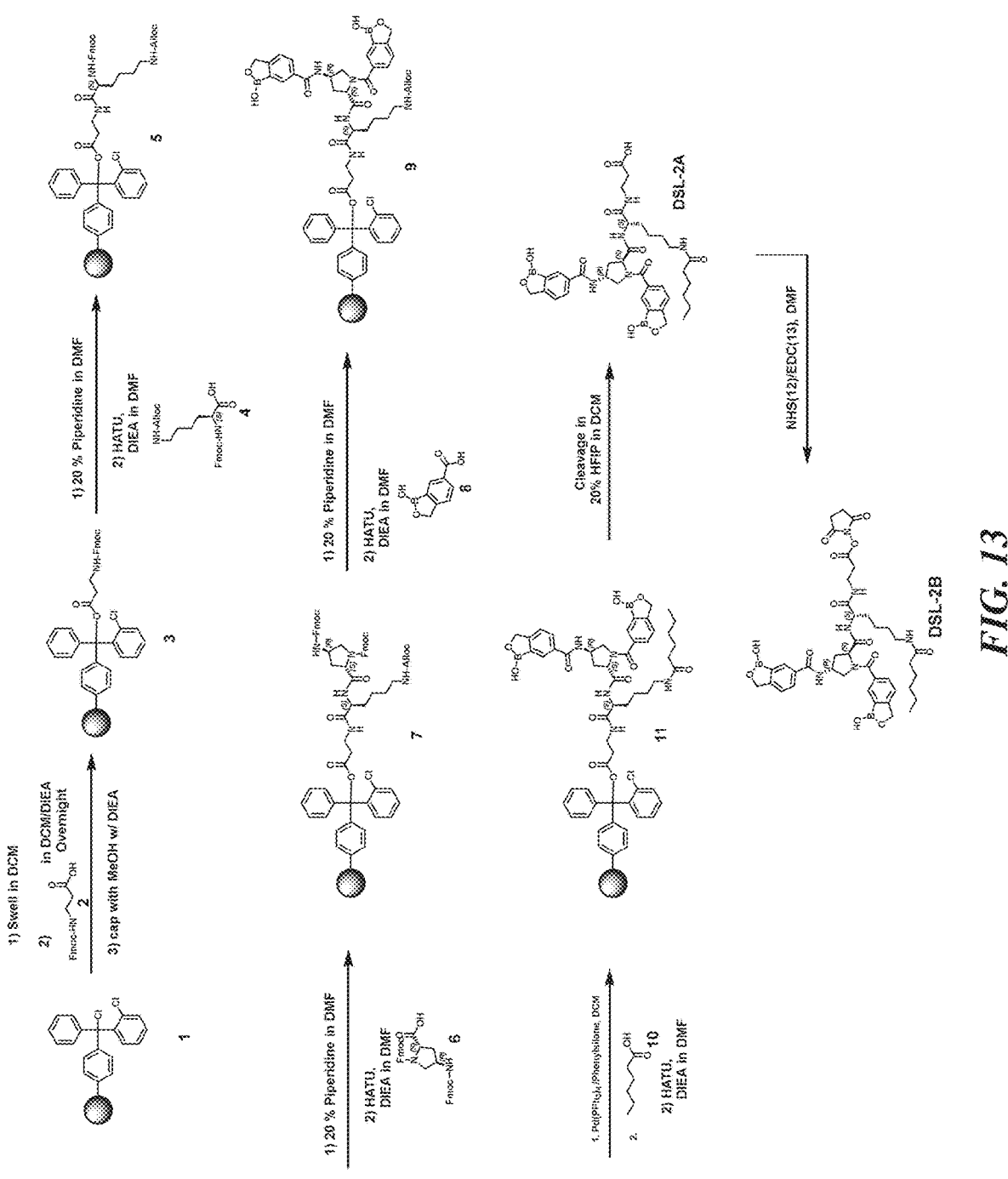

1b: NHS-Activation of Diboronated Sensor:

Crude diboronated sensor acid DSL-2A was dissolved in DMF (2 mL) and treated with 3(3-Dimethylaminopropyl)-1-ethyl-carbodiimide hydrochloride 13 (EDC) (0.096 g, 0.5 mmol), N-hydroxysuccinimide 12 (NHS) (0.115 g, 1 mmol), and stirred for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl 3-((S)-6-hexanamido-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanamido)propanoate DSL-2B in ~50% yield (126 mg). Calculated mass (M+H)$^+$=845.37 Da, Observed mass (M+H)$^+$=845.17 Da. The foregoing synthesis is illustrated in FIG. 13.

Examples DSL-4B, DSL-5B, DSL-17B, DSL-18B, DSL-30B-DSL-39B, DSL-41B-DSL-44B, DSL-46B, DSL-55B, DSL-66B, and DSL-115B listed in Table I below were synthesized under similar conditions.

DSL-1B, DSL-6B, DSL-7B, DSL-15B, DSL-16B, DSL-19B-DSL-21B, DSL-29B, DSL-40B, DSL-50B-DSL-54B, DSL-56B- DSL-65B, DSL-67B, DSL-150B, DSL-151B, DSL-153B, DSL-161B, DSL-163B, DSL-171B, and DSL-172B can be synthesized under similar conditions.

TABLE I

| DSL-B Examples | Mass Calculated [M + H]$^{+1}$ | Mass Observed [M + H]$^{+1}$ |
| --- | --- | --- |
| DSL-4B | 901.43 | 901.21 |
| DSL-5B | 929.47 | 929.26 |
| DSL-6B | 957.49 | 957.22 |
| DSL-7B | 985.52 | 985.24 |
| DSL16B | 901.42 | 901.25 |
| DSL-17B | 929.47 | 929.25 |
| DSL-18B | 957.50 | 957.33 |
| DSL-26B | 1015.49 | 1015.55 |
| DSL-30B | 921.40 | 921.42 |
| DSL-31B | 935.42 | 935.42 |
| DSL-32B | 851.32 | 851.20 |
| DSL-33B | 879.36 | 879.08 |
| DSL-34B | 879.35 | 879.25 |
| DSL-35B | 893.37 | 893.25 |
| DSL-36B | 893.36 | 893.36 |
| DSL-37B | 947.34 | 947.17 |
| DSL-38B | 923.37 | 923.37 |
| DSL-39B | 897.35 | 897.33 |
| DSL-40B | 897.34 | 897.33 |
| DSL-41B | 907.38 | 907.38 |
| DSL-42B | 915.34 | 915.08 |
| DSL-43B | 1301.07 | 1301.05 |
| DSL-44B | 1059.29 | 1059.10 |
| DSL-46B | 907.34 | 907.20 |
| DSL-53B | 907.38 | 907.42 |
| DSL-55B | 935.42 | 935.33 |
| DSL-58B | 1003.40 | 1003.47 |
| DSL-60B | 953.40 | 953.46 |
| DSL-63B | 971.39 | 971.47 |
| DSL-66B | 1080.48 | 1080.25 |
| DSL-115B | 907.39 | 907.25 |

DSL Synthesis Method 2:

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy)carbonyl)amino) propanoic acid 2 (94 mg, 0.3 mmol) in DCM with DIEA (0.3 mL, 1.7 mmol) was added immediately and gently mixed for overnight. The mixture was washed with DCM and unreacted sites were capped with a solution of 20% MeOH in a solution of DCM and DIEA (1M) and mixed for 1 hr to yield 3. The resin was washed with DCM (3×5 mL) then DMF (3×5 mL) and treated with 20% piperidine in DMF for 5 minutes (3×5 ML), washed with DMF (4×5 mL). Solution of N$^2$-(((9H-fluoren-9-yl)methoxy)carbonyl)-N$^6$-((allyloxy)carbonyl)-L-lysine 4 (0.181 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 5 followed by treatment with 20% piperidine in DMF for 5 minutes (3×5 mL) and washed with DMF (4×5 mL). Solution of (2S,4R)-1-(((9H-fluoren-9-yl)methoxy)carbonyl)-4-((((9H-fluoren-9-yl)methoxy)carbonyl)amino) pyrrolidine-2-carboxylic acid, 6 (0.229 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 7. Resin was treated with 20% piperidine in DMF for 5 minutes (3×5 mL) and washed with DMF (4×5 mL). Solution of 1-hydroxy-3H-2,1-benzoxaborole-6-carboxylic acid 8 (0.178 g, 1 mmol), HATU (0.380 g, 1 mmol) and DIEA (0.35 mL, 2 mmol) were added to the resin and heated at 50° C. for 30 min to get 9. The resin was washed with DMF (4×5 mL) and DCM (3×5 mL) and treated with Tetrakis(triphenylphosphine)palladium (20 mol %, 46 mg) and phenylsilane (493 ul, 4 mmol) in 6 mL DCM was agitated at room temperature for 1 h and washed with DCM (3×5 mL) and DMF (3×5 mL). Solution of 6-(tert-butoxy)-6-oxohexanoic acid 14 (77 ul, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 15.

Cleavage of Diboronated Sensor from Resin

Compound 15 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-9A which was used in the next step without purification.

Figure 14:
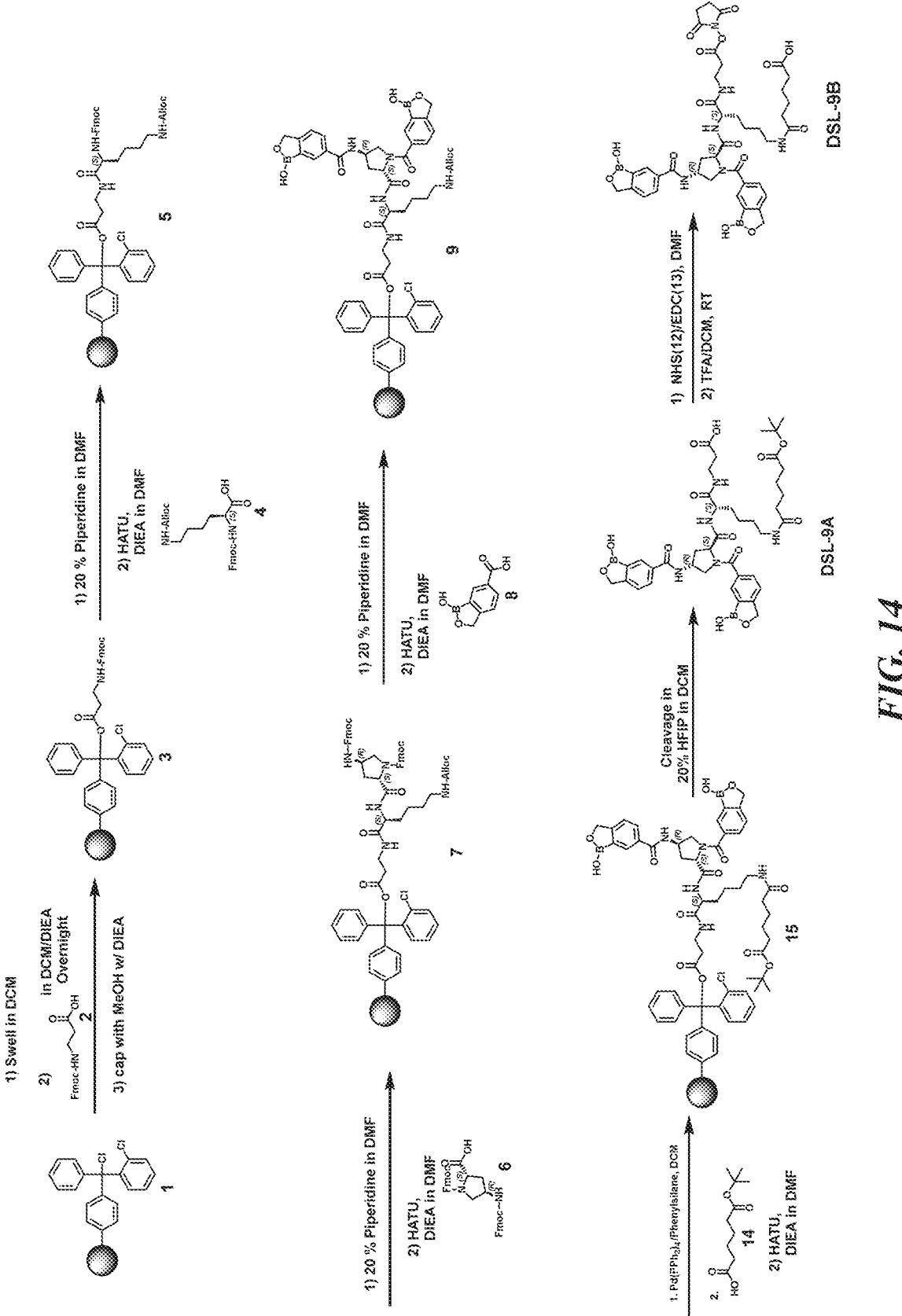

2b: NHS-Activation of Diboronated Sensor:

Crude diboronated sensor acid DSL-9A was dissolved in DMF (2 mL) and treated with 3-(3-Dimethylaminopropyl)-1-ethyl-carbodiimide hydrochloride 13 (EDC) (0.096 g, 0.5 mmol), N-hydroxysuccinimide 12 (NHS) (0.115 g, 1 mmol), and stirred for overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and evaporated under vacuum. The tert-butyl protecting group was removed with TFA in DCM (50%), allowed to mix for 1 hour, solvent was evaporated under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 6-(((S)-6-((3-((2,5-dioxopyrrolidin-1-yl)oxy)-3-oxopropyl)amino)-5-((2S,4R)-1-(1-hydroxy-1,3-dihydrobenzo[c][1,2]oxaborole-6-carbonyl)-4-(1-hydroxy-1,3-dihydrobenzo[c][1,2] oxaborole-6-carboxamido)pyrrolidine-2-carboxamido)-6-oxohexyl)amino)-6-oxohexanoic acid DSL-9B in ~45% yield (118 mg). Calculated mass (M+H)$^+$=875.35 Da, Observed mass (M+H)$^+$=874.88 Da. The foregoing synthesis is illustrated in FIG. 14.

Examples DSL-10B-DSL-14B, DSL-23B-DSL-27B, DSL-45B, DSL-47B, DSL-68B, DSL-69B, DSL-117B, and DSL-136B listed in Table II below were synthesized under similar conditions.

DSL-8B, DSL-22B, DSL-26B-DSL-28B, DSL-48B, DSL-49B, DSL-70B, DSL-138B, DSL-152B, DSL-154B, DSL-162B, DSL-165B, DSL-169B, and DSL-170B can be synthesized using similar conditions.

TABLE II

| DSL-B Examples | Mass Calculated [M + H]$^{+1}$ | Mass Observed [M + H]$^{+1}$ |
|---|---|---|
| DSL-10B | 903.38 | 902.86 |
| DSL-11B | 931.41 | 930.88 |
| DSL-12B | 959.44 | 958.98 |
| DSL-13B | 987.47 | 987.05 |
| DSL-14B | 1015.50 | 1015.03 |
| DSL-23B | 931.41 | 931.00 |
| DSL-24B | 959.44 | 958.92 |
| DSL-25B | 987.47 | 987.00 |
| DSL-45B | 1035.42 | 1035.22 |
| DSL-47B | 979.41 | 961.33 |
| DSL-68B | 951.38 | 951.17 |
| DSL-69B | 979.41 | 979.08 |
| DSL-117B | 951.38 | 951.17 |
| DSL-136B | 951.38 | 951.00 |

DSL Synthesis Method 3:

2-Chlorotrityl resin 1 (300 mg, 0.3 mmol) was swelled in dry DCM (5 mL) for 30 mins. Solvent was removed with nitrogen and a solution of (S)-4-((((9H-fluoren-9-yl)methoxy)carbonyl) amino)-5-(tert-butoxy)-5-oxopentanoic acid 16 (127 mg, 0.3 mmol) in DCM with DIEA (0.3 mL, 1.7 mmol) was added immediately and gently mixed for overnight. The mixture was washed with DCM and unreacted sites were capped with a solution of 20% MeOH in a solution of DCM and DIEA (1M) and mixed for 1 hr to yield 17. The resin was washed with DCM (3×5 mL) then DMF (3×5 mL) and treated with 20% piperidine in DMF for 5 minutes (3×5 mL), washed with DMF (4×5 mL). Solution of N$^2$-(((9H-fluoren-9-yl)methoxy)carbonyl)-N$^6$-((allyloxy)carbonyl)-L-lysine 4 (0.181 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 18 followed by treatment with 20% piperidine in DMF for 5 minutes (3×5 mL) and washed with DMF (4×5 mL). Solution of (2S,4R)-1-(((9H-fluoren-9-yl)methoxy)carbonyl)-4-((((9H-fluoren-9-yl)methoxy)carbonyl)amino)pyrrolidine-2-carboxylic acid, 6 (0.229 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 19. Resin was treated with 20% piperidine in DMF for 5 minutes (3×5 mL) and washed with DMF (4×5 mL). Solution of 1-hydroxy-3H-2,1-benzoxaborole-6-carboxylic acid 8 (0.178 g, 1 mmol), HATU (0.380 g, 1 mmol) and DIEA (0.35 mL, 2 mmol) were added to the resin and heated at 50° C. for 30 min to get 20. The resin was washed with DMF (4×5 mL) and DCM (3×5 mL) and treated with Tetrakis(triphenylphosphine)palladium (20 mol %, 46 mg) and phenylsilane (493 ul, 4 mmol) in 6 mL DCM was agitated at room temperature for 1 h and washed with DCM (3×5 mL) and DMF (3×5 mL). Solution of 12-(tert-butoxy)-12-oxododecanoic acid 21 (114 mg, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 22.

Cleavage of Diboronated Sensor from Resin

Compound 22 on resin was treated with 20% 1,1,1,3,3,3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-82A which was used in the next step without purification.

Figure 15:
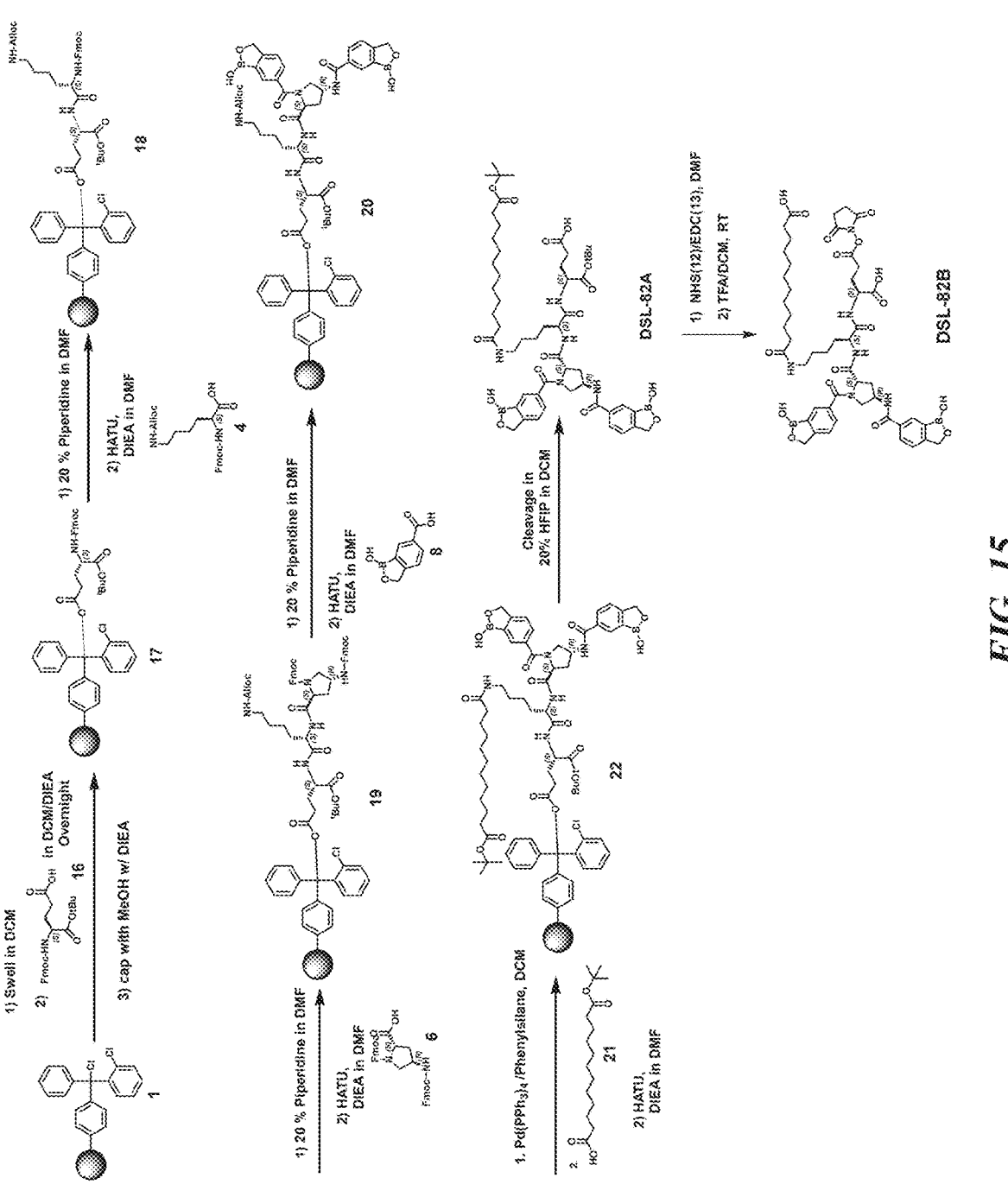

3b: NHS-Activation of Diboronated Sensor:

Crude diboronated sensor acid DSL-82A was dissolved in DMF (2 mL) and treated with 3-(3-Dimethylaminopropyl)-1-ethyl-carbodiimide hydrochloride 13 (EDC) (0.096 g, 0.5 mmol), N-hydroxysuccinimide 12 (NHS) (0.115 g, 1 mmol), and gently mixed for overnight. Progress of the reaction was monitored by LCMS. After completion of the reaction, reaction mixture was diluted with ethyl acetate (20 mL) and washed with 100 mmol HCl (10 mL). The organic layer was dried over anhydrous Na$_2$SO$_4$ and evaporated under vacuum. The tert-butyl protecting group was removed with TFA in DCM (50%), allowed to mix for 1 hour, solvent was evaporated under vacuum then dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 12-(((S)-6-(((S)-1-carboxy-4-((2,5-dioxopyrrolidin-1-yl)oxy)-4-oxobutyl)amino)-5-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-oxohexyl)amino)-12-oxododecanoic acid DSL-82B in ~55% yield (167 mg). Calculated mass (M+H)$^+$=1017.45 Da, Observed mass (M+H)$^+$=1017.00 Da. The foregoing synthesis is illustrated in FIG. 15.

Examples DSL-94B and DSL-125B listed in Table III below were synthesized under similar conditions.

DSL-71B-DSL-81B, DSL-83B-DSL-93B, DSL-95B-DSL-114B, DSL-116B, DSL-118B-DSL-124B, DSL-126B-DSL-135B, DSL-137B, DSL-139B, DSL-140B, and DSL-141B can be synthesized under similar conditions.

TABLE III

| DSL-B Examples | Mass Calculated [M + H]$^{+1}$ | Mass Observed [M + H]$^{+1}$ |
|---|---|---|
| DSL-94B | 1017.45 | 1017.00 |
| DSL-125B | 993.42 | 993.17 |
| DSL-141B | 675.26 | 675.17 |
| DSL-142B | 663.26 | 663.17 |

DSL Synthesis Method 4:

2-Chlorotrityl resin 1 (300 mg, 0.3 mmol) was swelled in dry DCM (5 mL) for 30 mins. Solvent was removed with nitrogen and a solution of (S)-3-((((9H-fluoren-9-yl)methoxy)carbonyl)amino)-5-phenylpentanoic acid 23 (124 mg, 0.3 mmol) in DCM with DIEA (0.3 mL, 1.7 mmol) was added immediately and gently mixed for overnight. The mixture was washed with DCM and unreacted sites were capped with a solution of 20% MeOH in a solution of DCM and DIEA (1 M) and mixed for 1 hr to yield 24. The resin was washed with DCM (3×5 mL) then DMF (3×5 mL) and treated with 20% piperidine in DMF for 5 minutes (3×5 mL), washed with DMF (4×5 mL). Solution of (2S,4R)-1-(((9H-fluoren-9-yl)methoxy)carbonyl)-4-((((9H-fluoren-9-yl)methoxy)carbonyl)amino)pyrrolidine-2-carboxylic acid, 6 (0.229 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 25. Resin was treated with 20% piperidine in DMF for 5 minutes (3×5 mL) and washed with DMF (4×5 mL). Solution of 1-hydroxy-3,3-dimethyl-1,3-dihydrobenzo[c][1,2]oxaborole-6-carboxylic acid 26 (0.206 g, 1 mmol), HATU (0.380 g, 1 mmol) and DIEA (0.35 mL, 2 mmol) were added to the resin and heated at 50° C. for 30 min to get 27. The resin was washed with DMF (4×5 mL) and DCM (3×5 mL).

Cleavage of Diboronated Sensor from Resin

Compound 27 on resin was treated with 20% 1,1,1,3,3, 3-Hexafluoro-2-propanol (HFIP) in DCM (7 mL) and gently mixed for 1 hr. The resin was filtered, and filtrate was evaporated under reduced pressure. Residue was further suspended with DCM (2×5 mL) and evaporated to yield diboronated sensor acid DSL-143A which was used in the next step without purification.

4b: NHS-Activation of Diboronated Sensor:

Crude diboronated sensor acid DSL-143A was dissolved in DMF (2 mL) and treated with 3-(3-Dimethylaminopropyl)-1-ethyl-carbodiimide hydrochloride 13 (EDC) (0.096 g, 0.5 mmol), N-hydroxysuccinimide 12 (NHS) (0.115 g, 1 mmol), and stirred for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl (S)-3-((2S, 4R)-1-(1-hydroxy-3,3-dimethyl-1,3-dihydrobenzo[c][1,2]oxaborole-6-carbonyl)-4-(1-hydroxy-3,3-dimethyl-1,3-di-hydrobenzo[c][1,2]oxaborole-6-carboxamido)pyrrolidine-2-carboxamido)-5-phenylpentanoate DSL-143B in ~30% yield (23.3 mg). Calculated mass $(M+H)^+=779.33$ Da, Observed mass $(M+H)^+=779.25$ Da.

Figure 16:
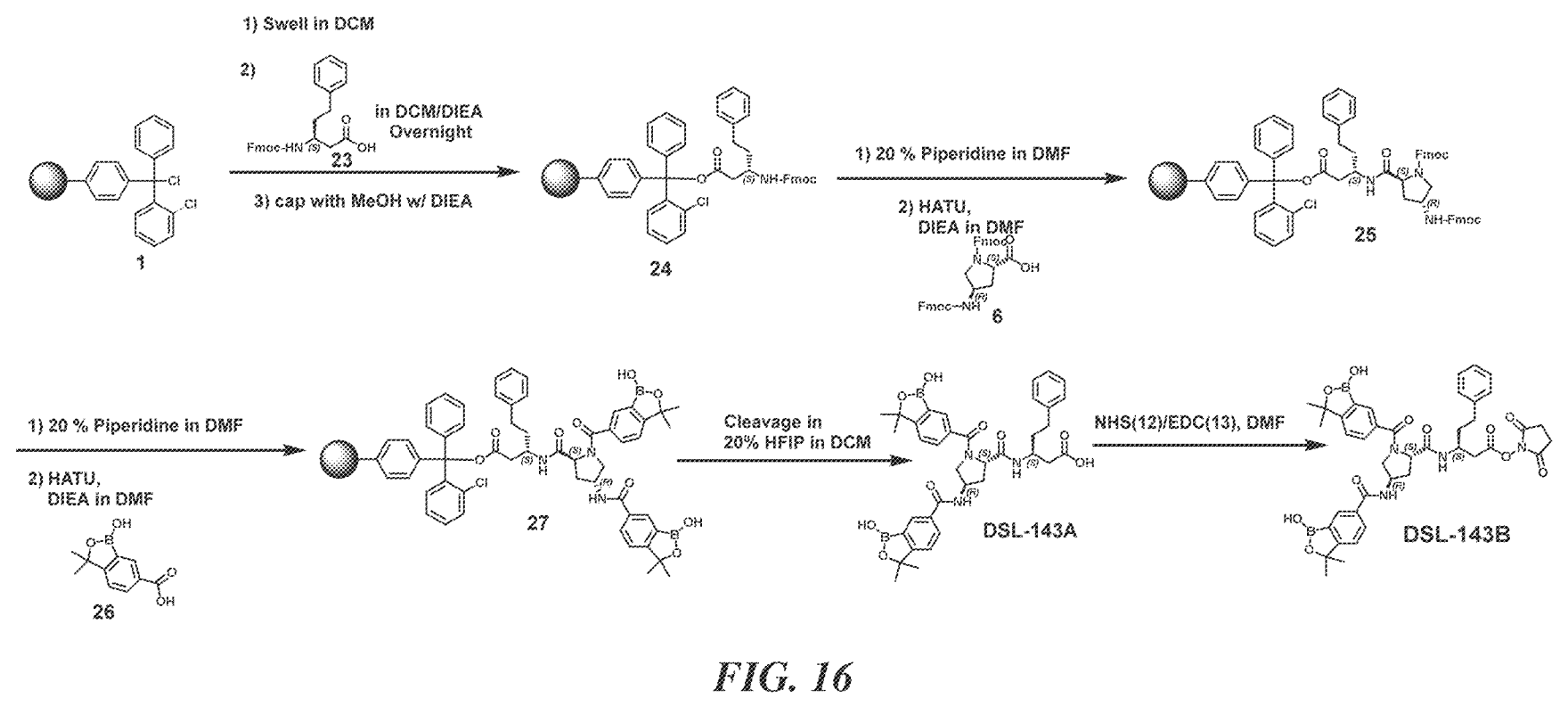

Example DSL-147B can be synthesized under similar conditions. The foregoing synthesis is illustrated in FIG. 16. DSL Synthesis Method 5:

2-Chlorotrityl resin 1 (300 mg, 0.3 mmol) was swelled in dry DCM (5 mL) for 30 mins. Solvent was removed with nitrogen and a solution of 3-((((9H-fluoren-9-yl)methoxy) carbonyl) amino)propanoic acid 2 (94 mg, 0.3 mmol) in DCM with DIEA (0.3 mL, 1.7 mmol) was added immediately and gently mixed for overnight. The mixture was washed with DCM and unreacted sites were capped with a solution of 20% MeOH in a solution of DCM and DIEA (1M) and mixed for 1 hr to yield 3. The resin was washed with DCM (3×5 mL) then DMF (3×5 mL) and treated with 20% piperidine in DMF for 5 minutes (3×5 mL), washed with DMF (4×5 mL). Solution of (2S,4R)-1-(((9H-fluoren-9-yl)methoxy)carbonyl)-4-((((9H-fluoren-9-yl)methoxy) carbonyl)amino)pyrrolidine-2-carboxylic acid, 6 (0.229 g, 0.4 mmol), DIEA (0.14 ml, 0.8 mmol) and HATU (0.152 g, 0.4 mmol) in DMF (5 mL) was added to the resin and heated at 50° C. for 30 min, washed with DMF (4×5 mL) to obtain 28. Resin was treated with 20% piperidine in DMF for 5 minutes (3×5 mL) and washed with DMF (4×5 mL). Solution of 1-hydroxy-1,3-dihydrobenzo[c][1,2]oxaborole-7-carboxylic acid 29 (0.178 g, 1 mmol), HATU (0.380 g, 1 mmol) and DIEA (0.35 mL, 2 mmol) were added to the resin and heated at 50° C. for 30 min to get 30. The resin was washed with DMF (4×5 mL) and DCM (3×5 mL).

Cleavage of Diboronated Sensor from Resin

Compound 30 on resin was treated with 20% 1,1,1,3,3, 3-Hexafluoro-2-propanol (HFIP) in DCM (7 mL) and gently mixed for 1 hr. The resin was filtered; and filtrate was evaporated under reduced pressure. Residue was further suspended with DCM (2×5 mL) and evaporated to yield diboronated sensor acid DSL-155A which was used in the next step without purification.

5b: NHS-Activation of Diboronated Sensor:

Crude diboronated sensor acid DSL-155A was dissolved in DMF (2 mL) and treated with 3-(3-Dimethylaminopropyl)-1-ethyl-carbodiimide hydrochloride 13 (EDC) (0.096 g, 0.5 mmol), N-hydroxysuccinimide 12 (NHS) (0.115 g, 1 mmol), and stirred for overnight. Progress of the reaction was monitored by LCMS. After completion of the reaction, reaction mixture was diluted with ethyl acetate (20 mL) and washed with 100 mmol HCl (10 mL). The organic layer was dried over anhydrous $Na_2SO_4$ and evaporated under vacuum, dissolved in DMSO (100 uL) and fractionated by reverse-phase (RP) flash chromatography on a C18 column with a gradient of 20% ACN in water with 0.1% TFA to 60% ACN in water with 0.1% TFA over 10 minutes and analyzed by LCMS. Pure fractions were isolated, combined, frozen, and lyophilized to give 2,5-dioxopyrrolidin-1-yl 3-((2S,4R)-1-(1-hydroxy-1,3-dihydrobenzo[c][1,2]oxaborole-7-carbonyl)-4-(1-hydroxy-1,3-dihydrobenzo[c][1,2]oxaborole-7-carboxamido)pyrrolidine-2-carboxamido)propanoate DSL-155B in ~20% yield (37 mg). Calculated mass $(M+H)^+$ =619.20 Da, Observed mass $(M+H)^+=619.08$ Da. The foregoing synthesis is illustrated in FIG. 17.

Examples DSL-156B-DSL-162B listed in Table IV below were synthesized under, similar conditions.

DSL-145B-DSL-154B, and DSL-163B-DSL-168B can be synthesized using similar procedure.

TABLE IV

| DSL-B Examples | Mass Calculated $[M + H]^{+1}$ | Mass Observed $[M + H]^{+1}$ |
|---|---|---|
| DSL-156B | 607.20 | 606.92 |
| DSL-157B | 647.24 | 646.75 |
| DSL-158B | 635.24 | 617.08 |
| DSL-159B | 647.24 | 647.17 |
| DSL-160B | 635.24 | 635.08 |
| DSL-161B | 907.39 | 907.17 |
| DSL-162B | 931.41 | 931.17 |

The chemical structure and IUPAC name of DSL-1A to DSL-172A are summarized in Table 1 below.

TABLE 1

| Compound # | FF | F | Z1b | Z1b | A' | A" | Structure/IUPAC |
|---|---|---|---|---|---|---|---|
| DSL-1A | FF12A | F2 | FL3 | FL69A | H | AB-1 | 3-((S)-6-butyramido-2-((2S,4R)-1-(1-hydroxy-1,3-dibydrobenzo[c][1,2]oxaborole-6-carbonyl)-4-(1-hydroxy-1,3-dihydrobenzo[e][1,2]oxaborole-6-carboxamido)pyrrolidine-2-carboxamido)hexanamido)propanoic acid |
| DSL-2A | FF12A | F2 | FL3 | FL69A | H | AB-2 | 3-((S)-6-hexanamido-2-((2S,4R)-1-(1-hydroxy-1,3-dibydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanamido)propanoic acid |

TABLE 1-continued

| Compound # | FF | F | Z1b | Z1b | A' | A" | Structure/IUPAC |
|---|---|---|---|---|---|---|---|
| DSL-3A | FF116A | F7 | FL3 | | | | ((2S,3S)-2,3-bis(1-hydroxy-3,3-dimethyl-1,3-dibydrobenzo[c][1,2]oxaborole-6-carboxamido)butanoyl)-L-glutamic acid |
| DSL-4A | FF12A | F2 | FL3 | FL69A | H | AB-4 | 3-((S)-6-decanamido-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanamido)propanoic acid |
| DSL-5A | FF12A | F2 | FL3 | FL69A | H | AB-5 | 3-((S)-6-dodecanamido-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanamido)propanoic acid |

TABLE 1-continued

| Compound # | FF | F | Z1b | Z1b | A' | A" | Structure/IUPAC |
|---|---|---|---|---|---|---|---|
| DSL-6A | FF12A | F2 | FL3 | FL69A | H | AB-6 | |

3-((S)-2-((2S,4R)-1-(1-hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-
carboxamido)-6-
tetradecanamidohexanamido)
propanoic acid

| DSL-7A | FF12A | F2 | FL3 | FL69A | H | AB-7 | |
|---|---|---|---|---|---|---|---|

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-
palmitamidohexanamido)propanoic
acid

| DSL-8A | FF12A | F2 | FL3 | FL69A | H | AB-8 | |
|---|---|---|---|---|---|---|---|

4-(((S)-6-((2-carboxyethyl)amino)-5-
((2S,4R)-1-(1-hydroxy-1,3-

TABLE 1-continued

| Compound # | FF | F | Z1b | Z1b | A' | A'' | Structure/IUPAC |
|---|---|---|---|---|---|---|---| dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-oxohexyl)amino)-4-
oxobutanoic acid

DSL-9A    FF12A    F2    FL3    FL69A    H    AB-9

6-(((S)-6-((2-carboxyethyl)amino)-5-
((2S,4R)-1-(1-hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-
carboxamido)-6-oxohexyl)amino)-6-
oxohexanoic acid

DSL-10A    FF12A    F2    FL3    FL69A    H    AB-10

8-(((S)-6-((2-carboxyethyl)amino)-5-
((2S,4R)-1-(1-hydroxy-1,3-
dihydrobenzo[c][1,2]oxaborole-6-
carbonyl)-4-(1-hydroxy-1,3-

TABLE 1-continued

| Compound # | FF | F | Z1b | Z1b | A' | A'' | Structure/IUPAC |
|---|---|---|---|---|---|---|---| dihydrobenzo[c][1,2]oxaborole-6-
carboxamido)pyrrolidine-2-
carboxamido)-6-oxohexyl)amino)-8-
oxooctanoic acid

| DSL-11A | FF12A | F2 | FL3 | FL69A | H | AB-11 | |

10-(((S)-6-((2-carboxyethyl)amino)-5-
((2S,4R)-1-(1-hydroxy-1,3-
dibydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-oxohexyl)amino)-10-
oxodecanoic acid

| DSL-12A | FF12A | F2 | FL3 | FL69A | H | AB-12 | |

12-(((S)-6-((2-carboxyethyl)amino)-5-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-oxohexyl)amino)-12-
oxododecanoic acid

| DSL-13A | FF12A | F2 | FL3 | FL69A | H | AB-13 | |

TABLE 1-continued

| Compound # | FF | F | Z1b | Z1b | A' | A" | Structure/IUPAC |
|---|---|---|---|---|---|---|---|
| | | | | | | | 14-(((S)-6-((2-carboxyethyl)amino)-5-((2S,4R)-1-(1-hydroxy-1,3-dihydrobenzo[e][1,2]oxaborole-6-carbonyl)-4-(1-hydroxy-1,3-dihydrobenzo[c][1,2]oxaborole-6-carboxamido)pyrrolidine-2-carboxamido)-6-oxohexyl)amino)-14-oxotetradecanoic acid |
| DSL-14A | FF12A | F2 | FL3 | FL69A | H | AB-14 | 16-(((S)-6-((2-carboxyethyl)amino)-5-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-oxohexyl)amino)-16-oxohexadecanoic acid |
| DSL-15A | FF12A | F7 | FL3 | FL69A | H | AB-1 | 3-((S)-6-butyramido-2-((2S,4R)-1-(1-bydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid |

TABLE 1-continued

| Compound # | FF | F | Z1b | Z1b | A' | A" | Structure/IUPAC |
|---|---|---|---|---|---|---|---|
| DSL-16A | FF12A | F7 | FL3 | FL69A | H | AB-2 | |

3-((S)-6-bexanamido-2-((2S,4R)- 1-(1-bydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid

| DSL-17A | FF12A | F7 | FL3 | FL69A | H | AB-3 | |

3-((S)-2-((2S,4R)-1-(1-hydroxy-3,3-dimethyl-1,3-dihydrobenzo[e][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-octanamidohexanamido)propanoic acid TABLE 1-continued

| Compound # | FF | F | Z1b | Z1b | A' | A" | Structure/IUPAC |
|---|---|---|---|---|---|---|---|
| DSL-18A | FF12A | F7 | FL3 | FL69A | H | AB-4 | |

3-((S)-6-decanamido-2-(2S,4R)-1-(1-
hydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)hexanamido)propanoic
acid

| DSL-19A | FF12A | F7 | FL3 | FL69A | H | AB-5 | |
|---|---|---|---|---|---|---|---|

3-((S)-6-dodecanamido-2-((2S,4R)-1-
(1-hydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)hexanamido)propanoic
acid.

| DSL-20A | FF12A | F7 | FL3 | FL69A | H | AB-6 | |
|---|---|---|---|---|---|---|---|

TABLE 1-continued

| Compound # | FF | F | Z1b | Z1b | A' | A'' | Structure/IUPAC |
|---|---|---|---|---|---|---|---|

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-tetradecanamidohexanamido)propanoic acid

| DSL-21A | FF12A | F7 | FL3 | FL69A | H | AB-7 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-palmitamidohexanamido)propanoic acid

| DSL-22A | FF12A | F7 | FL3 | FL69A | H | AB-8 | |

4-(((S)-6-((2-carboxyethyl)amino)-5-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-oxohexyl)amino)-4-oxobutanoic acid TABLE 1-continued

| Compound # | FF | F | Z1b | Z1b | A' | A" | Structure/IUPAC |
|---|---|---|---|---|---|---|---|
| DSL-23A | FF12A | F7 | FL3 | FL69A | H | AB-9 | |

6-(((S)-6-((2-carboxyethyl)amino)-5-
((2S,4R)-1-(1-hydroxy-3,3-dimethyl-
1,3-dihydrobenzo[e][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-oxohexylamino)-6-
oxohexanoic acid

| Compound # | FF | F | Z1b | Z1b | A' | A" | Structure/IUPAC |
|---|---|---|---|---|---|---|---|
| DSL-24A | FF12A | F7 | FL3 | FL69A | H | AB-10 | |

8-(((S)-6-((2-carboxyethyl)amino)-5-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-oxohexyl)amino)-8-
oxooctanoic acid TABLE 1-continued

| Compound # | FF | F | Z1b | Z1b | A' | A" | Structure/IUPAC |
|---|---|---|---|---|---|---|---|
| DSL-25A | FF12A | F7 | FL3 | FL69A | H | AB-11 | 10-(((S)-6-((2-carboxyethyl)amino)-5-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-oxohexyl)amino)-10-oxodecanoic acid |
| DSL-26A | FF12A | F7 | FL3 | FL69A | H | AB-12 | 12-(((S)-6-((2-carboxyethyl)amino)-5-((2S,4R)-1-(1-hydroxy-3,3-dimethyl-1,3-dihydrobenzo[e][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-oxohexyl)amino)-12-oxododecanoic acid |
| DSL-27A | FF12A | F7 | FL3 | FL69A | H | AB-13 | 14-(((S)-6-((2-carboxyethyl)amino)-5-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-oxohexyl)amino)-14-oxotetradecanoic acid |

TABLE 1-continued

| Compound # | FF | F | Z1b | Z1b | A' | A" | Structure/IUPAC |
|---|---|---|---|---|---|---|---|
| DSL-28A | FF12A | F7 | FL3 | FL69A | H | AB-14 | |

16-(((S)-6-((2-carboxyethyl)amino)-5-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-oxohexyl)amino)-16-
oxohexadecanoic acid

| DSL-29A | FF12A | F2 | FL3 | FL69A | H | AB-15 | |
|---|---|---|---|---|---|---|---|

3-((2S)-2-((2S,4R)-1-(1-hydroxy-1,3-
dihydrobenzo[c][1,2]oxaborole-6-
carbonyl)-4-(1-hydroxy-1,3-
dibydrobenzo[e][1,2]oxaborole-6-
carboxamido)pyrrolidine-2-
carboxamido)-6-(2-
phenylpropanamido)hexanamido)
propanoic acid

| DSL-30A | FF12A | F2 | FL3 | FL69A | H | AB-16 | |
|---|---|---|---|---|---|---|---|

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-(2-(4-
isobutylphenyl)acetamido)
hexanamido)propanoic acid TABLE 1-continued

| Compound # | FF | F | Z1b | Z1b | A' | A" | Structure/IUPAC |
|---|---|---|---|---|---|---|---|
| DSL-31A | FF12A | F2 | FL3 | FL69A | H | AB-17 | |

DSL-31A 3-((2S)-2-((2S,4R)-1-(1-hydroxy-1,3-
dihydrobenzo[c][1,2]oxaborole-6-
carbonyl)-4-(1-hydroxy-1,3-
dihydrobenzo[e][1,2]oxaborole-6-
carboxamido)pyrrolidine-2-
carboxamido)-6-(2-(4-
isobutylphenyl)propanamido)
hexanamido)propanoic acid

| DSL-32A | FF12A | F2 | FL3 | FL69A | H | AB-18 | |
|---|---|---|---|---|---|---|---|

3-((S)-6-benzamido-2-
((2S,4R)-1-(1-hydroxy-1,3-
dihydrobenzo[e][1,2]oxaborole-6-
carbonyl)-4-(1-hydroxy-1,3.
dihydrobenzo[c][1,2]oxaborole-6-
carboxamido)pyrrolidine-2-
carboxamido)hexanamido)propanoic
acid TABLE 1-continued

| Compound # | FF | F | Z1b | Z1b | A' | A" | Structure/IUPAC |
|---|---|---|---|---|---|---|---|
| DSL-33A | FF12A | F2 | FL3 | FL69A | H | AB-19 | |

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c]l1,2]oxaborole-6-
carboxamido)pyrrolidine-2-
carboxamido)-6-(2-(p-
tolyl)acetamido)hexanamido)
propanoic acid

| DSL-34A | FF12A | F2 | FL3 | FL69A | H | AB-20 | |

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-(3-
phenylpropanamido)hexanamido)
propanoic acid.

TABLE 1-continued

| Compound # | FF | F | Z1b | Z1b | A' | A" | Structure/IUPAC |
|---|---|---|---|---|---|---|---|
| DSL-35A | FF12A | F2 | FL3 | FL69A | H | AB-21 | |

3-((S)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-(4-phenylbutanamido)hexanamido)propanoic acid

| Compound # | FF | F | Z1b | Z1b | A' | A" | Structure/IUPAC |
|---|---|---|---|---|---|---|---|
| DSL-36A | FF12A | F2 | FL3 | FL69A | H | AB-22 | |

3-((S)-6-(3-(4-chlorophenyl)propanamido)-2-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carboxamido)hexanamido)propanoic acid TABLE 1-continued

| Compound # | FF | F | Z1b | Z1b | A' | A" | Structure/IUPAC |
|---|---|---|---|---|---|---|---|
| DSL-37A | FF12A | F2 | FL3 | FL69A | H | AB-23 | |

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-(3-(4-
(trifluoromethyl)phenyl)propanamido)
hexanamido)propanoic acid

| DSL-38A | FF12A | F2 | FL3 | FL69A | H | AB-24 | |
|---|---|---|---|---|---|---|---|

3-((S)-6-(3-(4-
ethoxyphenyl)propanamido)-2-
((2S,4R)-1-(1-hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-
carboxamido)hexanamido)propanoic
acid TABLE 1-continued

| Compound # | FF | F | Z1b | Z1b | A' | A" | Structure/IUPAC |
|---|---|---|---|---|---|---|---|
| DSL-39A | FF12A | F2 | FL3 | FL69A | H | AB-25 | |

3-((S)-6-(3-(4-
fluorophenyl)propanamido)-2-
((2S,4R)-1-(1-hydroxy-1,3-
dihydrobenzo[c][1,2]oxaborole-6-
carbonyl)-4-(1-hydroxy-1,3-
dihydrobenzo[e][1,2]oxaborole-6-
carboxamido)pyrrolidine-2-
carboxamido)hexanamido)propanoic
acid

| DSL-40A | FF12A | F2 | FL3 | FL69A | H | AB-26 | |
|---|---|---|---|---|---|---|---|

3-((S)-6-(3-(3-
fluorophenyl)propanamido)-2-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)hexanamido)propanoic
acid TABLE 1-continued

| Compound # | FF | F | Z1b | Z1b | A' | A" | Structure/IUPAC |
|---|---|---|---|---|---|---|---|
| DSL-41A | FF12A | F2 | FL3 | FL69A | H | AB-27 | |

3-((S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-(5-
phenylpentanamido)hexanamido)
propanoic acid

| Compound # | FF | F | Z1b | Z1b | A' | A" | Structure/IUPAC |
|---|---|---|---|---|---|---|---|
| DSL-42A | FF12A | F2 | FL3 | FL69A | H | AB-28 | |

3-((S)-6-(3-(3,5-
difluorophenyl)propanamido)-2-
((2S,4R)-1-(1-hydroxy-1,3-
dibydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)hexanamido)propanoic
acid TABLE 1-continued

| Compound # | FF | F | Z1b | Z1b | A' | A" | Structure/IUPAC |
|---|---|---|---|---|---|---|---|
| DSL-43A | FF12A | F2 | FL3 | FL69A | H | AB-29 | |

3-((2S)-2-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-6-(2-(3-hydroxy-2,4,6-
triiodobenzyl)butanamido)
hexanamido)propanoic acid

| DSL-44A | FF12A | F2 | FL3 | FL69A | H | AB-30 | |

3-((S)-6-(4-chloro-2-((furan-2-
ylmethyl)amino)-5-
sulfamoylbenzamido)-2-((2S,4R)-1-
(1-hydroxy-1,3-
dihydrobenzo[c][1,2]oxaborole-6-

TABLE 1-continued

| Compound # | FF | F | Z1b | Z1b | A' | A" | Structure/IUPAC |
|---|---|---|---|---|---|---|---|
| | | | | | | | carbonyl)-4-(1-hydroxy-1,3-dihydrobenzo[c][1,2]oxaborole-6-carboxamido)pyrrolidine-2-carboxamido)hexanamido)propanoic acid |
| DSL-45A | FF12A | F7 | FL3 | FL69A | H | AB-35 | |

6-((4-(((S)-6-((2-carboxyethyl)amino)-5-((2S,4R)-1-(1-hydroxy-3,3-dimethyl-1,3-dibydrobenzo[c][1,2]oxaborole-6-carbonyl)-4-(1-hydroxy-3,3-dimethyl-1,3-dihydrobenzo[e][1,2]oxaborole-6-carboxamido)pyrrolidine-2-carboxamido)-6-oxohexyl)carbamoyl)benzyl)amino)-6-oxohexanoic acid

| DSL-46A | FF12A | F2 | FL3 | FL69A | H | AB-32 | |

3-((S)-2-((2S,4R)-1-(1-hydroxy-1,3-dibydrobenzo[c][1,2]oxaborole-6-carbonyl)-4-(1-hydroxy-1,3-dihydrobenzo[c][1,2]oxaborole-6-carboxamido)pyrrolidine-2-carboxamido)-6-(4-oxo-4-phenylbutanamido)hexanamido)propanoic acid TABLE 1-continued

| Compound # | FF | F | Z1b | Z1b | A' | A" | Structure/IUPAC |
|---|---|---|---|---|---|---|---|
| DSL-47A | FF12A | F7 | FL3 | FL69A | H | AB-36 | |

3-(4-(((S)-6-((2-
carboxyethyl)amino)-5-((2S,4R)-1-(1-
bydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-
oxohexyl)carbamoyl)phenyl)
propanoic acid

| DSL-48A | FF12A | F2 | FL3 | FL69A | H | AB-34 | |

5-((2S,4R)-1-(1-hydroxy-1,3-
dihydrobenzo[c][1,2]oxaborole-6-
carbonyl)-4-(1-hydroxy-1,3-
dibydrobenzo[c][1,2]oxaborole-6-
carboxamido)pyrrolidine-2-

TABLE 1-continued

| Compound # | FF | F | Z1b | Z1b | A' | A" | Structure/IUPAC |
|---|---|---|---|---|---|---|---| carboxamido)-6-oxohexyl)amino)-3-oxopropyl)benzoic acid

| DSL-49A | FF12A | F2 | FL3 | FL69A | H | AB-31 | |

2-(3-(((S)-6-((2-carboxyethyl)amino)-5-((2S,4R)-1-(1-hydroxy-1,3-dihydrobenzo[c][1,2]oxaborole-6-carbonyl)-4-(1-hydroxy-1,3-dibydrobenzo[c][1,2]oxaborole-6-carboxamido)pyrrolidine-2-carboxamido)-6-oxohexyl)amino)-3-oxopropyl)benzoic acid

| DSL-50A | FF12A | F2 | FL3 | FL69A | H | AB-15 | |

3-((2S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-(2-

TABLE 1-continued

| Compound # | FF | F | Z1b | Z1b | A' | A" | Structure/IUPAC |
|---|---|---|---|---|---|---|---| pheny lpropanamido)hexanamido)
propanoic acid

| DSL-51A | FF12A | F7 | FL3 | FL69A | H | AB-16 | |

3-((S)-2-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-(2-(4-
isobutylphenyl)acetamido)
hexanamido)propanoic acid

| DSL-52A | FF12A | F7 | FL3 | FL69A | H | AB-17 | |

3-((2S)-2-((2S,4R)-1-(1-hydroxy-3,3-
dimethyl-1,3-
dibydrobenzo[c][1,2]oxaborole-6-
carbonyl)-4-(1-hydroxy-3,3-dimethy]-
1,3-dihydrobenzo[c][1,2]oxaborole-6-

TABLE 1-continued

| Compound # | FF | F | Z1b | Z1b | A' | A'' | Structure/IUPAC |
|---|---|---|---|---|---|---|---|
| | | | | | | | carboxamido)pyrrolidine-2-carboxamido)-6-(2-(4-isobutylphenyl)propanamido)hexanamido)propanoic acid |
| DSL-53A | FF12A | F7 | FL3 | FL69A | H | AB-18 | |

3-((S)-6-benzamido-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid

| DSL-54A | FF12A | F7 | FL3 | FL69A | H | AB-19 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-

TABLE 1-continued

| Compound # | FF | F | Z1b | Z1b | A' | A" | Structure/IUPAC |
|---|---|---|---|---|---|---|---|
| | | | | | | | carboxamido)pyrrolidine-2-carboxamido)-6-(2-(p-tolyl)acetamido)hexanamido) propanoic acid |
| DSL-55A | FF12A | F7 | FL3 | FL69A | H | AB-20 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-(3-phenylpropanamido)hexanamido) propanoic acid

| DSL-56A | FF12A | F7 | FL3 | FL69A | H | AB-21 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl- TABLE 1-continued

| Compound # | FF | F | Z1b | Z1b | A' | A" | Structure/IUPAC |
|---|---|---|---|---|---|---|---|
| | | | | | | | 1,3-dihydrobenzo[c][1,2]oxaborole-6-carboxamido)pyrrolidine-2-carboxamido)-6-(4-phenylbutanamido)hexanamido)propanoic acid |
| DSL-57A | FF12A | F7 | FL3 | FL69A | H | AB-22 | |

3-((S)-6-(3-(4-chlorophenyl)propanamido)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid

| DSL-58A | FF12A | F7 | FL3 | FL69A | H | AB-23 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl- TABLE 1-continued

| Compound # | FF | F | Z1b | Z1b | A' | A'' | Structure/IUPAC |
|------------|-----|-----|------|-------|-----|------|-----------------|

1,3-dihydrobenzo[c][1,2]oxaborole-6-carboxamido)pyrrolidine-2-carboxamido)-6-(3-(4-(trifluoromethyl)phenyl)propanamido)hexanamido)propanoic acid

| DSL-59A | FF12A | F7 | FL3 | FL69A | H | AB-24 | |

3-((S)-6-(3-(4-ethoxyphenyl)propanamido)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid

| DSL-60A | FF12A | F7 | FL3 | FL69A | H | AB-25 | |

3-((S)-6-(3-(4-fluorophenyl)propanamido)-2-((2S,4R)-1-(1-hydroxy-3,3-dimethyl-1,3-dihydrobenzo[c][1,2]oxaborole-6-

TABLE 1-continued

| Compound # | FF | F | Z1b | Z1b | A' | A" | Structure/IUPAC |
|---|---|---|---|---|---|---|---| carbonyl)-4-(1-hydroxy-3,3-dimethyl-
1,3-dihydrobenzo[c][1,2]oxaborole-6-
carboxamido)pyrrolidine-2-
carboxamido)hexanamido)propanoic
acid

DSL-61A FF12A F7 FL3 FL69A H AB-26

3-((5)-6-(3-(3-
fluorophenyl)propanamido)-2-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)hexanamido)propanoic
acid

DSL-62A FF12A F7 FL3 FL69A H AB-27

3-((S)-2-((2S,4R)-1-(1-hydroxy-3,3-
dimethyl-1,3-
dihydrobenzo[c][1,2]oxaborole-6-

TABLE 1-continued

| Compound # | FF | F | Z1b | Z1b | A' | A" | Structure/IUPAC |
|---|---|---|---|---|---|---|---|
| | | | | | | | carbonyl)-4-(1-hydroxy-3,3-dimethyl-1,3-dihydrobenzo[c][1,2]oxaborole-6-carboxamido)pyrrolidine-2-carboxamido)-6-(5-phenylpentanamido)hexanamido)propanoic acid. |
| DSL-63A | FF12A | F7 | FL3 | FL69A | H | AB-28 | 3-((S)-6-(3-(3,5-difluorophenyl)propanamido)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid |
| DSL-64A | FF12A | F7 | FL3 | FL69A | H | AB-29 | 3-((2S)-6-((2-(3-hydroxy-2,4,6-triiodobenzyl)butanoyl)-λ³-oxidaneyl)-2-((2S,4R)-1-(1-hydroxy- |

| Compound # | FF | F | Z1b | Z1b | A' | A" | Structure/IUPAC |
|---|---|---|---|---|---|---|---|
| | | | | | | | 3,3-dimethyl-1,3-dihydrobenzo[c][1,2]oxaborole-6-carbonyl)-4-(1-hydroxy-3,3-dimethyl-1,3-dihydrobenzo[e][1,2]oxaborole-6-carboxamido)pyrrolidine-2-carboxamido)hexanamido)propanoic acid |
| DSL-65A | FF12A | F7 | FL3 | FL69A | H | AB-30 | |

3-((S)-6-(4-chloro-2-((furan-2-ylmethyl)amino)-5-sulfamoylbenzamido)-2-((2,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)hexanamido)propanoic acid TABLE 1-continued

| Compound # | FF | F | Z1b | Z1b | A' | A" | Structure/IUPAC |
|---|---|---|---|---|---|---|---|
| DSL-66A | FF12A | F7 | FL3 | FL69A | H | AB-37 | |

(S)-18-((2S,4R)-1-(1-hydroxy-3,3-
dimethyl-2,3-dihydro-1H-
benzo[b]borole-6-carbonyl)-4-(1-
hydroxy-3,3-dimethyl-2,3-dihydro-
1H-benzo[b]borole-6-
carboxamido)pyrrolidine-2-
carboxamido)-3,12,19-trioxo-1-
phenyl-7,10-dioxa-4,13,20-
triazatricosan-23-oic acid TABLE 1-continued

| Compound # | FF | F | Z1b | Z1b | A' | A" | Structure/IUPAC |
|---|---|---|---|---|---|---|---|
| DSL-67A | FF12A | F7 | FL3 | FL69A | H | AB-32 | |

3-((S)-2-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-(4-oxo-4-
phenylbutanamido)hexanamido)
propanoic acid

| DSL-68A | FF12A | F7 | FL3 | FL69A | H | AB-33 | |

4-(((S)-6-((2-carboxyethyl)amino)-5-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-
oxohexyl)carbamoyl)benzoic acid TABLE 1-continued

| Compound # | FF | F | Z1b | Z1b | A' | A" | Structure/IUPAC |
|---|---|---|---|---|---|---|---|
| DSL-69A | FF12A | F7 | FL3 | FL69A | H | AB-34 | |

4-(3-(((S)-6-((2-carboxyethyl)amino)-
5-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-oxohexyl)amino)-3-
oxopropyl)benzoic acid

| DSL-70A | FF12A | F7 | FL3 | FL69A | H | AB-31 | |
|---|---|---|---|---|---|---|---|

TABLE 1-continued

| Compound # | FF | F | Z1b | Z1b | A' | A" | Structure/IUPAC |
|---|---|---|---|---|---|---|---|
| | | | | | | | 2-(3-(((S)-6-((2-carboxyethyl)amino)-5-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-6-oxohexyl)amino)-3-oxopropyl)benzoic acid |
| DSL-71A | FF12A | F2 | FL5B | FL69A | H | AB-1 | N6-butyryl-N2-(2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-L-lysyl-L-glutamic acid |
| DSL-72A | FF12A | F2 | FL5B | FL69A | H | AB-2 | |

TABLE 1-continued

| Compound # | FF | F | Z1b | Z1b | A' | A" | Structure/IUPAC |
|---|---|---|---|---|---|---|---|

N⁶-hexanoyl]-N²-((2S,4R)-1-(1-
hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

DSL-73A    FF12A    F2    FL5B    FL69A    H    AB-3

N²-(2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-octanoyl-E-lysyl-L-glutamic acid

DSL-74A    FF12A    F2    FL5B    FL69A    H    AB-4

N⁶-decanoyl-N²-((2S,4R)-1-(1-
hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-75A | FF12A | F2 | FL5B | FL69A | H | AB-5 | |

N⁶-dodecanoyl-N²-((2S,4R)-1-(1-
hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-76A | FF12A | F2 | FL5B | FL69A | H | AB-6 | |

N²-((2S,4R)-1-(1-hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-tetradecanoyl-L-lysyl-L-glutamic
acid

| Compound # | FF | F | Z1b | Z1b | A' | A" | Structure/IUPAC |
|---|---|---|---|---|---|---|---|
| DSL-77A | FF12A | F2 | FL5B | FL69A | H | AB-7 | |

N²-(2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-palmitoyl-L-lysyl-L-glutamic acid TABLE 1-continued

| Compound # | FF | F | Z1b | Z1b | A' | A" | Structure/IUPAC |
|---|---|---|---|---|---|---|---|
| DSL-78A | FF12A | F2 | FL5B | FL69A | H | AB-8 | |

N⁶-(3-carboxypropanoyl)-N²-
((2S,4R)-1-(1-hydroxy-1,3-
dihydrobenzo[c][1,2]oxaborole-6-
carbonyl)-4-(1-hydroxy-1,3-
dibydrobenzo[c][1,2]oxaborole-6-
carboxamido)pyrrolidine-2-carbonyl)-
L-lysyl-L-glutamic acid

| DSL-79A | FF12A | F2 | FL5B | FL69A | H | AB-9 | |
|---|---|---|---|---|---|---|---|

N⁶-(5-carboxypentanoy)-N²-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-80A | FF12A | F2 | FL5B | FL69A | H | AB-10 | |

$N^6$-(7-carboxyheptanoyl)-$N^2$-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| DSL-81A | FF12A | F2 | FL5B | FL69A | H | AB-11 | |
|---|---|---|---|---|---|---|---|

$N^6$-(9-carboxynonanoyl)-$N^2$-((2S,4R)-
1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| DSL-82A | FF12A | F2 | FL5B | FL69A | H | AB-12 | |
|---|---|---|---|---|---|---|---|

$N^6$-(11-carboxyundecanoy])-$N^2$-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-83A | FF12A | F2 | FL5B | FL69A | H | AB-13 | |

N<sup>6</sup>-(13-carboxytridecanoyl)-N<sup>2</sup>-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| DSL-84A | FF12A | F2 | FL5B | FL69A | H | AB-14 | |

N<sup>6</sup>-(15-carboxypentadecanoyl)-N<sup>2</sup>-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| DSL-85A | FF12A | F7 | FL5B | FL69A | H | AB-1 | |

N<sup>6</sup>-butyryl-N<sup>2</sup>-((2S,4R)-1-(1-
hydroxy-3,3-dimethyl-1,3-
dihydrobenzo[c][1,2]oxaborole-6-
carbonyl)-4-(1-hydroxy-3,3-dimethyl- TABLE 1-continued

| Compound # | FF | F | Z1b | Z1b | A' | A" | Structure/IUPAC |
|---|---|---|---|---|---|---|---|
| | | | | | | | 1,3-dihydrobenzo[c][1,2]oxaborole-6-carboxamido)pyrrolidine-2-carbonyl)-L-lysyl-L-glutamic acid |
| DSL-86A | FF12A | F7 | FL5B | FL69A | H | AB-2 | |

N$^6$-hexanoyl-N$^2$-((2S,4R)-1-(1-
hydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-87A | FF12A | F7 | FL5B | FL69A | H | AB-3 | |

N$^2$-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N$^6$-octanoyl-L-lysyl-L-glutamic acid TABLE 1-continued

| Compound # | FF | F | Z1b | Z1b | A' | A'' | Structure/IUPAC |
|---|---|---|---|---|---|---|---|
| DSL-88A | FF12A | F7 | FL5B | FL69A | H | AB-4 | N⁶-decanoyl-N²-((2S,4R)-1-(1-hydroxy-3,3-dimethyl-1,3-dihydrobenzo[c][1,2]oxaborole-6-carbonyl)-4-(1-hydroxy-3,3-dimethy]-1,3-dihydrobenzo[c][1,2]oxaborole-6-carboxamido)pyrrolidine-2-carbonyl)-L-lysyl-L-glutamic acid |
| DSL-89A | FF12A | F7 | FL5B | FL69A | H | AB-5 | N⁶-dodecanoyl-N²-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carbonyl)-L-lysyl-L-glutamic acid |
| DSL-90A | FF12A | F7 | FL5B | FL69A | H | AB-6 | N²-((2S,4R)-1-(1-hydroxy-3,3-dimethyl-1,3-dibydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carbonyl)-N⁶-tetradecanoyl-L-Jysyl-L-glutamic acid |

TABLE 1-continued

| Compound # | FF | F | Z1b | Z1b | A' | A" | Structure/IUPAC |
|---|---|---|---|---|---|---|---|
| DSL-91A | FF12A | F7 | FL5B | FL69A | H | AB-7 | |

$N^2$-((2S,4R)-1-(1-hydroxy-3,3-
dimethyl-1,3-
dihydrobenzo[e][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
$N^6$-palmitoyl-L-lysyl-L-glutamic acid

| DSL-92A | FF12A | F7 | FL5B | FL69A | H | AB-8 | |
|---|---|---|---|---|---|---|---|

$N^6$-(3-carboxypropanoyl])-$N^2$-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A'' | Structure/IUPAC |
|---|---|---|---|---|---|---|---|
| DSL-93A | FF12A | F7 | FL5B | FL69A | H | AB-9 | |

N⁶-(5-carboxypentanoy])-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| | | | | | | | |
|---|---|---|---|---|---|---|---|
| DSL-94A | FF12A | F7 | FLSB | FL69A | H | AB-10 | |

N⁶-(7-carboxyheptanoyl)-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| | | | | | | | |
|---|---|---|---|---|---|---|---|
| DSL-95A | FF12A | F7 | FL5B | FL69A | H | AB-11 | |

TABLE 1-continued

| Compound # | FF | F | Z1b | Z1b | A' | A'' | Structure/IUPAC |
|---|---|---|---|---|---|---|---|
| | | | | | | | N⁶-(9-carboxynonanoy])-N²-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carbonyl)-L-lysyl-L-glutamic acid |
| DSL-96A | FF12A | F7 | FL5B | FL69A | H | AB-12 | |

N⁶-(11-carboxyundecanoyl)-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| DSL-97A | FF12A | F7 | FL5B | FL69A | H | AB-13 | |

N⁶-(13-carboxytridecanoyl)-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| DSL-98A | FF12A | F7 | FL5B | FL69A | H | AB-14 | |

N⁶ (15-carboxypentadecanoyl)-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-99A | FF12A | F2 | FLSB | FL69A | H | AB-15 | |

$N^2$-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
$N^6$-(2-phenylpropanoyl)-L-lysyl-L-
glutamic acid

| Compound # | FF | F | Z1b | Z1b | A' | A" | Structure/IUPAC |
|---|---|---|---|---|---|---|---|
| DSL-100A | FF12A | F2 | FL5B | FL69A | H | AB-16 | |

$N^2$-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
$N^6$-(2-(4-isobutylphenyl)acetyl)-L-
lysyl-L-glutamic acid TABLE 1-continued

| Compound # | FF | F | Z1b | Z1b | A' | A'' | Structure/IUPAC |
|---|---|---|---|---|---|---|---|
| DSL-101A | FF12A | F2 | FL5B | FL69A | H | AB-17 | |

N²-((2S,4R)-1-(1-hydroxy-1,3-
dibydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-(2-(4-isobutylphenyl)propanoyl)-
L-lysyl-L-glutamic acid

| Compound # | FF | F | Z1b | Z1b | A' | A'' | Structure/IUPAC |
|---|---|---|---|---|---|---|---|
| DSL-102A | FF12A | F2 | FLSB | FL69A | H | AB-18 | |

N⁶-benzoyl-N²-((2S,4R)-1-(1-
hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-103A | FF12A | F2 | FLSB | FL69A | H | AB-19 | |

N²-((2S,4R)-1-(1-hydroxy-1,3-
dihydrobenzo[c][1,2]oxaborole-6-
carbonyl)-4-(1-hydroxy-1,3-
dihydrobenzo[e][1,2]oxaborole-6-
carboxamido)pyrrolidine-2-carbonyl)-
N⁶-(2-(p-tolyl)acetyl)-L-lysyl-L-
glutamic acid

| DSL-104A | FF12A | F2 | FL5B | FL69A | H | AB-20 | |

N²-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-(3-phenylpropanoyl)-L-lysyl-L-
glutamic acid TABLE 1-continued

| Compound # | FF | F | Z1b | Z1b | A' | A" | Structure/IUPAC |
|---|---|---|---|---|---|---|---|
| DSL-105A | FF12A | F2 | FL5B | FL69A | H | AB-21 | |

N²-((2S,4R)-1-(1-hydroxy-1,3.
dibydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-(4-phenylbutanoyl)-L-lysyl-L-
glutamic acid

| DSL-106A | FF12A | F2 | FL5B | FL69A | H | AB-22 | |

N⁶-(3-(4-chlorophenyl)propanoyl])-
N²-((2S,4R)-1-(1-hydroxy-1,3-
dihydrobenzo[e][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-107A | FF12A | F2 | FL5B | FL69A | H | AB-23 | |

N²-(2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
N⁶-(3-(4-
(trifluoromethyl)pbenyl)propanoyl)-L-
lysyl-L-glutamic acid

| DSL-108A | FF12A | F2 | FL5B | FL69A | H | AB-24 | |

N⁶-(3-(4-ethoxyphenyl)propanoyl)-
N²((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-109A | FF12A | F2 | FL5B | FL69A | H | AB-25 | |

N⁶-(3-(4-fluorophenyl)propanoyl)-
N²-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-110A | FF12A | F2 | FL5B | FL69A | H | AB-26 | |

N⁶-(3-(3-fluorophenyl)propanoyl)-
N²-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-111A | FF12A | F2 | FL5B | FL69A | H | AB-27 | |

N²-((2S,4R)-1-(1-hydroxy-1,3-dibydrobenzo[c][1,2]oxaborole-6-carbonyl)-4-(1-hydroxy-1,3-dihydrobenzo[c][1,2]oxaborole-6-carboxamido)pyrrolidine-2-carbonyl)-N⁶-(5-phenylpentanoyl)-L-lysyl-L-glutamic acid

| Compound # | FF | F | Z1b | Z1b | A' | A" | Structure/IUPAC |
|---|---|---|---|---|---|---|---|
| DSL-112A | FF12A | F2 | FL5B | FL69A | H | AB-28 | |

N⁶-(3-(3,5-difluorophenyl)propanoyl)-N²-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-L-lysyl-L-glutamic acid TABLE 1-continued

| Compound # | FF | F | Z1b | Z1b | A' | A" | Structure/IUPAC |
|---|---|---|---|---|---|---|---|
| DSL-113A | FF12A | F2 | FLSB | FL69A | H | AB-29 | |

N²-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-carboxamido)pyrrolidine-2-carbonyl)-N⁶-(2-(3-hydroxy-2,4,6-triiodobenzyl)butanoyl)-L-lysyl-L-glutamic acid

| Compound # | FF | F | Z1b | Z1b | A' | A" | Structure/IUPAC |
|---|---|---|---|---|---|---|---|
| DSL-114A | FF12A | F2 | FLSB | FL69A | H | AB-30 | |

N⁶-(4-chloro-2-((furan-2-ylmethyl)amino)-5-sulfamoylbenzoyl)-N²-((2S,4R)-1-(1-hydroxy-1,3-dihydrobenzo[c][1,2]oxaborole-6-

TABLE 1-continued

| Compound # | FF | F | Z1b | Z1b | A' | A'' | Structure/IUPAC |
|---|---|---|---|---|---|---|---|
| | | | | | | | carbonyl)-4-(1-hydroxy-1,3-dihydrobenzo[c][1,2]oxaborole-6-carboxamido)pyrrolidine-2-carbonyl)-L-lysyl-L-glutamic acid |
| DSL-115A | FF12A | F7 | FL3 | FL69A | H | AB-20 | |

3-((S)-2-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)-4-(3-phenylpropanamido)butanamido)propanoic acid.

| Compound # | FF | F | Z1b | Z1b | A' | A'' | Structure/IUPAC |
|---|---|---|---|---|---|---|---|
| DSL-116A | FF12A | F2 | FL5B | FL69A | H | AB-32 | |

N²-((2S,4R)-1-(1-hydroxy-1,3-dihydrobenzo[c][1,2]oxaborole-6-carbonyl)-4-(1-hydroxy-1,3-dihydrobenzo[c][1,2]oxaborole-6-

TABLE 1-continued

| Compound # | FF | F | Z1b | Z1b | A' | A" | Structure/IUPAC |
|---|---|---|---|---|---|---|---|
| | | | | | | | carboxamido)pyrrolidine-2-carbonyl)-N⁶-(4-oxo-4-phenylbutanoyl)-L-lysyl-L-glutamic acid |

DSL-117A FF12A F7 FL3 FL69A H AB-34

4-(3-(((S)-4-((2-carboxyethyl)amino)-
3-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-4-oxobutyl)amino)-3-
oxopropyl)benzoic acid

DSL-118A FF12A F2 FL5B FL69A H AB-34

N⁶-(3-(4-carboxyphenyl)propanoyl)-
N²-((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-

TABLE 1-continued

| Compound # | FF | F | Z1b | Z1b | A' | A" | Structure/IUPAC |
|---|---|---|---|---|---|---|---| carboxamido)pyrrolidine-2-carbonyl)-
L-lysyl-L-glutamic acid

DSL-119A    FF12A    F2    FL5B    FL69A    H    AB-31

N⁶-(3-(2-carboxyphenyl)propanoy])-
N²-((2S,4R)-1-(1-hydroxy-1,3-
dihydrobenzo[c][1,2]oxaborole-6-
carbonyl)-4-(1-hydroxy-1,3-
dibydrobenzo[c][1,2]oxaborole-6-
carboxamido)pyrrolidine-2-carbonyl)-
L-lysyl-L-glutamic acid

DSL-120A    FF12A    F7    FL5B    FL69A    H    AB-15

N²-((2S,4R)1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(2-phenylpropanoyl)-L-lysyl-L-
glutamic acid TABLE 1-continued

| Compound # | FF | F | Z1b | Z1b | A' | A'' | Structure/IUPAC |
|---|---|---|---|---|---|---|---|
| DSL-121A | FF12A | F7 | FL5B | FL69A | H | AB-16 | |

N²-(2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(2-(4-isobutylphenyl)acetyl)-L-
lysyl-L-glutamic acid

| Compound # | FF | F | Z1b | Z1b | A' | A'' | Structure/IUPAC |
|---|---|---|---|---|---|---|---|
| DSL-122A | FF12A | F7 | FL5B | FL69A | H | AB-17 | |

N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(2-(4-isobutylphenyl)propanoyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-123A | FF12A | F7 | FL5B | FL69A | H | AB-18 | |

N⁶-benzoyl-N²-((2S,4R)-1-(1-
bydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-124A | FF12A | F7 | FL5B | FL69A | H | AB-19 | |

N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(2-(p-tolyl)acetyl)-L-lysyl-L-
glutamic acid TABLE 1-continued

| Compound # | FF | F | Z1b | Z1b | A' | A" | Structure/IUPAC |
|---|---|---|---|---|---|---|---|
| DSL-125A | FF12A | F7 | FL5B | FL69A | H | AB-20 | |

N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(3-phenylpropanoy])-L-Jysyl-L-
glutamic acid

| DSL-126A | FF12A | F7 | FL5B | FL69A | H | AB-21 | |
|---|---|---|---|---|---|---|---|

N²-((2S,4R)-1-(1-hydroxy-3,3-
dimethyl-1,3-
dibydrobenzo[c][1,2]oxaborole-6-
carbonyl)-4-(1-hydroxy-3,3-dimethy]-
1,3-dihydrobenzo[c][1,2]oxaborole-6-
carboxamido)pyrrolidine-2-carbonyl)-
N⁶-(4-phenylbutanoyl)-L-lysyl-L-
glutamic acid TABLE 1-continued

| Compound # | FF | F | Z1b | Z1b | A' | A" | Structure/IUPAC |
|---|---|---|---|---|---|---|---|
| DSL-127A | FF12A | F7 | FL5B | FL69A | H | AB-22 | |

N⁶-(3-(4-chlorophenyl)propanoy)-
N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| DSL-128A | FF12A | F7 | FL5B | FL69A | H | AB-23 | |
|---|---|---|---|---|---|---|---|

N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(3-(4-
(trifluoromethyl)phenyl)propanoyl)-L-
lysyl-L-glutamic acid TABLE 1-continued

| Compound # | FF | F | Z1b | Z1b | A' | A" | Structure/IUPAC |
|---|---|---|---|---|---|---|---|
| DSL-129A | FF12A | F7 | FL5B | FL69A | H | AB-24 | |

N⁶-(3-(4-ethoxyphenyl)propanoyl)-
N²-((2S,4R)-1-(1-hydroxy-3,3-
dimethyl-1,3-
dibydrobenzo[c][1,2]oxaborole-6-
carbonyl)-4-(1-hydroxy-3,3-dimethy]-
1,3-dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-130A | FF12A | F7 | FLSB | FL69A | H | AB-25 | |

N⁶-(3-(4-fluorophenyl)propanoyl)-
N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-131A | FF12A | F7 | FL5B | FL69A | H | AB-26 | |

N⁶-(3-(3-fluorophenyl)propanoyl)-
N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| Compound # | FF | F | Z1b | Z1b | A' | A" | Structure/IUPAC |
|---|---|---|---|---|---|---|---|
| DSL-132A | FF12A | F7 | FL5B | FL69A | H | AB-27 | |

N²-((2S,4R)-1-(1-hydroxy-3,3-
dimethyl-1,3-
dibydrobenzo[c][1,2]oxaborole-6-
carbonyl)-4-(1-hydroxy-3,3-dimethy]-
1,3-dihydrobenzo[c][1,2]oxaborole-6-
carboxamido)pyrrolidine-2-carbonyl)-
N⁶-(5-phenylpentanoyl)-L-lysyl-L-
glutamic acid TABLE 1-continued

| Compound # | FF | F | Z1b | Z1b | A' | A" | Structure/IUPAC |
|---|---|---|---|---|---|---|---|
| DSL-133A | FF12A | F7 | FL5B | FL69A | H | AB-28 | |

N⁶-(3-(3,5-
difluorophenyl)propanoyl)-N²-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| DSL-134A | FF12A | F7 | FL5B | FL69A | H | AB-29 | |
|---|---|---|---|---|---|---|---|

N⁶-(2-(3-hydroxy-2,4,6-
triiodobenzyl)butanoyl)-N²-((2S,4R)-
1-(1-hydroxy-3,3-dimethyl-1,3-
dihydrobenzo[e][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid TABLE 1-continued

| Compound # | FF | F | Z1b | Z1b | A' | A" | Structure/IUPAC |
|---|---|---|---|---|---|---|---|
| DSL-135A | FF12A | F7 | FL5B | FL69A | H | AB-30 | |

N[6]-(4-chloro-2-((furan-2-
ylmethyl)amino)-5-
sulfamoylbenzoyl)-N[2]-((2S,4R)-1-(1-
hydroxy-3,3-dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

| DSL-136A | FF12A | F7 | FL3 | FL69A | H | AB-36 | |
|---|---|---|---|---|---|---|---|

3-(4-(((S)-4-((2-carboxyethyl)amino)-
3-((2S,4R)-1-(1-hydroxy-3,3-
dimethyl-1,3-

TABLE 1-continued

| Compound # | FF | F | Z1b | Z1b | A' | A" | Structure/IUPAC |
|---|---|---|---|---|---|---|---| dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-4-
oxobutyl)carbamoyl)phenyl)propanoic
acid

DSL-137A    FF12A    F7    FL5B    FL69A    H    AB-32

N²-(2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
N⁶-(4-oxo-4-phenylbutanoyl)-L-lysyl-
L-glutamic acid

DSL-138A    FF12A    F7    FL5B    FL69A    H    AB-38

TABLE 1-continued

| Compound # | FF | F | Z1b | Z1b | A' | A" | Structure/IUPAC |
|---|---|---|---|---|---|---|---|

2-(2-(((S)-6-((2-carboxyethyl)amino)-
5-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-6-oxohexyl)amino)-2-
oxoethyl)benzoic acid

DSL-139A    FF12A    F7    FL5B    FL69A    H    AB-34

N⁶-(3-(4-carboxyphenyl)propanoyl)-
N²-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-lysyl-L-glutamic acid

DSL-140A    FF12A    F7    FL5B    FL69A    H    AB-31

TABLE 1-continued

| Compound # | FF | F | Z1b | Z1b | A' | A'' | Structure/IUPAC |
|---|---|---|---|---|---|---|---|
| | | | | | | | N<sup>6</sup>-(3-(2-carboxyphenyl)propanoyl)-N<sup>2</sup>-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carbonyl)-L-lysyl-L-glutamic acid |
| DSL-141A | FF12A | F7 | FL3 | | | | |

$N^6$-(3-(2-carboxyphenyl)propanoyl)-$N^2$-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carbonyl)-L-lysyl-L-glutamic acid 3-((2S,4R)-1-(1-hydroxy-3,3-dimethyl-1,3-dihydrobenzo[c][1,2]oxaborole-6-carbonyl)-4-(1-hydroxy-3,3-dimethyl-1,3-dihydrobenzo[c][1,2]oxaborole-6-carboxamido)pyrrolidine-2-carboxamido)propanoic acid

DSL-142A    FF116A    F7    FL3

3-((2S,3S)-2,3-bis(1-hydroxy-3,3-dimethyl-1,3-dihydrobenzo[c][1,2]oxaborole-6-carboxamido)butanamido)propanoic acid TABLE 1-continued

| Compound # | FF | F | Z1b | Z1b | A' | A" | Structure/IUPAC |
|---|---|---|---|---|---|---|---|
| DSL-143A | FF12A | F7 | FL65 | | | | |

(S)-3-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-5-phenylpentanoic acid

| DSL-144A | FF12A | F7 | FL5B | | | | |

((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-carbonyl)-
L-glutamic acid

| Compound # | FF | F | Z1b | Z1b | A' | A" | Structure/IUPAC |
|---|---|---|---|---|---|---|---|
| DSL-145A | FF12A | F13 | FL3 | | | | |

3-((2S,4R)-1-(1-hydroxy-1,3-
dihydrobenzo[c][1,2]oxaborole-3-
carbonyl)-4-(1-hydroxy-1,3-
dihydrobenzo[e][1,2]oxaborole-3-
carboxamido)pyrrolidine-2-
carboxamido)propanoic acid

| DSL-146A | FF116A | F13 | FL3 | | | | |
|---|---|---|---|---|---|---|---|

3-((2S,3S)-2,3-bis(1-hydroxy-1,3-
dihydrobenzo[c][1,2]oxaborole-3-
carboxamido)butanamido)propanoic
acid TABLE 1-continued

| Compound # | FF | F | Z1b | Z1b | A' | A" | Structure/IUPAC |
|---|---|---|---|---|---|---|---|
| DSL-147A | FF12A | F13 | FL65 | | | | |

(3S)-3-((2S,4R)-1-(1-hydroxy-1,3-
dihydrobenzo[c][1,2]oxaborole-3-
carbonyl)-4-(1-hydroxy-1,3-
dibydrobenzo[c][1,2]oxaborole-3-
carboxamido)pyrrolidine-2-
carboxamido)-5-phenylpentanoic acid

| DSL-148A | FF12A | F13 | FL5B | | | | |

((2S,4R)-1-(1-hydroxy-1,3-
dihydrobenzo[c][1,2]oxaborole-3-
carbonyl)-4-(1-hydroxy-1,3-
dihydrobenzo[c][1,2]oxaborole-3-
carboxamido)pyrrolidine-2-carbonyl)-
L-glutamic acid TABLE 1-continued

| Compound # | FF | F | Z1b | Z1b | A' | A" | Structure/IUPAC |
|---|---|---|---|---|---|---|---|
| DSL-149A | FF12A | F13 | FL3 | FL69A | H | AB-20 | |

3-((2S)-2-((2S,4R)-1-(1-hydroxy-1,3-
dihydrobenzo[c][1,2]oxaborole-3-
carbonyl)-4-(1-hydroxy-1,3-
dihydrobenzo[c][1,2]oxaborole-3-
carboxamido)pyrrolidine-2-
carboxamido)-6-(3-
phenylpropanamido)hexanamido)
propanoic acid

| Compound # | FF | F | Z1b | Z1b | A' | A" | Structure/IUPAC |
|---|---|---|---|---|---|---|---|
| DSL-150A | FF12A | F13 | FL3 | FL69A | H | AB-10 | |

8-(((5S)-6-((2-carboxyethyl)amino)-5-
((2S,4R)-1-(1-hydroxy-1,3-
dihydrobenzo[c][1,2]oxaborole-3-
carbonyl)-4-(1-hydroxy-1,3-
dihydrobenzo[c][1,2]oxaborole-3-
carboxamido)pyrrolidine-2-
carboxamido)-6-oxohexyl)amino)-8-
oxooctanoic acid TABLE 1-continued

| Compound # | FF | F | Z1b | Z1b | A' | A'' | Structure/IUPAC |
|---|---|---|---|---|---|---|---|
| DSL-151A | FF12A | F2 | FL3 | FL69A | H | AB-20 | |

3-((S)-2-((2S,4R)-1-(1-hydroxy-1,3-dihydrobenzo[e][1,2]oxaborole-7-carbonyl)-4-(1-hydroxy-1,3-dihydrobenzo[c][1,2]oxaborole-7-carboxamido)pyrrolidine-2-carboxamido)-6-(3-phenylpropanamido)hexanamido) propanoic acid

| Compound # | FF | F | Z1b | Z1b | A' | A'' | Structure/IUPAC |
|---|---|---|---|---|---|---|---|
| DSL-152A | FF12A | F2 | FL3 | FL69A | H | AB-10 | |

8-(((S)-6-((2-carboxyethyl)amino)-5-((2S,4R)-1-(1-hydroxy-1,3-dihydrobenzo[c][1,2]oxaborole-7-carbonyl)-4-(1-hydroxy-1,3-dihydrobenzo[e][1,2]oxaborole-7-carboxamido)pyrrolidine-2-carboxamido)-6-oxohexyl)amino)-8-oxooctanoic acid TABLE 1-continued

| Compound # | FF | F | Z1b | Z1b | A' | A" | Structure/IUPAC |
|---|---|---|---|---|---|---|---|
| DSL-153A | FF12A | F6 | FL3 | FL69A | H | AB-20 | |

3-((S)-2-((2S,4R)-1-(1-hydroxy-3,4-
dihydro-1H-benzo[c][1,2]oxaborinine-
8-carbonyl)-4-(1-hydroxy-3,4-
dihydro-1H-benzo[c][1,2]oxaborinine-
8-carboxamido)pyrrolidine-2-
carboxamido)-6-(3-
pheny lpropanamido)hexanamido)
propanoic acid

| | | | | | | | |
|---|---|---|---|---|---|---|---|
| DSL-154A | FF12A | F6 | FL3 | FL69A | H | AB-10 | |

8-(((S)-6-((2-carboxyethyl)amino)-5-
((2S,4R)-1-(1-hydroxy-3,4-dihydro-
1H-benzo[c][1,2]oxaborinine-8-
carbonyl)-4-(1-hydroxy-3,4-dihydro-
1H-benzo[c][1,2]oxaborinine-8-
carboxamido)pyrrolidine-2-
carboxamido)-6-oxohexyl)amino)-8-
oxooctanoic acid TABLE 1-continued

| Compound # | FF | F | Z1b | Z1b | A' | A" | Structure/IUPAC |
|---|---|---|---|---|---|---|---|
| DSL-155A | FF12A | F2 | FL3 | | | | |

3-((2S,4R)-1-(1-hydroxy-1,3-dihydrobenzo[c][1,2]oxaborole-7-carbonyl)-4-(1-hydroxy-1,3-dihydrobenzo[c][1,2]oxaborole-7-carboxamido)pyrrolidine-2-carboxamido)propanoic acid

| DSL-156A | FF116A | F2 | FL3 | | | | |
|---|---|---|---|---|---|---|---|

3-((2S,3S)-2,3-bis(1-hydroxy-1,3-dihydrobenzo[c][1,2]oxaborole-7-carboxamido)butanamido)propanoic acid TABLE 1-continued

| Compound # | FF | F | Z1b | Z1b | A' | A" | Structure/IUPAC |
|---|---|---|---|---|---|---|---|
| DSL-157A | FF12A | F6 | FL3 | | | | |
| DSL-158A | FF116A | F6 | FL3 | | | | |

DSL-157A 3-((2S,4R)-1-(1-hydroxy-3,4-dihydro-
1H-benzo[c][1,2]oxaborinine-8-
carbonyl)-4-(1-hydroxy-3,4-dihydro-
1H-benzo[c][1,2]oxaborinine-8-
carboxamido)pyrrolidine-2-
carboxamido)propanoic acid

DSL-158A 3-((2S,3S)-2,3-bis(1-hydroxy-3,4-
dihydro-1H-benzo[c][1,2]oxaborinine-
8-carboxamido)butanamido)propanoic
acid TABLE 1-continued

| Compound # | FF | F | Z1b | Z1b | A' | A" | Structure/IUPAC |
|---|---|---|---|---|---|---|---|
| DSL-159A | FF12A | F6 | FL3 | | | | |
| DSL-160A | FF116A | F6 | FL3 | | | | |

DSL-159A structure:

3-((2S,4R)-1-(1-hydroxy-3,4-dihydro-
1H-benzo[c][1,2]oxaborinine-7-
carbonyl)-4-(1-hydroxy-3,4-dihydro-
1H-benzo[c][1,2]oxaborinine-7-
carboxamido)pyrrolidine-2-
carboxamido)propanoic acid DSL-160A structure:

3-(2S,3S)-2,3-bis(1-hydroxy-3,4-
dihydro-1H-benzo[c][1,2]oxaborinine-
7-carboxamido)butanamido)propanoic
acid TABLE 1-continued

| Compound # | FF | F | Z1b | Z1b | A' | A'' | Structure/IUPAC |
|---|---|---|---|---|---|---|---|
| DSL-161A | FF12A | F2 | FL3 | FL69A | H | AB-20 | |

3-((S)-2-((2S,4R)-4-(2-(1-hydroxy-
1,3-dihydrobenzo[c][1,2]oxaborol-7-
yl)acetamido)-1-(2-(1-hydroxy-1,3-
dihydrobenzo[c][1,2]oxaborol-7-
yl)acetyl)pyrrolidine-2-carboxamido)-
6-(3-
phenylpropanamido)hexanamido)
propanoic acid

| DSL-162A | FF12A | F2 | FL3 | FL69A | H | AB-10 | |

8-(((S)-6-((2-carboxyethyl)amino)-5-
((2S,4R)-4-(2-(1-hydroxy-1,3-
dihydrobenzo[c][1,2]oxaborol-7-
yl)acetamido)-1-(2-(1-hydroxy-1,3-
dihydrobenzo[c][1,2]oxaborol-7-
yl)acetyl)pyrrolidine-2-carboxamido)-
6-oxohexyl)amino)-8-oxooctanoic
acid TABLE 1-continued

| Compound # | FF | F | Z1b | Z1b | A' | A" | Structure/IUPAC |
|---|---|---|---|---|---|---|---|
| DSL-163A | FF12A | F2 | FL3 | FL69A | H | AB-20 | |

3-((S)-2-((2S,4R)-1-(1-hydroxy-1,3-
dihydrobenzo[c][1,2]oxaborole-4-
carbonyl)-4-(1-hydroxy-1,3-
dibydrobenzo[c][1,2]oxaborole-4-
carboxamido)pyrrolidine-2-
carboxamido)-6-(3-
phenylpropanamido)hexanamido)
propanoic acid

| DSL-164A | FF12A | F2 | FL3 | | | | |

3-((2S,4R)-4-(2-(1-hydroxy-1,3-
dihydrobenzo[c][1,2]oxaborol-7-
yl)acetamido)-1-(2-(1-hydroxy-1,3-
dibydrobenzo[c][1,2]oxaboro]-7-
yl)acetyl)pyrrolidine-2-
carboxamido)propanoic acid TABLE 1-continued

| Compound # | FF | F | Z1b | Z1b | A' | A" | Structure/IUPAC |
|---|---|---|---|---|---|---|---|
| DSL-165A | FF12A | F2 | FL3 | FL69A | H | AB-10 | |

8-(((S)-6-((2-carboxyethyl)amino)-5-
((2S,4R)-1-(1-hydroxy-1,3-
dihydrobenzo[c][1,2]oxaborole-4-
carbonyl)-4-(1-hydroxy-1,3-
dihydrobenzo[c][1,2]oxaborole-4-
carboxamido)pyrrolidine-2-
carboxamido)-6-oxohexyl)amino)-8-
oxooctanoic acid

| Compound # | FF | F | Z1b | Z1b | A' | A" | Structure/IUPAC |
|---|---|---|---|---|---|---|---|
| DSL-166A | FF116A | F2 | FL3 | | | | |

3-((2S,3S)-2,3-bis(2-(1-hydroxy-1,3-
dihydrobenzo[c][1,2]oxaborol-7-
yl)acetamido)butanamido)propanoic
acid TABLE 1-continued

| Compound # | FF | F | Z1b | Z1b | A' | A'' | Structure/IUPAC |
|---|---|---|---|---|---|---|---|
| DSL-167A | FF12A | F2 | FL3 | | | | |

3-((2S,4R)-1-(1-hydroxy-1,3-
dibydrobenzo[e][1,2]oxaborole-4-
carbonyl)-4-(1-hydroxy-2,3-dihydro-
1H-benzo[b]borole-4-
carboxamido)pyrrolidine-2-
carboxamido)propanoic acid

| DSL-168A | FF116A | F2 | FL3 | | | | |

3-((2S,3S)-2,3-bis(1-hydroxy-1,3-
dihydrobenzo[c][1,2]oxaborole-4-
carboxamido)butanamido)propanoic
acid TABLE 1-continued

| Compound # | FF | F | Z1b | Z1b | A' | A" | Structure/IUPAC |
|---|---|---|---|---|---|---|---|
| DSL-169A | FF12A | F2 | FL3 | FL69A | H | AB-10 | |

8-(((S)-7-((2-carboxyethyl)amino)-5-
((2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-7-oxoheptyl)amino)-8-
oxooctanoic acid

| Compound # | FF | F | Z1b | Z1b | A' | A" | Structure/IUPAC |
|---|---|---|---|---|---|---|---|
| DSL-170A | FF12A | F7 | FL3 | FL69A | H | AB-10 | |

8-(((S)-7-((2-carboxyethyl)amino)-5-
((2S,4R)-1-(1-hydroxy-3,3-dimethyl-
1,3-dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-7-oxoheptyl)amino)-8-
oxooctanoic acid TABLE 1-continued

| Compound # | FF | F | Z1b | Z1b | A' | A" | Structure/IUPAC |
|---|---|---|---|---|---|---|---|
| DSL-171A | FF12A | F2 | FL3 | FL69A | H | AB-20 | |

3-((S)-3-(2S,4R)-1-(1-hydroxy-1,3-
dihydrobenzo[c][1,2]oxaborole-6-
carbonyl)-4-(1-hydroxy-1,3-
dihydrobenzo[c][1,2]oxaborole-6-
carboxamido)pyrrolidine-2-
carboxamido)-7-(3-
phenylpropanamido)heptanamido)
propanoic acid

| Compound # | FF | F | Z1b | Z1b | A' | A" | Structure/IUPAC |
|---|---|---|---|---|---|---|---|
| DSL-172A | FF12A | F7 | FL3 | FL69A | H | AB-20 | |

3-((S)-3-((2S,4R)-1-(1-hydroxy-3,3-
dimethyl-1,3-
dihydrobenzo[c][1,2]oxaborole-6-
carbonyl)-4-(1-hydroxy-3,3-dimethyl-
1,3-dihydrobenzo[c][1,2]oxaborole-6-
carboxamido)pyrrolidine-2-
carboxamido)-7-(3-
phenylpropanamido)heptanamido)
propanoic acid TABLE 1-continued

| Compound # | FF | F | Z1b | Z1b | A' | A" | Structure/IUPAC |
|---|---|---|---|---|---|---|---|
| DSL-173A | FF12A | F7 | # | # | # | # | |

(S)-1-(2S,4R)-1-(1-hydroxy-3,3-
dimethyl-1,3-
dihydrobenzo[e][1,2]oxaborole-6-
carbonyl)-4-(1-hydroxy-3,3-dimethyl-
1,3-dihydrobenzo[c][1,2]oxaborole-6-
carboxamido)pyrrolidin-2-yl)-1,10,13-
trioxo-12-(4-(3-
phenylpropanamido)butyl)-5,8-dioxa-
2,11-diazaheptadecan-17-oic acid

| DSL-174A | FF12A | F7 | # | # | # | # | |

(S)-10-(2-(4-((3-
carboxypropanamido)methyl)
phenyl)acetamido)-6-((2S,4R)-1-(1-
hydroxy-3,3-dimethyl-1,3-
dihydrobenzo[c][1,2]oxaborole-6-
carbonyl)-4-(1-hydroxy-3,3-
dimethyl-1,3-
dihydrobenzo[c][1,2]oxaborole-6-
carboxamido)pyrrolidine-2-
carboxamido)-5-oxodecanoic acid

| DSL-175A | FF12A | F7 | # | # | # | # | |

$N^2$-((2S,4R)-1-(1-hydroxy-3,3-
dimethyl-1,3-
dihydrobenzo[c][1,2]oxaborole-6-
carbonyl)-4-(1-hydroxy-3,3-
dimethy 1-1,3-

TABLE 1-continued

| Compound # | FF | F | Z1b | Z1b | A' | A" | Structure/IUPAC |
|---|---|---|---|---|---|---|---|
| | | | | | | | dihydrobenzo[c][1,2]oxaborole-6-carboxamido)pyrrolidine-2-carbonyl)-N$^6$-(3-phenylpropanoyl)-L-lysyl-L-glutamic acid |

F. Synthesis of Compounds of Formula IB

Illustrative synthesis protocols are provided that can be used to synthesize the examples described.

The lines connecting cysteine residues are disulfide bonds. For the sake of clarity, the H- at the N-terminus of the A- and B-chain of insulin is not histidine, it is the hydrogen of the N-terminus. The —OH shown at the C-terminal end of the A- and B-chain is the C-terminus of the respective chain.

Insulin Expression and Conjugation Method 1

1a. Expression of proinsulin

Proinsulin can be expressed using standard IPTG induction of IPTG inducible expression constructs and vectors in E. coli strains such as B21 strain. Briefly, the expression construct consists of the B-chain, C-peptide, A-chain. For example, the c-peptide sequence of EAEDLQVGQVEL-GGGPGAGSLQPLALEGSLQR (SEQ ID NO:24070) can be used for expression of the proinsulin. Proinsulin is expressed in inclusion bodies (IBs), IBs are captured, washed and further purified, for example via an existing his-tag before sensor conjugation. Expression of the desired single-chain proinsulin can be performed via known procedures in the art. See, e.g., U.S. Pat. Nos. 5,457,066, 5,700, 662, 5,514,646, 9,050,371, and 10400021.

1b. Conjugation of Diboronate Sensor DSL-34B with Proinsulin.

Figure 10A:
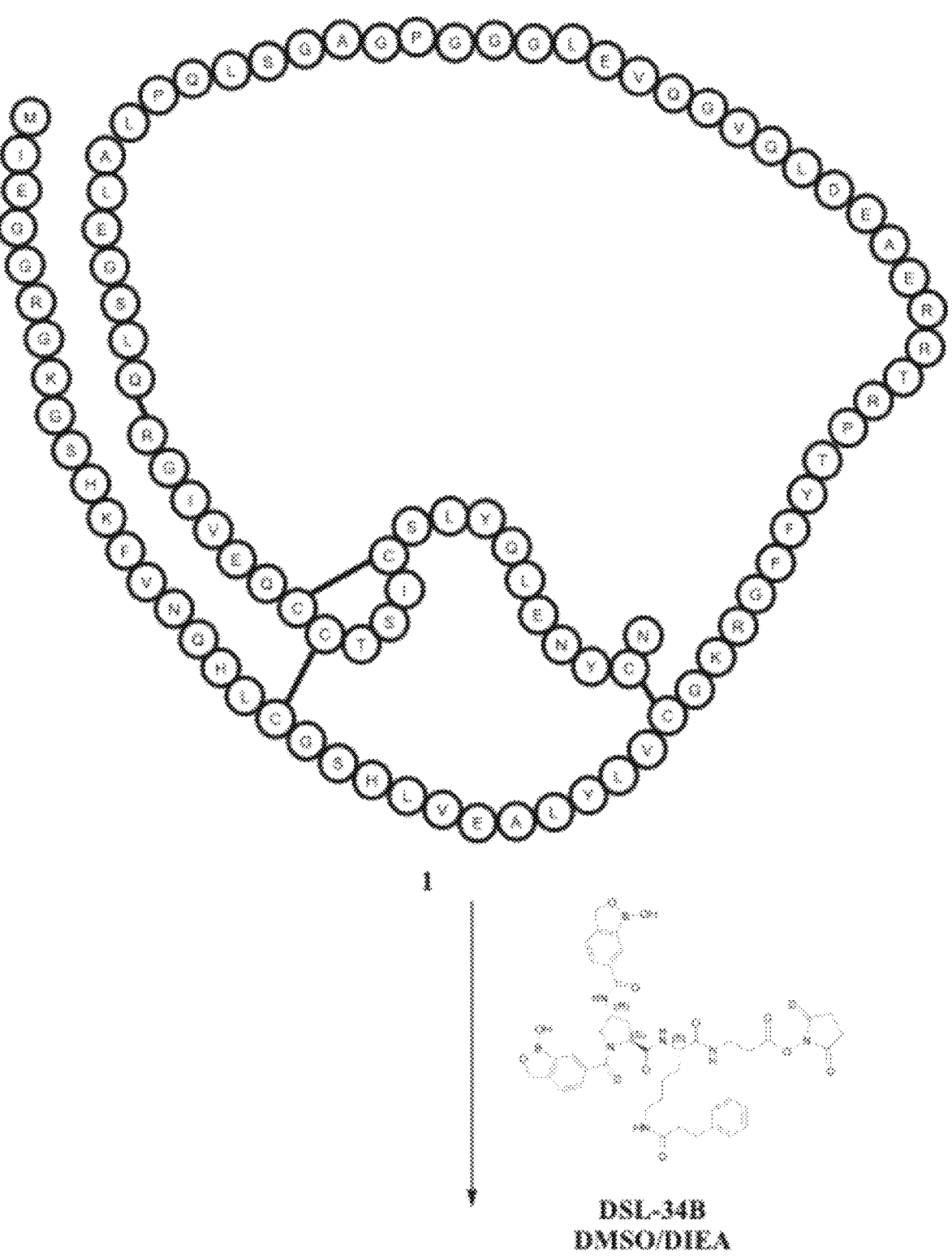
Figure 10B:
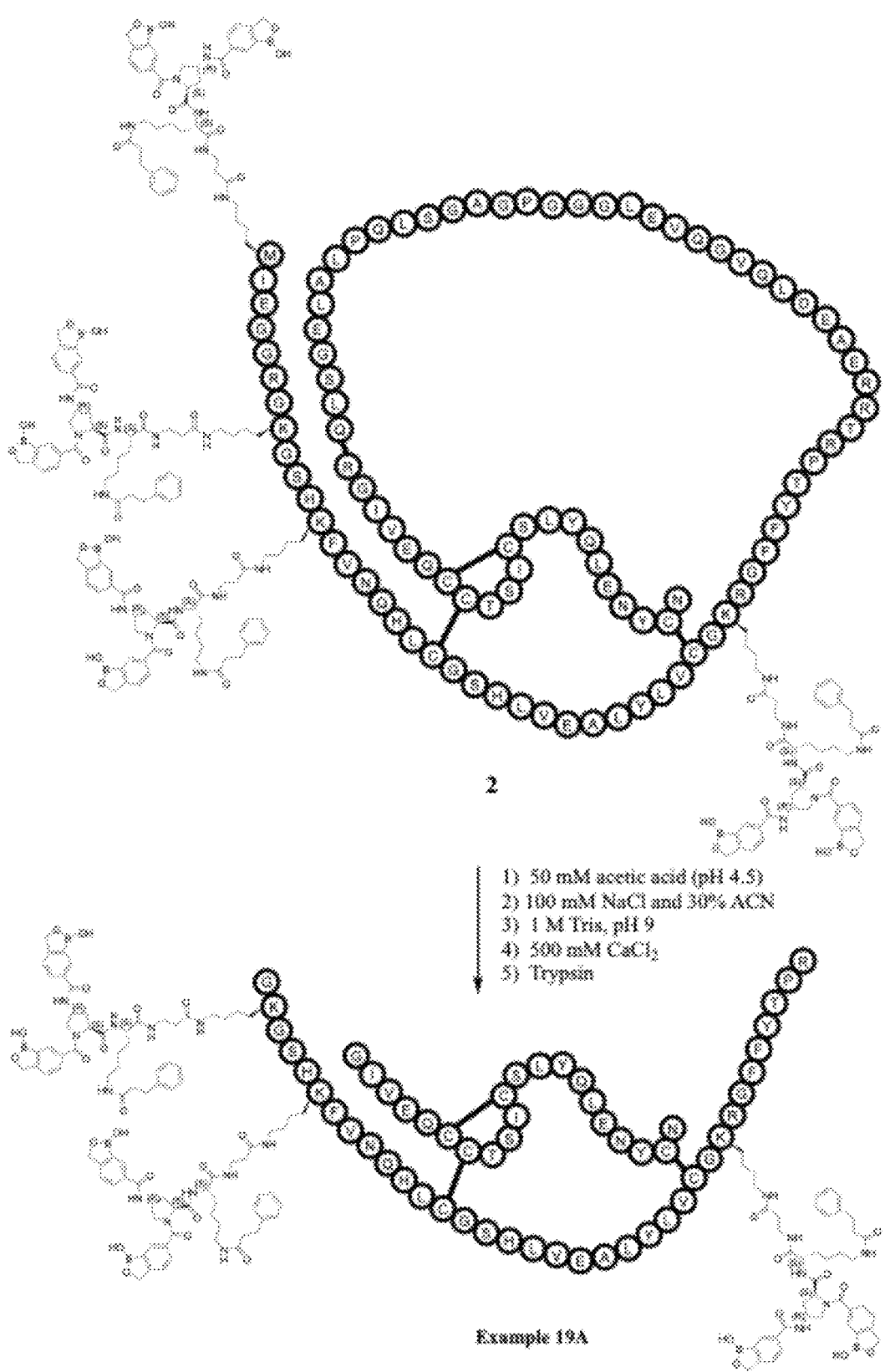

To a solution of single-chain proinsulin 1 (SEQ ID NO:24071) (20 mg) in DMSO (200 uL) was added 2,5-dioxopyrrolidin-1-yl 3-((S)-2-((2S,4R)-1-(1-hydroxy-1,3- dihydrobenzo[c][1,2]oxaborole-6-carbonyl)-4-(1-hydroxy-1,3-dihydrobenzo[c][1,2]oxaborole-6-carboxamido) pyrrolidine-2-carboxamido)-6-(3-phenylpropanamido) hexanamido)propanoate (DSL-34B, 9.2 mg) in DMSO (200 uL) and diisopropylethylamine (DIPEA, 20 uL) (FIG. 10A). The reaction was stirred at room temperature for 1 hr. Trifluoroacetic acid (TFA, 40 uL) was added to the reaction mixture to precipitate the proinsulin conjugate intermediate 2 (SEQ ID NO:24072) (FIG. 10B). Reaction mixture was centrifuged (11000 RPM, 5 min), decanted, and supernatant was resuspended in 100 uL solution of 50 mM acetic acid (pH 4.5), 100 mM NaCl and 30% ACN. Solution was diluted with 500 uL of water then 30 uL of 1M Tris pH 9 (50 mM final concentration), 6 uL of 500 mM CaCl$_2$) (5 mM final concentration) were added. The pH was adjusted with 0.5M NaOH (5-10 uL) to ~9-9.5 and trypsin (1:500 to 1:2000 trypsin mass to insulin mass ~10 uL of 0.2 ug/mL stock solution) was added. Crude solution was allowed to stir at r.t for 16 hours. The crude conjugated insulin conjugate was precipitated with TFA (~200 uL), centrifuged, decanted. Then crude precipitate was washed with water (2×500 uL) then dissolved in DMSO (100-200 uL), diluted with 20% ACN/Water (5-10 mL), and purified by reverse-phase HPLC. Fractions were collected, frozen, and lyophilized to yield a white powder (4-7 mg) of Example 19A (SEQ ID NO:24073 for the A-chain, SEQ ID NO:24075 for the B-chain) (FIG. 10B).

Examples IA, 4A, 6A-10A, 13A, 14A, 18A, 19A, 23, 25A, 26A, 28A, 30A, 32A-36A, 44A, 45A, 47A, 67A, 73A, 76A-82A, 84A, and 85A were synthesized under similar conditions.

| Example | Mass Expected (whole mass) | Mass Calculated [M + 5H − 5H$_2$O]$^{5+}$ | Mass Observed [M + 5H − 5H$_2$O]$^{5+}$ | Mass Calculated [M + 6H − 5H$_2$O]$^{6+}$ | Mass Observed [M + 6H − 5H$_2$O]$^{6+}$ |
|---|---|---|---|---|---|
| Example 1A | 8613.9331 | 1705.7866 | 1705.5606 | 1421.6555 | 1421.4915 |
| Example 4A | 8740.0719 | 1731.0144 | 1730.8393 | 1442.6787 | 1442.5644 |
| Example 6A | 9153.7526 | 1813.7505 | 1813.7420 | 1511.6254 | 1511.5718 |
| Example 7A | 7923.6145 | 1567.7229 | 1567.6899 | 1306.6024 | 1306.4176 |
| Example 8A | 8782.1189 | 1739.4238 | 1739.1836 | 1449.6865 | 1449.4731 |
| Example 9A | 8817.8932 | 1746.5786 | 1746.4686 | 1454.8155 | 1454.6752 |
| Example 10A | 8001.6615 | 1583.3323 | 1583.1050 | 1319.6102 | 1319.4272 |
| Example 13A | 8697.9158 | 1722.5862 | 1722.4869 | 1435.6526 | 1435.5521 |
| Example 14A | 7965.6615 | 1576.1323 | 1576.1914 | 1313.6102 | 1313.6601 |
| Example 18A | 8313.8493 | 1645.7699 | 1645.5378 | 1371.6416 | 1371.2578 |
| Example 19A | 8613.9311 | 1705.7862 | 1705.7672 | 1421.6552 | 1422.1946 |
| Example 23A | 8721.8746 | 1727.3749 | 1727.4543 | 1439.6458 | 1439.5606 |
| Example 25A | 8782.1189 | 1739.4238 | 1739.3922 | 1449.6865 | 1449.5164 |
| Example 26A | 8770.0884 | 1737.0176 | 1737.0506 | 1447.6814 | 1447.5519 |
| Example 28A | 8854.18 | 1753.8360 | 1753.5987 | 1461.6967 | 1461.5313 |
| Example 30A | 8938.2762 | 1770.6552 | 1770.4166 | 1475.7127 | 1475.5168 |
| Example 32A | 8601.9006 | 1703.3801 | 1703.5236 | 1419.6501 | 1419.6037 |
| Example 33A | 8938.2762 | 1770.6552 | 1770.7111 | 1475.7127 | 1475.7613 |
| Example 34A | 8685.9945 | 1720.1989 | 1720.3890 | 1433.6657 | 1433.8151 |
| Example 35A | 9022.3701 | 1787.4740 | 1787.5328 | 1489.7283 | 1489.7827 |
| Example 36A | 8770.0884 | 1737.0176 | 1737.1763 | 1447.6814 | 1447.6647 |
| Example 44A | 8764.2597 | 1735.8519 | 1735.8280 | 1446.7099 | 1446.6923 |
| Example 45A | 8680.1658 | 1719.0331 | 1719.2042 | 1432.6943 | 1432.4948 |
| Example 47A | 8764.2597 | 1735.8519 | 1735.6199 | 1446.7099 | 1446.4966 |

-continued

| Example | Mass Expected (whole mass) | Mass Calculated $[M + 5H - 5H_2O]^{5+}$ | Mass Observed $[M + 5H - 5H_2O]^{5+}$ | Mass Calculated $[M + 6H - 5H_2O]^{6+}$ | Mass Observed $[M + 6H - 5H_2O]^{6+}$ |
|---|---|---|---|---|---|
| Example 49A | 8848.3536 | 1752.6707 | 1752.6371 | 1460.7256 | 1460.6795 |
| Example 67A | 9082.2762 | 1799.4552 | 1799.2259 | 1499.7127 | 1499.5198 |
| Example 73A | 8956 | 1774.20 | 1773.98 | 1475.66 | 1475.48 |
| | | | | $[M + 6H - 6H_2O]^{6+}$ | |
| Example 76A | 8914.0884 | 1765.8177 | 1765.5883 | 1471.6814 | 1471.5017 |
| Example 77A | 8829.9445 | 1748.9889 | 1748.7934 | 1457.6574 | 1457.4832 |
| Example 78A | 8829.9445 | 1748.9889 | 1748.7364 | 1457.6574 | 1457.5006 |
| Example 79A | 9127.1997 | 1808.4399 | 1808.2167 | 1507.1999 | 1507.1909 |
| Example 80A | 8698.0250 | 1722.6050 | 1722.5434 | 1435.6708 | 1435.6550 |
| Example 81A | 9217.3406 | 1826.4621 | 1826.4406 | 1522.2234 | 1522.0216 |
| Example 82A | 8745.9006 | 1732.1801 | 1731.9653 | 1443.6501 | 1443.4628 |
| Example 84A | 9127.1997 | 1294.5999 | 1295.09 | 1510.1999 | 1510.4 |
| | | | $[M + 7H - 4H_2O]^{7+}$ | | $[M + 6H - 4H_2O]^{6+}$ |
| Example 85A | 8956.1353 | 1774.2270 | 1774.2454 | 1478.6892 | 1478.6870 |

G. Testing of Compounds for Activity in Biological Assays

Exemplary compounds (e.g. diboronated sensors) of the present disclosure can be tested using an alizarin red S (ARS) displacement assay.

G.1 Procedure for Determination of the Glucose, Fructose, and Lactate Binding (Kd) Using ARS Displacement Assay The association constant for the binding event between Alizarin Red S (ARS) and the exemplary compounds can be determined using standard methods in the art. Triplicate titrations of $10^{-5}$ M ARS in 0.1 M phosphate buffer, pH 7.4, is performed in a 96-well plate against serial dilutions of example compounds, ranging in concentration from 0-0.1M at 25° C. The example compound-ARS solution is incubated for 5-45 minutes at 25° C., and fluorescence intensity is measured using excitation wavelength 468 nm and emission wavelength 585 nm. Changes in intensity is plotted against the concentration of the example compound, and the intensity data is fitted to yield an association constant for ARS binding.

The association constant for the binding between a target sugar compound (e.g., glucose) and the aromatic boron-containing groups (DSL compounds) is determined via the displacement of ARS bound to the example compounds. Triplicate wells of $10^{-5}$ M ARS and 0.1 M example compounds in 0.1 M phosphate buffer, pH 7.4, is titrated in a 96-well plate against serial dilutions of the target sugar compound, ranging in concentration from 0-2.0 M at 25° C. The boron-ARS-carbohydrate solution is incubated for 30-60 minutes at 25° C. and the intensity of each well is measured in a plate reader at excitation wavelength 468 nm and emission wavelength 585 nm.

Changes in intensity are plotted against concentration of the target sugar compound, and the data is fitted to a one-site competition equation:

$$y = \min(y) + (\max(y) - \min(y))/(1 + 10^{x - logEC50})$$

to yield an association constant for the boron compound-target sugar compound binding event.

The binding constants of DSL compounds, such as DSL-1A to DSL-172A, to glucose, fructose, and/or lactate can be tested and calculated.

G.2 In Vitro Demonstration of Activity for Compounds of Formula IB

Chinese hamster ovary (CHO) cells constitutively expressing Human Insulin Receptor Isoform β were seeded in a 96-well tissue culture microplate at 35,000 cells/well and grown overnight in Roswell Park Memorial Institute (RPMI) 1640 media supplemented with Glutamine and 10% Fetal Bovine Serum (growth media). The next morning, growth media was replaced with fresh growth media.

A separate microplate of spiking media was prepared with a stepwise serial dilution of compounds of Formula IB in Dulbecco's Modified Eagle Medium (DMEM) media (without glucose, without phenol red, with 4% w/v serum albumin). Wells of serially diluted compounds of Formula IB were prepared in triplicate with an appropriate "high" (e.g., 20 mM) and "low" (e.g., 3 mM) concentration of glucose to determine change in potency of compounds of Formula IB at various potential blood glucose levels. Wild type insulin served as a positive control and media without any compounds served as a negative control.

Growth media on cells in the 96-well tissue culture microplate was then replaced with DMEM media (without glucose, without phenol red) and the plate was allowed to sit for 5 minutes at 37° C. The media was aspirated and replaced with the contents of the separate prepared plate (spiking media) for 10 minutes at 37° C. After 10 minutes, the spiking media was aspirated and the cells were fixed with 10% neutral buffered formalin for 10 minutes at room temperature. The neutral buffered formalin was then aspirated, and the microplate was stringently washed with PBS, pH 7.4. The microplate was then permeabilized and blocked with PBS, pH 7.4 supplemented with 10% v/v Fetal Bovine Serum and 0.1% Triton X-100 for 30 minutes. The plate was then stained at 4° C. overnight with 5% FBS in PBS+1:680 ratio (v:v) of Rabbit (Rb) α-phospho-Y1150/Y1151 IR antibody (Cell Signaling Technologies #3024). After overnight incubation followed by stringent washes with PBS, pH 7.4, the microplate was incubated at 37° C. in 5% FBS in PBS+1:1000 ratio (v/v) of HRP α-Rabbit antibody (Cell Signaling Technologies, #7074) for 100 minutes. The plate was stringently washed with PBS, pH 7.4, and colorimetric readout was developed for 15 minutes at 37° C. using TMB substrate. Color development was stopped with the addition of 0.1 M hydrochloric acid and absorbance measured at 450 nm. Triplicate absorbance values were plotted in GraphPad Prism and analyzed using a four-parameter logistic regression to generate dose-response curves. The EC50 of the dose-response curves were compared to assess fold activation of the exemplary compounds of Formula IB from low to high glucose concentration. The ratio of EC50 values for GSI at high and low glucose concentrations were taken to calculate fold-change in insulin activity. The EC50 was calculated using the following equation:

$$Y=\text{Bottom}+(X\hat{}\,\text{Hillslope})*(\text{Top}-\text{Bottom})/$$
$$(X\hat{}\,\text{HillSlope}+\text{EC50}\hat{}\,\text{HillSlope}).$$

Some examples disclosed herein have an insulin receptor phosphorylation (IR Phosphorylation) (fold change) ranging from ≥1.2 to 20. Some examples disclosed herein had an insulin receptor phosphorylation (IR Phosphorylation) (fold change) ranging from ≥1.2 to 14.

G.3 In Vivo Demonstration of Activity for Compounds of Formula I

Male Sprague-Dawley rats underwent surgical cannulation of a carotid artery and jugular vein for blood sampling and infusions and were allowed to recover for one week. Cannulated rats were treated with streptozotocin (STZ, 55 mg/kg, 7 days) to induce a diabetic state (blood glucose concentration >300 mg/dL). Diabetic rats were fasted overnight, then placed in a solo experimental chamber and connected to sampling/infusion lines. Prior to injection of insulin examples, glucose was infused to raise the blood glucose level (BG) or phloridzin is used to lower the BG of each rat to achieve a cohort of rats in a hyperglycemic state (200 mg/dL, N=6-8) or euglycemic state (100 mg/dL, N=6-8). Blood glucose and the glucose infusion rate (GIR) required to maintain clamped BG were measured every 5 minutes and the GIR was adjusted to maintain the desired BG level. Somatostatin (5 ug/kg/min) was continuously infused throughout the study beginning with the administration of phloridzin or glucose. At time 0 min, a bolus dose (1 nmol/kg to 60 nmol/kg) of a compound of Formula IB was infused over a 10 second period, and glucose was continuously infused at variable rates to maintain the hyperglycemia (200 mg/dL) or euglycemia steady state (100 mg/dL) for 300 minutes. The total area-under-the-curve (AUC) value of total glucose infusion post-compound injection until the GIR returned to its pre-compound injection value or 300 minutes was achieved was calculated for both hyperglycemic (200 mg/dL) and euglycemic (100 mg/dL) levels. Area under the curve (AUC) was calculated using the trapezoid rule and with baseline correction applied. Averaged GIR values from 30 minutes prior to injections to the injections were subtracted from each GIR value from time 0 to time 600 min for baseline correction. The trapezoidal calculation is as follows:

$$\int_a^b f(x)dx \approx (b-a)\cdot\frac{1}{2}(f(a)+f(b)).$$

Where a is the first time point (0 min) and b is the last time point (300 min). The area was calculated as a subdivision of small trapezoids as follows:

$$\int_a^b f(x)dx \approx$$
$$\frac{\Delta x}{2}(f(x_0)+2f(x_1)+2f(x_2)+2f(x_3)+2f(x_4)+\cdots+2f(x_{N-1})+x(f_N)).$$

Such that $\Delta x$ is the difference between each time point.

Compounds of Formula IB require greater GIR and total glucose infusion AUC to maintain clamped hyperglycemic BG than euglycemic BG, demonstrating a glucose-responsive increase in compound glucose-lowering action at increased BG. Compounds exhibited AUC values ranging from 250 to-5100 under hyperglycemic conditions and 200-to-4600 under euglycemic levels. The ratio of hyperglycemic AUC to euglycemic AUC ranged from 0.1-to-3.3 in 200 mg/dL to 100 mg/dL.

G.4 Pharmacokinetics for Compounds of Formula I

Pharmacokinetic (PK) properties of examples disclosed herein were also characterized following injection of insulin examples in euglycemic-treated rats as described above. Data was generated using the Meso Scale Discovery (MSD) ruthenium based electrochemiluminescence assay. Blood samples were taken at 0 min, 1 min, 5 min, 10 min, 15 min, 30 min, 60 min, 90 min, 120 min, 150 min, 180 min, 210 min, 240 min, 270 min, and 300 min for euglycemic experiments. Clearance values (CL), terminal half-life (t1/2), and apparent volume of distribution at steady state (Vss) were determined using non-compartmental analysis (NCA). See, e.g., Kittrell H C, et al. Pharmacokinetics of Intravenous, Intramuscular, Oral, and Transdermal Administration of Flunixin Meglumine in Pre-wean Piglets. *Front Vet Sci.* 2020 (using PKanalix (Monolix Suite 2019R2, Lixoft, France)); Nnane et al. Non-Clinical Pharmacokinetics, Prediction of Human Pharmacokinetics and First-in-Human Dose Selection for CNTO 5825, an Anti-Interleukin-13 Monoclonal Antibody, *Basic & Clinical Pharmacology & Toxicology,* 2015, 117, 219-225 (using a non-compartmental analysis module in WinNonlin (version 5.2.1) (Pharsight, Mountain View, CA, USA) to calculate PK parameters).

Generally, NCA will determine the following directly from the data:

Cmax—Maximum observed concentration (units=concentration)

Tmax—The time where the maximum concentration was observed (units=time)

AUC—The area under the curve (units=time×concentration)

AUMC—The area under the first moment curve (units=time$^2$×concentration)

Each sampling interval is a trapezoid and the area of each can be calculated and added up for all of the n samples:

$$AUC = \int_0^{t_f} Cdt \approx \sum_{i=1}^{n-1}\frac{C_i+C_{i+1}}{2}\times(t_{i+1}-t_i)$$

$$AUMC = \int_0^{t_f} t\times Cdt \approx \sum_{i=1}^{n-1}\frac{t_iC_i+t_{i+1}C_{i+1}}{2}\times(t_{i+1}-t_i)$$

The CL, Vss, and terminal half-life can be calculated as follows:

Clearance: CL=Dose/AUC

Mean residence time: MRT=AUMC/AUC

Apparent volume of distribution at steady state: Vss=MRT×CL

Half-life: Terminal slope of the natural log of the data

Properties like AUC and AUMC can also be calculated using extrapolation from the last time point to infinity to account for data beyond the observations at hand.

The subsequent values of clearance, volumes of distribution, etc. can also change with extrapolation.

Some examples disclosed herein exhibited (a) CL values ranging from about 0.13 ml/min/kg to about 2.4 ml/min/kg; (b) terminal half-life ranging from at least about 100 minutes, for example 100 minutes to about 260 minutes; and (c) Vss values ranging from about 18 mL/kg to about 123 mL/kg. The data supports an extended duration of bioavailability for compounds disclosed herein.

It is also observed in cell-based experiments on compounds containing formulae FF116, and FF116A-D that sensors with geminal alkyl substituent on the same carbon as the nitrogen conjugated to the boroxole or boronates provided between 5-56% higher glucose responsiveness in the range of 3-20 mM glucose in comparison to variants that do not have the geminal alkyl substituents. For example, when a Z1C represented by one of formulae FF12, FF12A-D, FF116, FF116A-D is conjugated to lysine residues in insulin wherein the boronates (B1, B2) in formulae FF12, FF12A-D, FF116, and FF116A-D are represented by F2, the resulting insulin is observed to be between 11-56% more responsive to changes in glucose levels between 3-20 mM glucose than if instead of one of the formulae FF12, FF12A-D, FF116, and FF116A-D one uses 2,3-diaminopropionic acid. This data shows that the presence of the geminal alkyl substituent on the same carbon as the nitrogen conjugated to the boroxole or boronates improves glucose responsiveness of the resulting insulin conjugate, and in tested variations in the 3-20 mM glucose range.

In some embodiments, it is believed that this general principle extends to other formulae FF12, FF12A-D, FF114, FF115, FF116, FF116A-D, FF117, FF193, and FF203 providing a framework for enhancement of glucose responsiveness by at least 5%, at least 10%, at least 20%, or at least 40% in the 3-20 mM or 2-50 mM glucose ranges.

In some embodiments, the presence of the carbonyl group adjacent to- or within less than two carbon centers away from the amine groups in FF formulae (to which aromatic boron-containing groups are conjugated) may enhance glucose responsiveness through impacting ability to turn off activity of drug substance through plasma protein interactions such as with albumin and that this is independent of glucose affinity such that glucose affinity is not impacted by the position of this carbonyl group.

In further embodiments, the pharmacokinetics of the molecules and potential albumin or blood proteins binding may be impacted by the position of this carbonyl group, and thereby enhance overall glucose responsiveness whilst the absolute glucose affinity is maintained or nearly identical. Therefore, in certain embodiments of the present disclosure, the carbonyl group (as part of an acid, amid or linkage to X in FF formulae) is placed within less than three, or within less than two-carbon centers away from one of the two amines to which the boron-containing compounds are conjugated. In certain embodiments, the placement of amines within two carbon centers from each other enables the spatial and geometric constraining of the aromatic boron-containing groups to enhance glucose binding and selectively, and furthermore the presence of a carbonyl group (for example, as part of an amide linkage) which is within less than two carbon centers, from one of the two amines (to which aromatic boron-containing groups are attached) ensures differential albumin binding in a manner that results in the compound exhibiting glucose responsiveness in the blood and in the body. In some embodiments, the combination of geometrical constraining of the two amines to which the aromatic boron-containing groups are conjugated, as well as the presence of the carbonyl within one to two carbon centers from one of the amines provides the necessary requirements for glucose responsiveness in physiological blood and plasma glucose levels.

In some embodiments, the interaction of the linker with the Z1c may help further enhance glucose responsiveness. For example, enhanced glucose responsiveness may result in some embodiments where Z1c is selected from FF12, FF12A-D, FF116, FF116A-D, B1 and B2 are represented by F2 or F7, wherein each of the remaining R1 is H, and wherein the linker is selected from a relatively hydrophobic amino acid or contains a relatively hydrophobic molecule (e.g., linker) selected from FL3, FL65A, FL65B, FL69, FL69A, FL69B, FL70, FL70A, and FL70B. For example, enhanced glucose responsiveness may result in some embodiments where Z1c is selected from FF12, FF12A-D, FF116, FF116A-D, B1 and B2 are represented by F2 or F7, wherein one of the remaining R1 is $CF_3$ and the remaining R1 is H, and wherein the linker is selected from a hydrophilic amino acid or contains a hydrophilic molecule (e.g., linker) selected from FL5, FL5A, and FL5B.

In some embodiments, glucose responsiveness at physiological ranges of 3-10 mM, 4-10 mM, 3-20 mM or 4-20 mM glucose is further enhanced either by (i) a combination of a relatively hydrophobic linker (e.g., FL3, FL65A, FL65B, FL69, FL69A, FL69B, FL70, FL70A, and FL70B) and a Z1c in which both B1 and B2 are selected from F2 or F7, wherein all remaining R1 are H, or (ii) a combination of a relatively hydrophilic linker (e.g., FL5, FL5A, FL5B) and a Z1c in which both B1 and B2 are selected from F2 or F7, wherein one of the remaining R1 is CF3.

In some embodiments, glucose responsiveness of an insulin at physiological ranges of 3-10 mM, 4-10 mM, 3-20 mM or 4-20 mM glucose is further enhanced either by (i) a combination of a relatively hydrophobic linker and a Z1c in which both B1 and B2 are selected from F2, wherein all remaining R1 are H, wherein at least three or at least four lysine residues in the insulin are conjugated to a Z1c or (ii) a combination of a relatively hydrophilic linker and a Z1c in which both B1 and B2 are selected from F2, wherein one of the remaining R1 is CF3, and wherein at least two or at least three lysine residues in the insulin are conjugated to a Z1c.

In some embodiments, glucose responsiveness of an insulin at physiological ranges of 3-10 mM, 4-10 mM, 3-20 mM or 4-20 mM glucose is further enhanced either by (i) a combination of a relatively hydrophobic linker and a Z1c in which both B1 and B2 are selected from F7, wherein all remaining R1 are H, wherein at least three or at least four lysine residues in the insulin are conjugated to a Z1c or (ii) a combination of a relatively hydrophilic linker and a Z1c in which both B1 and B2 are selected from F7, wherein one of the remaining R1 is CF3, and wherein at least two or at least three lysine residues in the insulin are conjugated to a Z1c.

In some embodiments, glucose responsiveness is enhanced through selection of combination of the linker and Z1c is selected from (i) a combination of a relatively hydrophobic linker and a Z1c in which both B1 and B2 are selected from F2, wherein all remaining R1 are H, or (ii) a combination of a relatively hydrophilic linker and a Z1c in which both B1 and B2 are selected from F2, wherein one of the remaining R1 is CF3 and the remaining R1 is H.

In some embodiments, glucose responsiveness is enhanced through selection of combination of the linker and Z1c is selected from (i) a combination of a relatively hydrophobic linker and a Z1c in which both B1 and B2 are selected from F2, wherein all remaining R1 are H, or (ii) a combination of a relatively hydrophilic linker and a Z1c in which both B1 and B2 are selected from F2, wherein one of the remaining R1 is CF3 and the remaining R1 is H.

In some embodiments, glucose responsiveness is enhanced through selection of combination of the linker and Z1c is selected from (i) a combination of a relatively hydrophobic linker and a Z1C selected from FF12, FF12A-D, FF116, FF116A-D, in which both B1 and B2 are selected from F2, wherein all remaining $R_1$ are H, or (ii) a combination of a relatively hydrophilic linker and a Z1c selected from FF12, FF12A-D, FF116, FF116A-D, in which both B1 and B2 are selected from F2, wherein one of the remaining $R_1$ is $CF_3$ and the remaining $R_1$ is H.

Experiments on cell-based assays of insulins with lysine residues conjugated with one of formulae FF12, FF12A-D, FF114, FF115, FF116, FF116A-D, FF117, FF193, and FF203, demonstrated that the enhanced glucose responsiveness of the insulins is increased when one or more lysine residues are modified as described by Formula IB using one of formulae FF12, FF12A-D, FF114, FF115, FF116, FF116A-D, FF117, FF193, and FF203, and wherein the lysine residues are present in insulin (as insertions or mutations) or in a polypeptide that is appended to the N- or C-terminus of the B-chain of insulin or the C-terminus of the A-chain of insulin, and wherein there are additional lysine residues within the insulin sequence that are similarly modified. The results are further corroborated by testing of the compounds of Formula IB in STZ diabetic mouse models wherein the activity of the insulin is measured through bolus injections of the compounds of Formula IB followed by glucose challenges and measurements of blood glucose, or through glucose clamp assays in which activity of the insulins is measured as a function of blood glucose levels. The results further showed that exemplary compounds of Formula IB disclosed herein function in the body and are responsive to physiological changes in blood glucose and provide dynamic insulin action in the body in response to changes in blood glucose levels. In certain embodiments one or more lysine residues near the N-terminus of a polypeptide appended to the N-terminus of the B-chain of insulin, as well as at least one additional lysine in the B-chain of insulin are conjugated as described by Formula I.

Sequences

In certain embodiments, a sequence is appended to the N-terminus and/or C-terminus, and/or inserted into the sequence of the A-chain of insulin, wherein the A-chain of insulin comprises one of the following sequences, optionally with up to four additional deletions and/or mutations:

```
                            (SEQ ID NO: 1)
GIVEQCCTSICSLYQLENYCN;

(SEQ ID NO: 3)
GIVKQCCTSICSLYQLENYCN;

(SEQ ID NO: 4)
GIVEQCCHSICSLYQLENYCN;

(SEQ ID NO: 5)
GIVEQCCASICSLYQLENYCN;

(SEQ ID NO: 6)
GIVEQCCTRICSLYQLENYCN;

(SEQ ID NO: 7)
GIVEQCCTKICSLYQLENYCN;

(SEQ ID NO: 8)
GIVEQCCTSICSEYQENYCN;
```

-continued

```
                            (SEQ ID NO: 9)
GIVKQCCTSICSLYQLENYCG;

(SEQ ID NO: 10)
GIVEQCCHSICSLYQLENYCG;

(SEQ ID NO: 11)
GIVEQCCASICSLYQLENYCG;

(SEQ ID NO: 12)
GIVEQCCTRICSLYQLENYCG;

(SEQ ID NO: 13)
GIVEQCCTKICSLYQLENYCG;

(SEQ ID NO: 14)
GIVEQCCTSICSEYQENYCG;

(SEQ ID NO: 15)
GIVEQCCTSICSEYQENYC;

(SEQ ID NO: 16)
GIVEQCCTSICSLYQLENYCNK;

(SEQ ID NO: 17)
KPGIVEQCCTSICSLYQLENYCN;

(SEQ ID NO: 18)
KPIVEQCCTSICSLYQLENYCN;

(SEQ ID NO: 19)
KPVEQCCTSICSLYQLENYCN;

(SEQ ID NO: 20)
KPGVEQCCTSICSLYQLENYCN;

(SEQ ID NO: 21)
GEKPVEQCCTSICSLYQLENYCN;

(SEQ ID NO: 22)
KPGEKPVEQCCTSICSLYQLENYCN;

(SEQ ID NO: 23)
KPVEQCCTSICSLYQLENYCNK;

(SEQ ID NO: 24)
KPVEQCCTSICSLYQLENYCNEKP;

(SEQ ID NO: 25)
GIVEQCCTSICSLYQLENYCGK;

(SEQ ID NO: 26)
KPGIVEQCCTSICSLYQLENYCG;

(SEQ ID NO: 27)
KPIVEQCCTSICSLYQLENYCG;

(SEQ ID NO: 28)
KPVEQCCTSICSLYQLENYCG;

(SEQ ID NO: 29)
KPGVEQCCTSICSLYQLENYCG;

(SEQ ID NO: 30)
GEKPVEQCCTSICSLYQLENYCG;

(SEQ ID NO: 31)
KPGEKPVEQCCTSICSLYQLENYCG;

(SEQ ID NO: 32)
KPVEQCCTSICSLYQLENYCGK;

(SEQ ID NO: 33)
KPVEQCCTSICSLYQLENYCGEKP;
```

-continued

```
                              (SEQ ID NO: 24051)
GIVEQCCTSICSLYQLENYCG;
and (SEQ ID NO: 24052)
GIVEQCCTSICSLEQLENYCG;
``` and/or a sequence is appended to the N-terminus and/or C-terminus, and/or inserted into the sequence of the B-chain of insulin, wherein the B-chain of insulin comprises one of following sequences, and optionally with up to four additional deletions and/or mutations:

```
                              (SEQ  ID NO: 2)
FVNQHLCGSHLVEALYLVCGERGFFYTPKT;

(SEQ  ID NO: 34)
FVNQHLCGSHLVEALYLVCGERGFFYTP;

(SEQ  ID NO: 35)
FVNQHLCGSHLVEALYLVCGKRGFFYTP;

(SEQ  ID NO: 36)
FVNQHLCGSHLVEALYLVCGKRGFFYTPRT;

(SEQ  ID NO: 37)
FVNQHLCGSHLVEALYLVCGKRGFFYT;

(SEQ  ID NO: 38)
VNQHLCGSHLVEALYLVCGERGFFYTPKT;

(SEQ  ID NO: 39)
NQHLCGSHLVEALYLVCGERGFFYTPKT;

(SEQ  ID NO: 40)
QHLCGSHLVEALYLVCGERGFFYTPKT;

(SEQ  ID NO: 41)
PFVNQHLCGSHLVEALYLVCGERGFFYTPKT;

(SEQ  ID NO: 42)
PFVNQHLCGSHLVEALYLVCGKRGFFYTPRT;

(SEQ  ID NO: 43)
PFVNQHLCGSHLVEALYLVCGKEGFFYTPRT;

(SEQ  ID NO: 44)
PFVNQHLCGSHLVEALYLVCGKRGFFYTPR;

(SEQ  ID NO: 45)
PFVNQHLCGSHLVEALYLVCGKRGFFYTRPT;

(SEQ  ID NO: 46)
PFVNQHLCGSHLVEALYLVCGKRGFFYTRP;

(SEQ  ID NO: 47)
PFVNQHLCGSHLVEALYLVCGKNGFFYTPRT;

(SEQ  ID NO: 48)
PFVNQHLCGSHLVEALYLVCGKNGFFYTPRT;

(SEQ  ID NO: 49)
PFVNQHLCGSHLVEALYLVCGKNGFFYTPR;

(SEQ  ID NO: 50)
PFVNQHLCGSHLVEALYLVCGKNGFFYTRPT;

(SEQ  ID NO: 51)
PFVNQHLCGSHLVEALYLVCGKNGFFYTRP;

(SEQ  ID NO: 52)
PFVNQHLCGSHLVEALYLVCGKEGFFYTPRT;

(SEQ  ID NO: 53)
PFVNQHLCGSHLVEALYLVCGKEGFFYTPRT;

(SEQ  ID NO: 54)
PFVNQHLCGSHLVEALYLVCGKEGFFYTPR;

(SEQ  ID NO: 55)
PFVNQHLCGSHLVEALYLVCGKEGFFYTRPT;

(SEQ  ID NO: 56)
PFVNQHLCGSHLVEALYLVCGKEGFFYTRP;
```

-continued (SEQ  ID NO: 57)
PFVNQHLCGSHLVEALYLVCGKRGFFYTPR;

(SEQ  ID NO: 58)
PVNQHLCGSHLVEALYLVCGERGFFYTPKT;

(SEQ  ID NO: 59)
PVNQHLCGSHLVEALYLVCGKRGFFYTPRT;

(SEQ  ID NO: 60)
PVNQHLCGSHLVEALYLVCGKRGFFYTPR;

(SEQ  ID NO: 61)
PNQHLCGSHLVEALYLVCGERGFFYTPKT;

(SEQ  ID NO: 62)
PNQHLCGSHLVEALYLVCGKRGFFYTPRT;

(SEQ  ID NO: 63)
PNQHLCGSHLVEALYLVCGKRGFFYTPR;

(SEQ  ID NO: 64)
PQHLCGSHLVEALYLVCGERGFFYTPKT;

(SEQ  ID NO: 65)
PQHLCGSHLVEALYLVCGKRGFFYTPRT;

(SEQ  ID NO: 66)
PQHLCGSHLVEALYLVCGKRGFFYTPR;

(SEQ  ID NO: 67)
PFVNQHLCGSHLVEALYLVCGERGFFYTKPT;

(SEQ  ID NO: 68)
PFVNQHLCGSHLVEALYLVCGERGFFYTKP;

(SEQ  ID NO: 69)
PVNQHLCGSHLVEALYLVCGERGFFYTKPT;

(SEQ  ID NO: 70)
PVNQHLCGSHLVEALYLVCGERGFFYTKP;

(SEQ  ID NO: 71)
PNQHLCQSHLVEALYLVCGERGFFYTKPT;

(SEQ  ID NO: 72)
PNQHLCGSHLVEALYLVCGERGFFYTKP;

(SEQ  ID NO: 73)
PQHLCGSHLVEALYLVCGERGFFYTKPT;

(SEQ  ID NO: 74)
FVNQHLCGSHLVEALYLVCGERGFFYTPK;

(SEQ  ID NO: 24047)
FVNQHLCGSHLVEALYLVCGKRGFFYTPKT;

(SEQ  ID NO: 24048)
FVNQHLCGSHLVEALYLVCGKRGFFYTPR;

(SEQ  ID NO: 24060)
KFVNQHLCGSHLVEALYLVCGKRGFFYTPKT;

(SEQ  ID NO: 24061)
KGSHFVNQHLCGSHLVEALYLVCGKRGFFYTPR;

(SEQ  ID NO: 24062)
KGSHQHLCGSHLVEALYLVCGKRGFFYTPR;

(SEQ  ID NO: 24063)
KQSHKQHLCGSHLVEALYLVCGKRGFFYTPR;

(SEQ  ID NO: 24064)
GKPGGGGSGGGGSGGGGSFVNQHLCGSHLVEALYLVCGDRGFFYTPK;

(SEQ  ID NO: 25000)
KFVNQHLCGSHLVEALYLVCGKRGFFYTRPT;

(SEQ  ID NO: 25001)
KFVGQHLCGSHLVEALYLVCGKRGFFYTRPT;

-continued

```
                                       (SEQ ID NO: 25002)
KHLCGSHLVEALYLVCGKRGFFYTRPT;

(SEQ ID NO: 25003)
KFVNQHLCGSHLVEALYLVCGKRGFFYTRP;

(SEQ ID NO: 25004)
KFVGQHLCGSHLVEALYLVCGKRGFFYTRP;

(SEQ ID NO: 25005)
KHLCGSHLVEALYLVCGKRGFFYTRP;

(SEQ ID NO: 25006)
KFVSQHLCGSHLVEALYLVCGKRGFFYTPR;

(SEQ ID NO: 25007)
KFVTQHLCGSHLVEALYLVCGKRGFFYTPR;

(SEQ ID NO: 25008)
KFVGQHLCGSHLVEALYLVCGKRGFFYTPR;

(SEQ ID NO: 25009)
KFVNQHLCGSHLVEALYLVCGKRGFFYTPR;

(SEQ ID NO: 25010)
KHLCGSHLVEALYLVCGKRGFFYTPR;

(SEQ ID NO: 25011)
KFVNQHLCGSHLVEALYLVCGERGFFYTKPT;

(SEQ ID NO: 25012)
KFVGQHLCGSHLVEALYLVCGERGFFYTKPT;

(SEQ ID NO: 25013)
KHLCGSHLVEALYLVCGERGFFYTKPT;

(SEQ ID NO: 25014)
KFVNQHLCGSHLVEALYLVCGERGFFYTKP;

(SEQ ID NO: 25015)
KFVGQHLCGSHLVEALYLVCGERGFFYTKP;

(SEQ ID NO: 25016)
KHLCGSHLVEALYLVCGERGFFYTKP;

(SEQ ID NO: 25017)
KFVSQHLCGSHLVEALYLVCGERGFFYTPK;

(SEQ ID NO: 25018)
KFVTQHLCGSHLVEALYLVCGERGFFYTPK;

(SEQ ID NO: 25019)
KFVGQHLCGSHLVEALYLVCGERGFFYTPK;

(SEQ ID NO: 25020)
KFVNQHLCGSHLVEALYLVCGERGFFYTPK;

(SEQ ID NO: 25021)
KHLCGSHLVEALYLVCGERGFFYTPK;

(SEQ ID NO: 25022)
KFVNQHLCGSHLVEALYLVCGDRGFFYTKPT;

(SEQ ID NO: 25023)
KFVGQHLCGSHLVEALYLVCGDRGFFYTKPT;

(SEQ ID NO: 25024)
KHLCGSHLVEALYLVCGDRGFFYTKPT;

(SEQ ID NO: 25025)
KFVNQHLCGSHLVEALYLVCGDRGFFYTKP;

(SEQ ID NO: 25026)
KFVGQHLCGSHLVEALYLVCGDRGFFYTKP;

(SEQ ID NO: 25027)
KHLCGSHLVEALYLVCGDRGFFYTKP;

(SEQ ID NO: 25028)
KFVSQHLCGSHLVEALYLVCGDRGFFYTPK;
```

-continued

KFVTQHLCGSHLVEALYLVCGDRGFFYTPK;

(SEQ ID NO: 25029)

KFVGQHLCGSHLVEALYLVCGDRGFFYTPK;

(SEQ ID NO: 25030)

KFVNQHLCGSHLVEALYLVCGDRGFFYTPK;

(SEQ ID NO: 25031)

KHLCGSHLVEALYLVCGDRGFFYTPK;

(SEQ ID NO: 25032)

KFVNQHLCGSHLVEALHLVCGKRGFFYTRPT;

(SEQ ID NO: 25033)

KFVGQHLCGSHLVEALHLVCGKRGFFYTRPT;

(SEQ ID NO: 25034)

KHLCGSHLVEALHLVCGKRGFFYTRPT;

(SEQ ID NO: 25035)

KFVNQHLCGSHLVEALHLVCGKRGFFYTRP;

(SEQ ID NO: 25036)

KFVGQHLCGSHLVEALHLVCGKRGFFYTRP;

(SEQ ID NO: 25037)

KHLCGSHLVEALHLVCGKRGFFYTRP;

(SEQ ID NO: 25038)

KFVSQHLCGSHLVEALHLVQGKRGFFYTPR;

(SEQ ID NO: 25039)

KFVTQHLCGSHLVEALHLVCGKRGFFYTPR;

(SEQ ID NO: 25040)

KFVGQHLCGSHLVEALHLVCGKRGFFYTPR;

(SEQ ID NO: 25041)

KFVNQHLCGSHLVEALHLVCGKRGFFYTPR;

(SEQ ID NO: 25042)

KHLCGSHLVEALHLVCGKRGFFYTPR;

(SEQ ID NO: 25043)

KFVGQHLCGSHLVEALHLVCGDRGFFYTKPT;

(SEQ ID NO: 25044)

KHLCGSHLVEALHLVCGDRGFFYTKPT;

(SEQ ID NO: 25045)

KFVNQHLCGSHLVEALHLVCGDRGFFYTKP;

(SEQ ID NO: 25046)

KFVGQHLCGSHLVEALHLVCGDRGFFYTKP;

(SEQ ID NO: 25047)

KHLCGSHLVEALHLVCGDRGFFYTKP;

(SEQ ID NO: 25048)

KFVSQHLCGSHLVEALHLVCGDRGFFYTPK;

(SEQ ID NO: 25049)

KFVTQHLCGSHLVEALHLVCGDRGFFYTPK;

(SEQ ID NO: 25050)

KFVGQHLCGSHLVEALHLVCGDRGFFYTPK;

(SEQ ID NO: 25051)

KFVNQHLCGSHLVEALHLVCGDRGFFYTPK;

(SEQ ID NO: 25052)

KHLCGSHLVEALHLVCGDRGFFYTPK;

(SEQ ID NO: 25053)

KFVNQHLCGSHLVEALHLVCGKRGFHYTRPT;

(SEQ ID NO: 25054)

KFVGQHLCGSHLVEALHLVCGKRGFHYTRPT;

(SEQ ID NO: 25055)

-continued

```
                                    (SEQ  ID NO: 25056)
KHLCGSHLVEALHLVCGKRGFHYTRPT;

(SEQ  ID) NO: 25057)
KFVNQHLCGSHLVEALHLVCGKRGFHYTRP;

(SEQ  ID NO: 25058)
KFVGQHLCGSHLVEALHLVCGKRGFHYTRP;

(SEQ  ID NO: 25059)
KHLCGSHLVEALHLVCGKRGFHYTRP;

(SEQ  ID NO: 25060)
KFVSQHLCGSHLVEALHLVCGKRGFHYTPR;

(SEQ  ID NO: 25061)
KFVTQHLCGSHLVEALHLVCGKRGFHYTPR;

(SEQ  ID NO: 25062)
KFVGQHLCGSHLVEALHLVCGKRGFHYTPR;

(SEQ  ID NO: 25063)
KFVNQHLCGSHLVEALHLVCGKRGFHYTPR;

(SEQ  ID NO: 25064)
KHLCGSHLVEALHLVCGKRGFHYTPR;

(SEQ  ID NO: 25065)
KFVNQHLCGSHLVEALHLVCGDRGFHYTKPT;

(SEQ  ID NO: 25066)
KFVGQHLCGSHLVEALHLVCGDRGFHYTKPT;

(SEQ  ID NO: 25067)
KHLCGSHLVEALHLVCGDRGFHYTKPT;

(SEQ  ID NO: 25068)
KFVNQHLCGSHLVEALHLVCGDRGFHYTKP;

(SEQ  ID NO: 25069)
KFVGQHLCGSHLVEALHLVCGDRGFHYTKP;

(SEQ  ID NO: 25070)
KHLCGSHLVEALHLVCGDRGFHYTKP;

(SEQ  ID NO: 25071)
KFVSQHLCGSHLVEALHLVCGDRGFHYTPK;

(SEQ  ID NO: 25072)
KFVTQHLCGSHLVEALHLVCGDRGFHYTPK;

(SEQ  ID NO: 25073)
KFVGQHLCQSHLVEALHLVCGDRGFHYTPK;

(SEQ  ID NO: 25074)
KFVNQHLCGSHLVEALHLVCGDRGFHYTPK;

(SEQ  ID NO: 25075)
KHLCGSHLVEALHLVCGDRGFHYTPK;

(SEQ  ID NO: 25076)
KGSHGGGGSGGGGSGGGGSFVNQHLCGSHLVEALYLVCGKRGFFYTRPT;

(SEQ  ID NO: 25077)
KGSHGGGGSGGGGSGGGGSFVGQHLCGSHLVEALYLVCGKRGFFYTRPT;

(SEQ  ID NO: 25078)
KGSHGGGGSGGGGSGGGGSHLCGSHLVEALYLVCGKRGFFYTRPT;

(SEQ  ID NO: 25079)
KGSHGGGGSGGGGSGGGGSFVNQHLCGSHLVEALYLVCGKRGFFYTRP;

(SEQ  ID NO: 25080)
KGSHGGGGSGGGGSGGGGSFVGQHLCGSHLVEALYLVCGKRGFFYTRP;

(SEQ  ID NO: 25081)
KGSHGGGGSGGGGSGGGGSHLCGSHLVEALYLVQGKRGFFYTRP;

(SEQ  ID NO: 25082)
KGSHGGGGSGGGGSGGGGSFVSQHLCGSHLVEALYLVCGKRGFFYTPR;
```

-continued

```
                                    (SEQ ID NO: 25083)
KGSHGGGGSGGGGSGGGGSFVTQHLCGSHLVEALYLVCGKRGFFYTPR;

(SEQ ID NO: 25084)
KGSHGGGGSGGGGSGGGGSFVGQHLCGSHLVEALYLVCGKRGFFYTPR;

(SEQ ID NO: 25085)
KGSHGGGGSGGGGSGGGGSFVNQHLCGSHLVEALYLVCGKRGFFYTPR;

(SEQ ID NO: 25086)
KGSHGGGGSGGGGSGGGGSHLCGSHLVEALYLVCGKRGFFYTPR;

(SEQ ID NO: 25087)
KGSHGGGGSGGGGSGGGGSFVNQHLCGSHLVEALYLVCGERGFFYTKPT;

(SEQ ID NO: 25088)
KGSHGGGGSGGGGSGGGGSFVGQHLCGSHLVEALYLVCGERGFFYTKPT;

(SEQ ID NO: 25089)
KGSHGGGGSGGGGSGGGGSHLCGSHLVEALYLVCGERGFFYTKPT;

(SEQ ID NO: 25090)
KGSHGGGGSGGGGSGGGGSFVNQHLCGSHLVEALYLVCGERGFFYTKP;

(SEQ ID NO: 25091)
KGSHGGGGSGGGGSGGGGSFVGQHLCGSHLVEALYLVCGERGFFYTKP;

(SEQ ID NO: 25092)
KGSHGGGGSGGGGSGGGGSHLCGSHLVEALYLVCGERGFFYTKP;

(SEQ ID NO: 25093)
KGSHGGGGSGGGGSGGGGSFVSQHLCGSHLVEALYLVCGERGFFYTPK;

(SEQ ID NO: 25094)
KGSHGGGGSGGGGSGGGGSFVTQHLCGSHLVEALYLVCGERGFFYTPK;

(SEQ ID NO: 25095)
KGSHGGGGSGGGGSGGGGSFVGQHLCGSHLVEALYLVCGERGFFYTPK;

(SEQ ID NO: 25096)
KGSHGGGGSGGGGSGGGGSFVNQHLCGSHLVEALYLVCGERGFFYTPK;

(SEQ ID NO: 25097)
KGSHGGGGSGGGGSGGGGSHLCGSHLVEALYLVCGERGFFYTPK;

(SEQ ID NO: 25098)
KGSHGGGGSGGGGSGGGGSFVNQHLCGSHLVEALYLVCGDRGFFYTKPT;

(SEQ ID NO: 25099)
KGSHGGGGSGGGGSGGGGSFVGQHLCGSHLVEALYLVCGDRGFFYTKPT;

(SEQ ID NO: 25100)
KGSHGGGGSGGGGSGGGGSHLCGSHLVEALYLVCGDRGFFYTKPT;

(SEQ ID NO: 25101)
KGSHGGGGSGGGGSGGGGSFVNQHLCGSHLVEALYLVCGDRGFFYTKP;

(SEQ ID NO: 25102)
KGSHGGGGSGGGGSGGGGSFVGQHLCGSHLVEALYLVCGDRGFFYTKP;

(SEQ ID NO: 25103)
KGSHGGGGSGGGGSGGGGSHLCGSHLVEALYLVCGDRGFFYTKP;

(SEQ ID NO: 25104)
KGSHGGGGSGGGGSGGGGSFVSQHLCGSHLVEALYLVQGDRGFFYTPK;

(SEQ ID NO: 25105)
KGSHGGGGSGGGGSGGGGSFVTQHLCGSHLVEALYLVCGDRGFFYTPK;

(SEQ ID NO: 25106)
KGSHGGGGSGGGGSGGGGSFVGQHLCGSHLVEALYLVCGDRGFFYTPK;

(SEQ ID NO: 25107)
KGSHGGGGSGGGGSGGGGSFVNQHLCGSHLVEALYLVCGDRGFFYTPK;

(SEQ ID NO: 25108)
KGSHGGGGSGGGGSGGGGSHLCGSHLVEALYLVCGDRGFFYTPK;

(SEQ ID NO: 25109)
KGSHGGGGSGGGGSGGGGSFVNQHLCGSHLVEALHLVCGKRGFFYTRPT;
```

-continued

```
                                       (SEQ  ID NO: 25110)
KGSHGGGGSGGGGSGGGGSFVGQHLCGSHLVEALHLVCGKRGFFYTRPT;

(SEQ  ID NO: 25111)
KGSHGGGGSGGGGSGGGGSHLCGSHLVEALHLVCGKRGFFYTRPT;

(SEQ  ID NO: 25112)
KGSHGGGGSGGGGSGGGGSFVNQHLCGSHLVEALHLVCGKRGFFYTRP;

(SEQ  ID NO: 25113)
KGSHGGGGSGGGGSGGGGSFVGQHLCGSHLVEALHLVCGKRGFFYTRP;

(SEQ  ID NO: 25114)
KGSHGGGGSGGGGSGGGGSHLCGSHLVEALHLVCGKRGFFYTRP;

(SEQ  ID NO: 25115)
KGSHGGGGSGGGGSGGGGSFVSQHLCGSHLVEALHLVQGKRGFFYTPR;

(SEQ  ID NO: 25116)
KGSHGGGGSGGGGSGGGGSFVTQHLCGSHLVEALHLVCGKRGFFYTPR;

(SEQ  ID NO: 25117)
KGSHGGGGSGGGGSGGGGSFVGQHLCGSHLVEALHLVCGKRGFFYTPR;

(SEQ  ID NO: 25118)
KGSHGGGGSGGGGSGGGGSFVNQHLCGSHLVEALHLVCGKRGFFYTPR;

(SEQ  ID NO: 25119)
KGSHGGGGSGGGGSGGGGSHLCGSHLVEALHLVCGKRGFFYTPR;

(SEQ  ID NO: 25120)
KGSHGGGGSGGGGSGGGGSFVGQHLCGSHLVEALHLVCGDRGFFYTKPT;

(SEQ  ID NO: 25121)
KGSHGGGGSGGGGSGGGGSHLCGSHLVEALHLVCGDRGFFYTKPT;

(SEQ  ID NO: 25122)
KGSHGGGGSGGGGSGGGGSFVNQHLCGSHLVEALHLVCGDRGFFYTKP;

(SEQ  ID NO: 25123)
KGSHGGGGSGGGGSGGGGSFVGQHLCGSHLVEALHLVCGDRGFFYTKP;

(SEQ  ID NO: 25124)
KGSHGGGGSGGGGSGGGGSHLCGSHLVEALHLVCGDRGFFYTKP;

(SEQ  ID NO: 25125)
KGSHGGGGSGGGGSGGGGSFVSQHLCGSHLVEALHLVCGDRGFFYTPK;

(SEQ  ID NO: 25126)
KGSHGGGGSGGGGSGGGGSFVTQHLCGSHLVEALHLVCGDRGFFYTPK;

(SEQ  ID NO: 25127)
KGSHGGGGSGGGGSGGGGSFVGQHLCGSHLVEALHLVCGDRGFFYTPK;

(SEQ  ID NO: 25128)
KGSHGGGGSGGGGSGGGGSFVNQHLCGSHLVEALHLVCGDRGFFYTPK;

(SEQ  ID NO: 25129)
KGSHGGGGSGGGGSGGGGSHLCGSHLVEALHLVCGDRGFFYTPK;

(SEQ  ID NO: 25130)
KGSHGGGGSGGGGSGGGGSFVNQHLCGSHLVEALHLVCGKRGFHYTRPT;

(SEQ  ID NO: 25131)
KGSHGGGGSGGGGSGGGGSFVGQHLCGSHLVEALHLVCGKRGFHYTRPT;

(SEQ  ID NO: 25132)
KGSHGGGGSGGGGSGGGGSHLCGSHLVEALHLVCGKRGFHYTRPT;

(SEQ  ID NO: 25133)
KGSHGGGGSGGGGSGGGGSFVNQHLCGSHLVEALHLVCGKRGFHYTRP;

(SEQ  ID NO: 25134)
KGSHGGGGSGGGGSGGGGSFVGQHLCGSHLVEALHLVCGKRGFHYTRP;

(SEQ  ID NO: 25135)
KGSHGGGGSGGGGSGGGGSHLCGSHLVEALHLVCGKRGFHYTRP;

(SEQ  ID NO: 25136)
KGSHGGGGSGGGGSGGGGSFVSQHLCGSHLVEALHLVCGKRGFHYTPR;
```

-continued

```
                                 (SEQ ID NO: 25137)
KGSHGGGGSGGGGSGGGGSFVTQHLCGSHLVEALHLVCGKRGFHYTPR;

(SEQ ID NO: 25138)
KGSHGGGGSGGGGSGGGGSFVGQHLCGSHLVEALHLVCGKRGFHYTPR;

(SEQ ID NO: 25139)
KGSHGGGGSGGGGSGGGGSFVNQHLCGSHLVEALHLVCGKRGFHYTPR;

(SEQ ID NO: 25140)
KGSHGGGGSGGGGSGGGGSHLCGSHLVEALHLVCGKRGFHYTPR;

(SEQ ID NO: 25141)
KGSHGGGGSGGGGSGGGGSFVNQHLCGSHLVEALHLVCGDRGFHYTKPT;

(SEQ ID NO: 25142)
KGSHGGGGSGGGGSGGGGSFVGQHLCGSHLVEALHLVCGDRGFHYTKPT;

(SEQ ID NO: 25143)
KGSHGGGGSGGGGSGGGGSHLCGSHLVEALHLVCGDRGFHYTKPT;

(SEQ ID NO: 25144)
KGSHGGGGSGGGGSGGGGSFVNQHLCGSHLVEALHLVCGDRGFHYTKP;

(SEQ ID NO: 25145)
KGSHGGGGSGGGGSGGGGSFVGQHLCGSHLVEALHLVCGDRGFHYTKP;

(SEQ ID NO: 25146)
KGSHGGGGSGGGGSGGGGSHLCGSHLVEALHLVCGDRGFHYTKP;

(SEQ ID NO: 25147)
KGSHGGGGSGGGGSGGGGSFVSQHLCGSHLVEALHLVCGDRGFHYTPK;

(SEQ ID NO: 25148)
KGSHGGGGSGGGGSGGGGSFVTQHLCGSHLVEALHLVCGDRGFHYTPK;

(SEQ ID NO: 25149)
KGSHGGGGSGGGGSGGGGSFVGQHLCGSHLVEALHLVCGDRGFHYTPK;

(SEQ ID NO: 25150)
KGSHGGGGSGGGGSGGGGSFVNQHLCGSHLVEALHLVCGDRGFHYTPK;

(SEQ ID NO: 25151)
KGSHGGGGSGGGGSGGGGSHLCGSHLVEALHLVCGDRGFHYTPK;

(SEQ ID NO: 25152)
KGSHGGGGSGGGGSGGGGSGGGGSFVNQHLCGSHLVEALYLVCGKRGFFYTRPT;

(SEQ ID NO: 25153)
KGSHGGGGSGGGGSGGGGSGGGGSFVGQHLCGSHLVEALYLVCGKRGFFYTRPT;

(SEQ ID NO: 25154)
KGSHGGGGSGGGGSGGGGSGGGGSHLCGSHLVEALYLVCGKRGFFYTRPT;

(SEQ ID NO: 25155)
KGSHGGGGSGGGGSGGGGSGGGGSFVNQHLCGSHLVEALYLVCGKRGFFYTRP;

(SEQ ID NO: 25156)
KGSHGGGGSGGGGSGGGGSGGGGSFVGQHLCGSHLVEALYLVCGKRGFFYTRP;

(SEQ ID NO: 25157)
KGSHGGGGSGGGGSGGGGSGGGGSHLCGSHLVEALYLVCGKRGFFYTRP;

(SEQ ID NO: 25158)
KGSHGGGGSGGGGSGGGGSGGGGSFVSQHLCGSHLVEALYLVCGKRGFFYTPR;

(SEQ ID NO: 25159)
KGSHGGGGSGGGGSGGGGSGGGGSFVTQHLCGSHLVEALYLVCGKRGFFYTPR;

(SEQ ID NO: 25160)
KGSHGGGGSGGGGSGGGGSGGGGSFVGQHLCGSHLVEALYLVCGKRGFFYTPR;

(SEQ ID NO: 25161)
KGSHGGGGSGGGGSGGGGSGGGGSFVNQHLCGSHLVEALYLVCGKRGFFYTPR;

(SEQ ID NO: 25162)
KGSHGGGGSGGGGSGGGGSGGGGSHLCGSHLVEALYLVCGKRGFFYTPR;

(SEQ ID NO: 25163)
KGSHGGGGSGGGGSGGGGSGGGGSFVNQHLCGSHLVEALYLVCGERGFFYTKPT;
```

-continued

```
                                        (SEQ  ID NO: 25164)
KGSHGGGGSGGGGSGGGGSGGGGSFVGQHLCGSHLVEALYLVCGERGFFYTKPT;

(SEQ  ID NO: 25165)
KGSHGGGGSGGGGSGGGGSGGGGSHLCGSHLVEALYLVCGERGFFYTKPT;

(SEQ  ID NO: 25166)
KGSHGGGGSGGGGSGGGGSGGGGSFVNQHLCGSHLVEALYLVCGERGFFYTKP;

(SEQ  ID NO: 25167)
KGSHGGGGSGGGGSGGGGSGGGGSFVGQHLCGSHLVEALYLVCGERGFFYTKP;

(SEQ  ID NO: 25168)
KGSHGGGGSGGGGSGGGGSGGGGSHLCGSHLVEALYLVCGERGFFYTKP;

(SEQ  ID NO: 25169)
KGSHGGGGSGGGGSGGGGSGGGGSFVSQHLCGSHLVEALYLVCGERGFFYTPK;

(SEQ  ID NO: 25170)
KGSHGGGGSGGGGSGGGGSGGGGSFVTQHLCGSHLVEALYLVCGERGFFYTPK;

(SEQ  ID NO: 25171)
KGSHGGGGSGGGGSGGGGSGGGGSFVGQHLCGSHLVEALYLVCGERGFFYTPK;

(SEQ  ID NO: 25172)
KGSHGGGGSGGGGSGGGGSGGGGSFVNQHLCGSHLVEALYLVCGERGFFYTPK;

(SEQ  ID NO: 25173)
KGSHGGGGSGGGGSGGGGSGGGGSHLCGSHLVEALYLVCGERGFFYTPK;

(SEQ  ID NO: 25174)
KGSHGGGGSGGGGSGGGGSGGGGSFVNQHLCGSHLVEALYLVCGDRGFFYTKPT;

(SEQ  ID NO: 25175)
KGSHGGGGSGGGGSGGGGSGGGGSFVGQHLCGSHLVEALYLVCGDRGFFYTKPT;

(SEQ  ID NO: 25176)
KGSHGGGGSGGGGSGGGGSGGGGSHLCGSHLVEALYLVCGDRGFFYTKPT;

(SEQ  ID NO: 25177)
KGSHGGGGSGGGGSGGGGSGGGGSFVNQHLCGSHLVEALYLVCGDRGFFYTKP;

(SEQ  ID NO: 25178)
KGSHGGGGSGGGGSGGGGSGGGGSFVGQHLCGSHLVEALYLVCGDRGFFYTKP;

(SEQ  ID NO: 25179)
KGSHGGGGSGGGGSGGGGSGGGGSHLCGSHLVEALYLVCGDRGFFYTKP;

(SEQ  ID NO: 25180)
KGSHGGGGSGGGGSGGGGSGGGGSFVSQHLCGSHLVEALYLVCQDRGFFYTPK;

(SEQ  ID NO: 25181)
KGSHGGGGSGGGGSGGGGSGGGGSFVTQHLCGSHLVEALYLVCGDRGFFYTPK;

(SEQ  ID NO: 25182)
KGSHGGGGSGGGGSGGGGSGGGGSFVGQHLCGSHLVEALYLVCGDRGFFYTPK;

(SEQ  ID NO: 25183)
KGSHGGGGSGGGGSGGGGSGGGGSFVNQHLCGSHLVEALYLVCGDRGFFYTPK;

(SEQ  ID NO: 25184)
KGSHGGGGSGGGGSGGGGSGGGGSHLCGSHLVEALYLVCGDRGFFYTPK;

(SEQ  ID NO: 25185)
KGSHGGGGSGGGGSGGGGSGGGGSFVNQHLCGSHLVEALHLVCGKRGFFYTRPT;

(SEQ  ID NO: 25186)
KGSHGGGGSGGGGSGGGGSGGGGSFVGQHLCGSHLVEALHLVCGKRGFFYTRPT;

(SEQ  ID NO: 25187)
KGSHGGGGSGGGGSGGGGSGGGGSHLCGSHLVEALHLVCGKRGFFYTRPT;

(SEQ  ID NO: 25188)
KGSHGGGGSGGGGSGGGGSGGGGSFVNQHLCGSHLVEALHLVCGKRGFFYTRP;

(SEQ  ID NO: 25189)
KGSHGGGGSGGGGSGGGGSGGGGSFVGQHLCGSHLVEALHLVCGKRGFFYTRP;

(SEQ  ID NO: 25190)
KGSHGGGGSGGGGSGGGGSGGGGSHLCGSHLVEALHLVCGKRGFFYTRP;
```

-continued

```
                                        (SEQ  ID NO: 25191)
KGSHGGGGSGGGGSGGGGSGGGGSFVSQHLCGSHLVEALHLVCGKRGFFYTPR;

(SEQ  ID NO: 25192)
KGSHGGGGSGGGGSGGGGSGGGGSFVTQHLCGSHLVEALHLVCGKRGFFYTPR;

(SEQ  ID NO: 25193)
KGSHGGGGSGGGGSGGGGSGGGGSFVGQHLCGSHLVEALHLVCGKRGFFYTPR;

(SEQ  ID NO: 25194)
KGSHGGGGSGGGGSGGGGSGGGGSFVNQHLCGSHLVEALHLVCGKRGFFYTPR;

(SEQ  ID NO: 25195)
KGSHGGGGSGGGGSGGGGSGGGGSHLCGSHLVEALHLVCGKRGFFYTPR;

(SEQ  ID NO: 25196)
KGSHGGGGSGGGGSGGGGSGGGGSFVGQHLCGSHLVEALHLVCGDRGFFYTKPT;

(SEQ  ID NO: 25197)
KGSHGGGGSGGGGSGGGGSGGGGSHLCGSHLVEALHLVCQDRGFFYTKPT;

(SEQ  ID NO: 25198)
KGSHGGGGSGGGGSGGGGSGGGGSFVNQHLCGSHLVEALHLVCGDRGFFYTKP;

(SEQ  ID NO: 25199)
KGSHGGGGSGGGGSGGGGSGGGGSFVGQHLCGSHLVEALHLVCGDRGFFYTKP;

(SEQ  ID NO: 25200)
KGSHGGGGSGGGGSGGGGSGGGGSHLCGSHLVEALHLVCGDRGFFYTKP;

(SEQ  ID NO: 25201)
KGSHGGGGSGGGGSGGGGSGGGGSFVSQHLCGSHLVEALHLVCGDRGFFYTPK;

(SEQ  ID NO: 25202)
KGSHGGGGSGGGGSGGGGSGGGGSFVTQHLCGSHLVEALHLVCGDRGFFYTPK;

(SEQ  ID NO: 25203)
KGSHGGGGSGGGGSGGGGSGGGGSFVGQHLCGSHLVEALHLVCGDRGFFYTPK;

(SEQ  ID NO: 25204)
KGSHGGGGSGGGGSGGGGSGGGGSFVNQHLCGSHLVEALHLVCGDRGFFYTPK;

(SEQ  ID NO: 25205)
KGSHGGGGSGGGGSGGGGSGGGGSHLCGSHLVEALHLVCGDRGFFYTPK;

(SEQ  ID NO: 25206)
KGSHGGGGSGGGGSGGGGSGGGGSFVNQHLCGSHLVEALHLVCGKRGFHYTRPT;

(SEQ  ID NO: 25207)
KGSHGGGGSGGGGSGGGGSGGGGSFVGQHLCGSHLVEALHLVCGKRGFHYTRPT;

(SEQ  ID NO: 25208)
KGSHGGGGSGGGGSGGGGSGGGGSHLCGSHLVEALHLVCQKRGFHYTRPT;

(SEQ  ID NO: 25209)
KGSHGGGGSGGGGSGGGGSGGGGSFVNQHLCGSHLVEALHLVCGKRGFHYTRP;

(SEQ  ID NO: 25210)
KGSHGGGGSGGGGSGGGGSGGGGSFVGQHLCGSHLVEALHLVCGKRGFHYTRP;

(SEQ  ID NO: 25211)
KGSHGGGGSGGGGSGGGGSGGGGSHLCGSHLVEALHLVCGKRGFHYTRP;

(SEQ  ID NO: 25212)
KGSHGGGGSGGGGSGGGGSGGGGSFVSQHLCGSHLVEALHLVCGKRGFHYTPR;

(SEQ  ID NO: 25213)
KGSHGGGGSGGGGSGGGGSGGGGSFVTQHLCGSHLVEALHLVCGKRGFHYTPR;

(SEQ  ID NO: 25214)
KGSHGGGGSGGGGSGGGGSGGGGSFVGQHLCGSHLVEALHLVCGKRGFHYTPR;

(SEQ  ID NO: 25215)
KGSHGGGGSGGGGSGGGGSGGGGSFVNQHLCGSHLVEALHLVCGKRGFHYTPR;

(SEQ  ID NO: 25216)
KGSHGGGGSGGGGSGGGGSGGGGSHLCGSHLVEALHLVCGKRGFHYTPR;

(SEQ  ID NO: 25217)
KGSHGGGGSGGGGSGGGGSGGGGSFVNQHLCGSHLVEALHLVCGDRGFHYTKPT;
```

-continued

```
                                 (SEQ  ID NO: 25218)
KGSHGGGGSGGGGSGGGGSGGGGSFVGQHLCGSHLVEALHLVCGDRGFHYTKPT;

(SEQ  ID NO: 25219)
KGSHGGGGSGGGGSGGGGSGGGGSHLCGSHLVEALHLVCGDRGFHYTKPT;

(SEQ  ID NO: 25220)
KGSHGGGGSGGGGSGGGGSGGGGSFVNQHLCGSHLVEALHLVCGDRGFHYTKP;

(SEQ  ID NO: 25221)
KGSHGGGGSGGGGSGGGGSGGGGSFVGQHLCGSHLVEALHLVCGDRGFHYTKP;

(SEQ  ID NO: 25222)
KGSHGGGGSGGGGSGGGGSGGGGSHLCGSHLVEALHLVCGDRGFHYTKP;

(SEQ  ID NO: 25223)
KGSHGGGGSGGGGSGGGGSGGGGSFVSQHLCGSHLVEALHLVCGDRGFHYTPK;

(SEQ  ID NO: 25224)
KGSHGGGGSGGGGSGGGGSGGGGSFVTQHLCGSHLVEALHLVCGDRGFHYTPK;

(SEQ  ID NO: 25225)
KGSHGGGGSGGGGSGGGGSGGGGSFVGQHLCGSHLVEALHLVCGDRGFHYTPK;

(SEQ  ID NO: 25226)
KGSHGGGGSGGGGSGGGGSGGGGSFVNQHLCGSHLVEALHLVCGDRGFHYTPK;

(SEQ  ID NO: 25227)
KGSHGGGGSGGGGSGGGGSGGGGSHLCGSHLVEALHLVCGDRGFHYTPK;

(SEQ  ID NO: 25228)
GKGSHKFVNQHLCGSHLVEALYLVCGKRGFFYTPR;

(SEQ  ID NO: 25229)
GKGSHKFVGQHLCGSHLVEALYLVCGKRGFFYTRPT;

(SEQ  ID NO: 25230)
GKGSHKHLCGSHLVEALYLVCGKRGFFYTRPT;

(SEQ  ID NO: 25231)
GKGSHKFVNQHLCGSHLVEALYLVCGKRGFFYTRP;

(SEQ  ID NO: 25232)
GKGSHKFVGQHLCGSHLVEALYLVCGKRGFFYTRP;

(SEQ  ID NO: 25233)
GKGSHKHLCGSHLVEALYLVCGKRGFFYTRP;

(SEQ  ID NO: 25234)
GKGSHKFVSQHLCGSHLVEALYLVCGKRGFFYTPR;

(SEQ  ID NO: 25235)
GKGSHKFVTQHLCGSHLVEALYLVCGKRGFFYTPR;

(SEQ  ID NO: 25236)
GKGSHKFVGQHLCGSHLVEALYLVCGKRGFFYTPR;

(SEQ  ID NO: 25237)
GKGSHKFVNQHLCGSHLVEALYLVCGKRGFFYTPRT;

(SEQ  ID NO: 25238)
GKGSHKHLCGSHLVEALYLVCGKRGFFYTPR;

(SEQ  ID NO: 25239)
GKGSHKFVNQHLCGSHLVEALYLVCGERGFFYTKPT;

(SEQ  ID NO: 25240)
GKGSHKFVGQHLCGSHLVEALYLVCGERGFFYTKPT;

(SEQ  ID NO: 25241)
GKGSHKHLCGSHLVEALYLVCGERGFFYTKPT;

(SEQ  ID NO: 25242)
GKGSHKFVNQHLCGSHLVEALYLVCGERGFFYTKP;

(SEQ  ID NO: 25243)
GKGSHKFVGQHLCGSHLVEALYLVCGERGFFYTKP;

(SEQ  ID NO: 25244)
GKGSHKHLCGSHLVEALYLVCGERGFFYTKP;
```

-continued

```
                                        (SEQ ID NO: 25245)
GKGSHKFVSQHLCGSHLVEALYLVCGERGFFYTPK;

(SEQ ID NO: 25246)
GKGSHKFVTQHLCGSHLVEALYLVCGERGFFYTPK;

(SEQ ID NO: 25247)
GKGSHKFVGQHLCGSHLVEALYLVCGERGFFYTPK;

(SEQ ID NO: 25248)
GKGSHKFVNQHLCGSHLVEALYLVCGERGFFYTPK;

(SEQ ID NO: 25249)
GKGSHKHLCQSHLVEALYLVCGERGFFYTPK;

(SEQ ID NO: 25250)
GKGSHKFVNQHLCGSHLVEALYLVCGDRGFFYTKPT;

(SEQ ID NO: 25251)
GKGSHKFVGQHLCGSHLVEALYLVCGDRGFFYTKPT;

(SEQ ID NO: 25252)
GKGSHKHLCGSHLVEALYLVCGDRGFFYTKPT;

(SEQ ID NO: 25253)
GKGSHKFVNQHLCGSHLVEALYLVCGDRGFFYTKP;

(SEQ ID NO: 25254)
GKGSHKFVGQHLCGSHLVEALYLVCGDRGFFYTKP;

(SEQ ID NO: 25255)
GKGSHKHLCGSHLVEALYLVCGDRGFFYTKP;

(SEQ ID NO: 25256)
GKGSHKFVSQHLCGSHLVEALYLVCGDRGFFYTPK;

(SEQ ID NO: 25257)
GKGSHKFVTQHLCGSHLVEALYLVCGDRGFFYTPK;

(SEQ ID NO: 25258)
GKGSHKFVGQHLCGSHLVEALYLVCGDRGFFYTPK;

(SEQ ID NO: 25259)
GKGSHKFVNQHLCGSHLVEALYLVCGDRGFFYTPK;

(SEQ ID NO: 25260)
GKGSHKHLCGSHLVEALYLVCGDRGFFYTPK;

(SEQ ID NO: 25261)
GKGSHKFVNQHLCGSHLVEALHLVCGKRGFFYTRPT;

(SEQ ID NO: 25262)
GKGSHKFVGQHLCGSHLVEALHLVCGKRGFFYTRPT;

(SEQ ID NO: 25263)
GKGSHKHLCGSHLVEALHLVCGKRGFFYTRPT;

(SEQ ID NO: 25264)
GKGSHKFVNQHLCGSHLVEALHLVCGKRGFFYTRP;

(SEQ ID NO: 25265)
GKGSHKFVGQHLCGSHLVEALHLVCGKRGFFYTRP;

(SEQ ID NO: 25266)
GKGSHKHLCGSHLVEALHLVCGKRGFFYTRP;

(SEQ ID NO: 25267)
GKGSHKFVSQHLCGSHLVEALHLVCGKRGFFYTPR;

(SEQ ID NO: 25268)
GKGSHKFVTQHLCGSHLVEALHLVCGKRGFFYTPR;

(SEQ ID NO: 25269)
GKGSHKFVGQHLCGSHLVEALHLVCGKRGFFYTPR;

(SEQ ID NO: 25270)
GKGSHKFVNQHLCGSHLVEALHLVCGKRGFFYTPR;

(SEQ ID NO: 25271)
GKGSHKHLCGSHLVEALHLVCGKRGFFYTPR;
```

-continued

```
                                    (SEQ  ID NO: 25272)
GKGSHKFVGQHLCGSHLVEALHLVCGDRGFFYTKPT;

(SEQ  ID NO: 25273)
GKGSHKHLCGSHLVEALHLVCGDRGFFYTKPT;

(SEQ  ID NO: 25274)
GKGSHKFVNQHLCGSHLVEALHLVCGDRGFFYTKP;

(SEQ  ID NO: 25275)
GKGSHKFVGQHLCGSHLVEALHLVCGDRGFFYTKP;

(SEQ  ID NO: 25276)
GKGSHKHLCGSHLVEALHLVCGDRGFFYTKP;

(SEQ  ID NO: 25277)
GKGSHKFVSQHLCGSHLVEALHLVCGDRGFFYTPK;

(SEQ  ID NO: 25278)
GKGSHKFVTQHLCGSHLVEALHLVCGDRGFFYTPK;

(SEQ  ID NO: 25279)
GKGSHKFVGQHLCGSHLVEALHLVCGDRGFFYTPK;

(SEQ  ID NO: 25280)
GKGSHKFVNQHLCGSHLVEALHLVCGDRGFFYTPK;

(SEQ  ID NO: 25281)
GKGSHKHLCGSHLVEALHLVCGDRGFFYTPK;

(SEQ  ID NO: 25282)
GKGSHKFVNQHLCGSHLVEALHLVCGKRGFHYTRPT;

(SEQ  ID NO: 25283)
GKGSHKFVGQHLCGSHLVEALHLVCGKRGFHYTRPT;

(SEQ  ID NO: 25284)
GKGSHKHLCGSHLVEALHLVCGKRGFHYTRPT;

(SEQ  ID NO: 25285)
GKGSHKFVNQHLCGSHLVEALHLVCGKRGFHYTRP;

(SEQ  ID NO: 25286)
GKGSHKFVGQHLCGSHLVEALHLVCGKRGFHYTRP;

(SEQ  ID NO: 25287)
GKGSHKHLCGSHLVEALHLVCGKRGFHYTRP;

(SEQ  ID NO: 25288)
GKGSHKFVSQHLCGSHLVEALHLVCGKRGFHYTPR;

(SEQ  ID NO: 25289)
GKGSHKFVTQHLCGSHLVEALHLVCGKRGFHYTPR;

(SEQ  ID NO: 25290)
GKGSHKFVGQHLCGSHLVEALHLVCGKRGFHYTPR;

(SEQ  ID NO: 25291)
GKGSHKFVNQHLCGSHLVEALHLVCGKRGFHYTPR;

(SEQ  ID NO: 25292)
GKGSHKHLCGSHLVEALHLVCGKRGFHYTPR;

(SEQ  ID NO: 25293)
GKGSHKFVNQHLCGSHLVEALHLVCGDRGFHYTKPT;

(SEQ  ID NO: 25294)
GKGSHKFVGQHLCGSHLVEALHLVCGDRGFHYTKPT;

(SEQ  ID NO: 25295)
GKGSHKHLCGSHLVEALHLVCGDRGFHYTKPT;

(SEQ  ID NO: 25296)
GKGSHKFVNQHLCGSHLVEALHLVCGDRGFHYTKP;

(SEQ  ID NO: 25297)
GKGSHKFVGQHLCGSHLVEALHLVCGDRGFHYTKP;

(SEQ  ID NO: 25298)
GKGSHKHLCGSHLVEALHLVCGDRGFHYTKP;
```

-continued

```
                                       (SEQ ID NO: 25299)
GKGSHKFVSQHLCGSHLVEALHLVCGDRGFHYTPK;

(SEQ ID NO: 25300)
GKGSHKFVTQHLCGSHLVEALHLVCGDRGFHYTPK;

(SEQ ID NO: 25301)
GKGSHKFVGQHLCGSHLVEALHLVCGDRGFHYTPK;

(SEQ ID NO: 25302)
GKGSHKFVNQHLCGSHLVEALHLVCGDRGFHYTPK;

(SEQ ID NO: 25303)
GKGSHKHLCGSHLVEALHLVCGDRGFHYTPK;

(SEQ ID NO: 25304)
KGSHKFVNQHLCGSHLVEALYLVCGKRGFFYTRPT;

(SEQ ID NO: 25305)
KGSHKFVGQHLCGSHLVEALYLVCGKRGFFYTRPT;

(SEQ ID NO: 25306)
KGSHKHLCGSHLVEALYLVCGKRGFFYTRPT;

(SEQ ID NO: 25307)
KGSHKFVNQHLCGSHLVEALYLVCGKRGFFYTRP;

(SEQ ID NO: 25308)
KGSHKFVGQHLCGSHLVEALYLVCGKRGFFYTRP;

(SEQ ID NO: 25309)
KGSHKHLCGSHLVEALYLVCGKRGFFYTRP;

(SEQ ID NO: 25310)
KGSHKFVSQHLCGSHLVEALYLVCGKRGFFYTPR;

(SEQ ID NO: 25311)
KGSHKFVTQHLCGSHLVEALYLVCGKRGFFYTPR;

(SEQ ID NO: 25312)
KGSHKFVGQHLCGSHLVEALYLVCGKRGFFYTPR;

(SEQ ID NO: 25313)
KGSHKFVNQHLCGSHLVEALYLVCGKRGFFYTPR;

(SEQ ID NO: 25314)
KGSHKHLCQSHLVEALYLVCGKRGFFYTPR;

(SEQ ID NO: 25315)
KGSHKFVNQHLCGSHLVEALYLVCGERGFFYTKPT;

(SEQ ID NO: 25316)
KGSHKFVGQHLCGSHLVEALYLVCGERGFFYTKPT;

(SEQ ID NO: 25317)
KGSHKHLCGSHLVEALYLVCGERGFFYTKPT;

(SEQ ID NO: 25318)
KGSHKFVNQHLCGSHLVEALYLVCGERGFFYTKP;

(SEQ ID NO: 25319)
KGSHKFVGQHLCGSHLVEALYLVCGERGFFYTKP;

(SEQ ID NO: 25320)
KGSHKHLCGSHLVEALYLVCGERGFFYTKP;

(SEQ ID NO: 25321)
KGSHKFVSQHLCGSHLVEALYLVCGERGFFYTPK;

(SEQ ID NO: 25322)
KGSHKFVTQHLCGSHLVEALYLVCGERGFFYTPK;

(SEQ ID NO: 25323)
KGSHKFVGQHLCGSHLVEALYLVCGERGFFYTPK;

(SEQ ID NO: 25324)
KGSHKFVNQHLCGSHLVEALYLVCGERGFFYTPK;

(SEQ ID NO: 25325)
KGSHKHLCGSHLVEALYLVCGERGFFYTPK;
```

-continued

```
                                         (SEQ  ID NO: 25326)
KGSHKFVNQHLCGSHLVEALYLVCGDRGFFYTKPT;

(SEQ  ID NO: 25327)
KGSHKFVGQHLCGSHLVEALYLVCGDRGFFYTKPT;

(SEQ  ID NO: 25328)
KGSHKHLCGSHLVEALYLVCGDRGFFYTKPT;

(SEQ  ID NO: 25329)
KGSHKFVNQHLCGSHLVEALYLVCGDRGFFYTKP;

(SEQ  ID NO: 25330)
KGSHKFVGQHLCGSHLVEALYLVCGDRGFFYTKP;

(SEQ  ID NO: 25331)
KGSHKHLCGSHLVEALYLVCGDRGFFYTKP;

(SEQ  ID NO: 25332)
KGSHKFVSQHLCGSHLVEALYLVQGDRGFFYTPK;

(SEQ  ID NO: 25333)
KGSHKFVTQHLCGSHLVEALYLVCGDRGFFYTPK;

(SEQ  ID NO: 25334)
KGSHKFVGQHLCGSHLVEALYLVCGDRGFFYTPK;

(SEQ  ID NO: 25335)
KGSHKFVNQHLCGSHLVEALYLVCGDRGFFYTPK;

(SEQ  ID NO: 25336)
KGSHKHLCGSHLVEALYLVCGDRGFFYTPK;

(SEQ  ID NO: 25337)
KGSHKFVNQHLCGSHLVEALHLVCGKRGFFYTRPT;

(SEQ  ID NO: 25338)
KGSHKFVGQHLCGSHLVEALHLVCGKRGFFYTRPT;

(SEQ  ID NO: 25339)
KGSHKHLCGSHLVEALHLVCGKRGFFYTRPT;

(SEQ  ID NO: 25340)
KGSHKFVNQHLCGSHLVEALHLVCGKRGFFYTRP;

(SEQ  ID NO: 25341)
KGSHKFVGQHLCGSHLVEALHLVCGKRGFFYTRP;

(SEQ  ID NO: 25342)
KGSHKHLCGSHLVEALHLVCGKRGFFYTRP;

(SEQ  ID NO: 25343)
KGSHKFVSQHLCGSHLVEALHLVCGKRGFFYTPR;

(SEQ  ID NO: 25344)
KGSHKFVTQHLCGSHLVEALHLVCGKRGFFYTPR;

(SEQ  ID NO: 25345)
KGSHKFVGQHLCGSHLVEALHLVCGKRGFFYTPR;

(SEQ  ID NO: 25346)
KGSHKFVNQHLCGSHLVEALHLVCGKRGFFYTPR;

(SEQ  ID NO: 25347)
KGSHKHLCGSHLVEALHLVCGKRGFFYTPR;

(SEQ  ID NO: 25348)
KGSHKFVGQHLCGSHLVBALHLVCGDRGFFYTKPT;

(SEQ  ID NO: 25349)
KGSHKHLCGSHLVEALHLVCGDRGFFYTKPT;

(SEQ  ID NO: 25350)
KGSHKFVNQHLCGSHLVEALHLVCGDRGFFYTKP;

(SEQ  ID NO: 25351)
KGSHKFVGQHLCGSHLVEALHLVCGDRGFFYTKP;

(SEQ  ID NO: 25352)
KGSHKHLCGSHLVEALHLVCGDRGFFYTKP;
```

-continued

```
                                   (SEQ  ID NO: 25353)
KGSHKFVSQHLCGSHLVEALHLVCGDRGFFYTPK;

(SEQ  ID NO: 25354)
KGSHKFVTQHLCGSHLVEALHLVCGDRGFFYTPK;

(SEQ  ID NO: 25355)
KGSHKFVGQHLCGSHLVEALHLVCGDRGFFYTPK;

(SEQ  ID NO: 25356)
KGSHKFVNQHLCGSHLVEALHLVCGDRGFFYTPK;

(SEQ  ID NO: 25357)
KGSHKHLCGSHLVEALHLVCGDRGFFYTPK;

(SEQ  ID NO: 25358)
KGSHKFVNQHLCGSHLVEALHLVCGKRGFHYTRPT;

(SEQ  ID NO: 25359)
KGSHKFVGQHLCGSHLVEALHLVCGKRGFHYTRPT;

(SEQ  ID NO: 25360)
KGSHKHLCGSHLVEALHLVCGKRGFHYTRPT;

(SEQ  ID NO: 25361)
KGSHKFVNQHLCGSHLVEALHLVCGKRGFHYTRP;

(SEQ  ID NO: 25362)
KGSHKFVGQHLCGSHLVEALHLVCGKRGFHYTRP;

(SEQ  ID NO: 25363)
KGSHKHLCGSHLVEALHLVCGKRGFHYTRP;

(SEQ  ID NO: 25364)
KGSHKFVSQHLCGSHLVEALHLVCGKRGFHYTPR;

(SEQ  ID NO: 25365)
KGSHKFVTQHLCGSHLVEALHLVCGKRGFHYTPR;

(SEQ  ID NO: 25366)
KGSHKFVGQHLCGSHLVBALHLVCGKRGFHYTPR;

(SEQ  ID NO: 25367)
KGSHKFVNQHLCGSHLVEALHLVCGKRGFHYTPR;

(SEQ  ID NO: 25368)
KGSHKHLCGSHLVEALHLVCGKRGFHYTPR;

(SEQ  ID NO: 25369)
KGSHKFVNQHLCGSHLVEALHLVCGDRGFHYTKPT;

(SEQ  ID NO: 25370)
KGSHKFVGQHLCGSHLVEALHLVCGDRGFHYTKPT;

(SEQ  ID NO: 25371)
KGSHKHLCGSHLVEALHLVCGDRGFHYTKPT;

(SEQ  ID NO: 25372)
KGSHKFVNQHLCGSHLVEALHLVCGDRGFHYTKP;

(SEQ  ID NO: 25373)
KGSHKFVGQHLCGSHLVEALHLVCGDRGFHYTKP;

(SEQ  ID NO: 25374)
KGSHKHLCGSHLVEALHLVCGDRGFHYTKP;

(SEQ  ID NO: 25375)
KGSHKFVSQHLCGSHLVEALHLVCGDRGFHYTPK;

(SEQ  ID NO: 25376)
KGSHKFVTQHLCGSHLVEALHLVCGDRGFHYTPK;
```

-continued

```
                                 (SEQ  ID NO: 25377)
KGSHKFVGQHLCGSHLVEALHLVCGDRGFHYTPK;

(SEQ  ID NO: 25378)
KGSHKFVNQHLCGSHLVEALHLVCGDRGFHYTPK;

(SEQ  ID NO: 25379)
KGSHKHLCGSHLVEALHLVCGDRGFHYTPK;

(SEQ  ID NO: 25380)
KGSHKFVGQHLCGSHLVEALYLVCGKRGFFYTPRT;

(SEQ  ID NO: 25381)
GKGSHKFVGQHLCGSHLVEALYLVCGKRGFFYTPRT;

(SEQ  ID NO: 25382)
KGGGGGGGGSGGGGSFVGQHLCGSHLVEALYLVCGERGFFYTPK;

(SEQ  ID NO: 25383)
GKGGGGSGGGGSGGGGSFVGQHLCGSHLVEALYLVCGERGFFYTPK;

(SEQ  ID NO: 25384)
KGGGGSGGGGSGGGGSFVGQHLCGSHLVEALYLVCGERGFFYTPKT;

(SEQ  ID NO: 25385)
GKGGGGSGGGGSGGGGSFVGQHLCGSHLVEALYLVCGERGFFYTPKT;

(SEQ  ID NO: 25386)
KGSHGGGGSGGGGSGGGGSFVGQHLCGSHLVEALYLVCGERGFFYTPKT;

(SEQ  ID NO: 25387)
GKGSHGGGGSGGGGSGGGGSFVGQHLCGSHLVEALYLVCGERGFFYTPK;

(SEQ  ID NO: 25388)
GKGSHGGGGSGGGGSGGGGSFVGQHLCGSHLVEALYLVCGERGFFYTPKT;

(SEQ  ID NO: 25389)
KGGGGSGGGGSGGGGSFVGQHLCGSHLVEALYLVCGKRGFFYTPR;

(SEQ  ID NO: 25390)
GKGGGGSGGGGSGGGGSFVGQHLCGSHLVEALYLVCGKRGFFYTPR;

(SEQ  ID NO: 25391)
KGGGGSGGGGGGGGSFVGQHLCGSHLVEALYLVCGKRGFFYTPRT;

(SEQ  ID NO: 25392)
GKGGGGSGGGGGGGGSFVGQHLCGSHLVEALYLVCGKRGFFYTPRT;

(SEQ  ID NO: 25393)
KGSHKFVDQHLCGSHLVEALYLVCGKRGFFYTPR;

(SEQ  ID NO: 25394)
KFVDQHLCGSHLVEALYLVCGKRGFFYTPKT;

(SEQ  ID NO: 25395)
KGGGGSGGGGSGGGGSFVNQHLCGSHLVEALYLVCGERGFFYTPK;

(SEQ  ID NO: 25396)
GKGSHKFVNQHLCGSHLVEALYLVCGKRGFFYTRPT;
and (SEQ  ID NO: 25397)
GKGGGGSGGGGSGGGGSFVNQHLCGSHLVEALYLVCGERGFFYTPK.
```

SEQUENCE LISTING (25397 sequences)

SEQ ID NO: 1 - protein, 21 aa, Homo sapiens
GIVEQCCTSICSLYQLENYCN

SEQ ID NO: 2 - protein, 30 aa, Homo sapiens
FVNQHLCGSHLVEALYLVCGERGFFYTPKT

SEQ ID NO: 3 - protein, 21 aa, synthetic construct
  REGION 1..21: note = Synthetic Construct
GIVKQCCTSICSLYQLENYCN

SEQ ID NO: 4 - protein, 21 aa, synthetic construct
  REGION 1..21: note = Synthetic Construct
GIVEQCCHSICSLYQLENYCN

SEQ ID NO: 5 - protein, 21 aa, synthetic construct
  REGION 1..21: note = Synthetic Construct
GIVEQCCASICSLYQLENYCN

SEQ ID NO: 6 - protein, 21 aa, synthetic construct
  REGION 1..21: note = Synthetic Construct
GIVEQCCTRICSLYQLENYCN

SEQ ID NO: 7 - protein, 21 aa, synthetic construct
  REGION 1..21: note = Synthetic Construct
GIVEQCCTKICSLYQLENYCN

SEQ ID NO: 8 - protein, 20 aa, synthetic construct
  REGION 1..20: note = Synthetic Construct
GIVEQCCTSICSEYQENYCN

SEQ ID NO: 9 - protein, 21 aa, synthetic construct
  REGION 1..21: note = Synthetic Construct
GIVKQCCTSICSLYQLENYCG

SEQ ID NO: 10 - protein, 21 aa, synthetic construct
  REGION 1..21: note = Synthetic Construct
GIVEQCCHSICSLYQLENYCG

SEQ ID NO: 11 - protein, 21 aa, synthetic construct
  REGION 1..21: note = Synthetic Construct
GIVEQCCASICSLYQLENYCG

SEQ ID NO: 12 - protein, 21 aa, synthetic construct
  REGION 1..21: note = Synthetic Construct
GIVEQCCTRICSLYQLENYCG

SEQ ID NO: 13 - protein, 21 aa, synthetic construct
  REGION 1..21: note = Synthetic Construct
GIVEQCCTKICSLYQLENYCG

SEQ ID NO: 14 - protein, 20 aa, synthetic construct
  REGION 1..20: note = Synthetic Construct
GIVEQCCTSICSEYQENYCG

SEQ ID NO: 15 - protein, 19 aa, synthetic construct
  REGION 1..19: note = Synthetic Construct
GIVEQCCTSICSEYQENYC

SEQ ID NO: 16 - protein, 22 aa, synthetic construct
  REGION 1..22: note = Synthetic Construct
GIVEQCCTSICSLYQLENYCNK

SEQ ID NO: 17 - protein, 23 aa, synthetic construct
  REGION 1..23: note = Synthetic Construct
KPGIVEQCCTSICSLYQLENYCN

SEQ ID NO: 18 - protein, 22 aa, synthetic construct
  REGION 1..22: note = Synthetic Construct
KPIVEQCCTSICSLYQLENYCN

SEQ ID NO: 19 - protein, 21 aa, synthetic construct
  REGION 1..21: note = Synthetic Construct
KPVEQCCTSICSLYQLENYCN

SEQ ID NO: 20 - protein, 22 aa, synthetic construct
  REGION 1..22: note = Synthetic Construct
KPGVEQCCTSICSLYQLENYCN

SEQ ID NO: 21 - protein, 23 aa, synthetic construct
  REGION 1..23: note = Synthetic Construct
GEKPVEQCCTSICSLYQLENYCN

SEQ ID NO: 22 - protein, 25 aa, synthetic construct
  REGION 1..25: note = Synthetic Construct
KPGEKPVEQCCTSICSLYQLENYCN

SEQ ID NO: 23 - protein, 22 aa, synthetic construct
  REGION 1..22: note = Synthetic Construct
KPVEQCCTSICSLYQLENYCNK

SEQ ID NO: 24 - protein, 24 aa, synthetic construct
  REGION 1..24: note = Synthetic Construct
KPVEQCCTSICSLYQLENYCNEKP

SEQ ID NO: 25 - protein, 22 aa, synthetic construct
  REGION 1..22: note = Synthetic Construct
GIVEQCCTSICSLYQLENYCGK

SEQ ID NO: 26 - protein, 23 aa, synthetic construct
  REGION 1..23: note = Synthetic Construct
KPGIVEQCCTSICSLYQLENYCG

SEQ ID NO: 27 - protein, 22 aa, synthetic construct
  REGION 1..22: note = Synthetic Construct
KPIVEQCCTSICSLYQLENYCG

SEQ ID NO: 28 - protein, 21 aa, synthetic construct
  REGION 1..21: note = Synthetic Construct
KPVEQCCTSICSLYQLENYCG

SEQ ID NO: 29 - protein, 22 aa, synthetic construct
  REGION 1..22: note = Synthetic Construct
KPGVEQCCTSICSLYQLENYCG

SEQ ID NO: 30 - protein, 23 aa, synthetic construct
  REGION 1..23: note = Synthetic Construct
GEKPVEQCCTSICSLYQLENYCG

SEQ ID NO: 31 - protein, 25 aa, synthetic construct
  REGION 1..25: note = Synthetic Construct
KPGEKPVEQCCTSICSLYQLENYCG

SEQ ID NO: 32 - protein, 22 aa, synthetic construct
  REGION 1..22: note = Synthetic Construct
KPVEQCCTSICSLYQLENYCGK

SEQ ID NO: 33 - protein, 24 aa, synthetic construct
  REGION 1..24: note = Synthetic Construct
KPVEQCCTSICSLYQLENYCGEKP

SEQ ID NO: 34 - protein, 28 aa, synthetic construct
  REGION 1..28: note = Synthetic Construct
FVNQHLCGSHLVEALYLVCGERGFFYTP

SEQ ID NO: 35 - protein, 28 aa, synthetic construct
  REGION 1..28: note = Synthetic Construct
FVNQHLCGSHLVEALYLVCGKRGFFYTP

SEQ ID NO: 36 - protein, 30 aa, synthetic construct
  REGION 1..30: note = Synthetic Construct
FVNQHLCGSHLVEALYLVCGKRGFFYTPRT

SEQ ID NO: 37 - protein, 27 aa, synthetic construct
  REGION 1..27: note = Synthetic Construct
FVNQHLCGSHLVEALYLVCGKRGFFYT

SEQ ID NO: 38 - protein, 29 aa, synthetic construct
  REGION 1..29: note = Synthetic Construct
VNQHLCGSHLVEALYLVCGERGFFYTPKT

SEQ ID NO: 39 - protein, 28 aa, synthetic construct
  REGION 1..28: note = Synthetic Construct
NQHLCGSHLVEALYLVCGERGFFYTPKT

SEQ ID NO: 40 - protein, 27 aa, synthetic construct
  REGION 1..27: note = Synthetic Construct
QHLCGSHLVEALYLVCGERGFFYTPKT

SEQ ID NO: 41 - protein, 31 aa, synthetic construct
  REGION 1..31: note = Synthetic Construct
PFVNQHLCGSHLVEALYLVCGERGFFYTPKT

SEQ ID NO: 42 - protein, 31 aa, synthetic construct
  REGION 1..31: note = Synthetic Construct
PFVNQHLCGSHLVEALYLVCGKRGFFYTPRT

SEQ ID NO: 43 - protein, 31 aa, synthetic construct
  REGION 1..31: note = Synthetic Construct
PFVNQHLCGSHLVEALYLVCGKEGFFYTPRT

SEQ ID NO: 44 - protein, 30 aa, synthetic construct
  REGION 1..30: note = Synthetic Construct
PFVNQHLCGSHLVEALYLVCGKRGFFYTPR

SEQ ID NO: 45 - protein, 31 aa, synthetic construct
  REGION 1..31: note = Synthetic Construct
PFVNQHLCGSHLVEALYLVCGKRGFFYTRPT

SEQ ID NO: 46 - protein, 30 aa, synthetic construct
  REGION 1..30: note = Synthetic Construct
PFVNQHLCGSHLVEALYLVCGKRGFFYTRP

SEQ ID NO: 47 - protein, 31 aa, synthetic construct
  REGION 1..31: note = Synthetic Construct
PFVNQHLCGSHLVEALYLVCGKNGFFYTPRT

SEQ ID NO: 48 - protein, 31 aa, synthetic construct; identical to SEQ ID NO: 47
  REGION 1..31: note = Synthetic Construct

SEQ ID NO: 49 - protein, 30 aa, synthetic construct
  REGION 1..30: note = Synthetic Construct
PFVNQHLCGSHLVEALYLVCGKNGFFYTPR

SEQ ID NO: 50 - protein, 31 aa, synthetic construct
  REGION 1..31: note = Synthetic Construct
PFVNQHLCGSHLVEALYLVCGKNGFFYTRPT

SEQ ID NO: 51 - protein, 30 aa, synthetic construct
  REGION 1..30: note = Synthetic Construct
PFVNQHLCGSHLVEALYLVCGKNGFFYTRP

SEQ ID NO: 52 - protein, 31 aa, synthetic construct; identical to SEQ ID NO: 43
  REGION 1..31: note = Synthetic Construct

SEQ ID NO: 53 - protein, 31 aa, synthetic construct; identical to SEQ ID NO: 43
  REGION 1..31: note = Synthetic Construct

SEQ ID NO: 54 - protein, 30 aa, synthetic construct
  REGION 1..30: note = Synthetic Construct
PFVNQHLCGSHLVEALYLVCGKEGFFYTPR

SEQ ID NO: 55 - protein, 31 aa, synthetic construct
  REGION 1..31: note = Synthetic Construct
PFVNQHLCGSHLVEALYLVCGKEGFFYTRPT

SEQ ID NO: 56 - protein, 30 aa, synthetic construct
  REGION 1..30: note = Synthetic Construct
PFVNQHLCGSHLVEALYLVCGKEGFFYTRP

SEQ ID NO: 57 - protein, 30 aa, synthetic construct; identical to SEQ ID NO: 44
  REGION 1..30: note = Synthetic Construct

SEQ ID NO: 58 - protein, 30 aa, synthetic construct
  REGION 1..30: note = Synthetic Construct
PVNQHLCGSHLVEALYLVCGERGFFYTPKT

SEQ ID NO: 59 - protein, 30 aa, synthetic construct
  REGION 1..30: note = Synthetic Construct
PVNQHLCGSHLVEALYLVCGKRGFFYTPRT

SEQ ID NO: 60 - protein, 29 aa, synthetic construct
  REGION 1..29: note = Synthetic Construct
PVNQHLCGSHLVEALYLVCGKRGFFYTPR

SEQ ID NO: 61 - protein, 29 aa, synthetic construct
  REGION 1..29: note = Synthetic Construct
PNQHLCGSHLVEALYLVCGERGFFYTPKT

SEQ ID NO: 62 - protein, 29 aa, synthetic construct
  REGION 1..29: note = Synthetic Construct
PNQHLCGSHLVEALYLVCGKRGFFYTPRT

SEQ ID NO: 63 - protein, 28 aa, synthetic construct
  REGION 1..28: note = Synthetic Construct
PNQHLCGSHLVEALYLVCGKRGFFYTPR

SEQ ID NO: 64 - protein, 28 aa, synthetic construct
  REGION 1..28: note = Synthetic Construct
PQHLCGSHLVEALYLVCGERGFFYTPKT

SEQ ID NO: 65 - protein, 28 aa, synthetic construct
  REGION 1..28: note = Synthetic Construct
PQHLCGSHLVEALYLVCGKRGFFYTPRT

SEQ ID NO: 66 - protein, 27 aa, synthetic construct
  REGION 1..27: note = Synthetic Construct
PQHLCGSHLVEALYLVCGKRGFFYTPR

SEQ ID NO: 67 - protein, 31 aa, synthetic construct
  REGION 1..31: note = Synthetic Construct
PFVNQHLCGSHLVEALYLVCGERGFFYTKPT

SEQ ID NO: 68 - protein, 30 aa, synthetic construct
  REGION 1..30: note = Synthetic Construct
PFVNQHLCGSHLVEALYLVCGERGFFYTKP

SEQ ID NO: 69 - protein, 30 aa, synthetic construct
  REGION 1..30: note = Synthetic Construct
PVNQHLCGSHLVEALYLVCGERGFFYTKPT

SEQ ID NO: 70 - protein, 29 aa, synthetic construct
  REGION 1..29: note = Synthetic Construct
PVNQHLCGSHLVEALYLVCGERGFFYTKP

SEQ ID NO: 71 - protein, 29 aa, synthetic construct
  REGION 1..29: note = Synthetic Construct
PNQHLCGSHLVEALYLVCGERGFFYTKPT

SEQ ID NO: 72 - protein, 28 aa, synthetic construct
  REGION 1..28: note = Synthetic Construct
PNQHLCGSHLVEALYLVCGERGFFYTKP

SEQ ID NO: 73 - protein, 28 aa, synthetic construct
  REGION 1..28: note = Synthetic Construct
PQHLCGSHLVEALYLVCGERGFFYTKPT

SEQ ID NO: 74 - protein, 29 aa, synthetic construct
  REGION 1..29: note = Synthetic Construct
FVNQHLCGSHLVEALYLVCGERGFFYTPK

SEQ ID NO: 75 - protein, 4 aa, synthetic construct
  REGION 1..4: note = Synthetic Construct
AKAA

SEQ ID NO: 76 - protein, 4 aa, synthetic construct
  REGION 1..4: note = Synthetic Construct
AKAD

SEQ ID NO: 77 - protein, 4 aa, synthetic construct
  REGION 1..4: note = Synthetic Construct
AKAE

SEQ ID NO: 78 - protein, 4 aa, synthetic construct
  REGION 1..4: note = Synthetic Construct
AKAF

SEQ ID NO: 79 - protein, 4 aa, synthetic construct
  REGION 1..4: note = Synthetic Construct
AKAG

SEQ ID NO: 80 - protein, 4 aa, synthetic construct
  REGION 1..4: note = Synthetic Construct
AKAH

SEQ ID NO: 81 - protein, 4 aa, synthetic construct
  REGION 1..4: note = Synthetic Construct
AKAI

SEQ ID NO: 82 - protein, 4 aa, synthetic construct
  REGION 1..4: note = Synthetic Construct
AKAL

SEQ ID NO: 83 - protein, 4 aa, synthetic construct
  REGION 1..4: note = Synthetic Construct
AKAN

SEQ ID NO: 84 - protein, 4 aa, synthetic construct
  REGION 1..4: note = Synthetic Construct
AKAQ

SEQ ID NO: 85 - protein, 4 aa, synthetic construct
  REGION 1..4: note = Synthetic Construct
AKAR

SEQ ID NO: 86 - protein, 4 aa, synthetic construct
  REGION 1..4: note = Synthetic Construct
AKAS

SEQ ID NO: 87 - protein, 4 aa, synthetic construct
  REGION 1..4: note = Synthetic Construct
AKAT

SEQ ID NO: 88 - protein, 4 aa, synthetic construct
  REGION 1..4: note = Synthetic Construct
AKAY

SEQ ID NO: 89 - protein, 4 aa, synthetic construct
  REGION 1..4: note = Synthetic Construct
AKDA

SEQ ID NO: 90 - protein, 4 aa, synthetic construct
  REGION 1..4: note = Synthetic Construct
AKDD

SEQ ID NO: 91 - protein, 4 aa, synthetic construct
  REGION 1..4: note = Synthetic Construct
AKDE

SEQ ID NO: 92 - protein, 4 aa, synthetic construct
  REGION 1..4: note = Synthetic Construct
AKDF

SEQ ID NO: 93 - protein, 4 aa, synthetic construct
  REGION 1..4: note = Synthetic Construct
AKDG

SEQ ID NO: 94 - protein, 4 aa, synthetic construct
  REGION 1..4: note = Synthetic Construct
AKDH

SEQ ID NO: 95 - protein, 4 aa, synthetic construct
  REGION 1..4: note = Synthetic Construct
AKDI

SEQ ID NO: 96 - protein, 4 aa, synthetic construct
  REGION 1..4: note = Synthetic Construct
AKDL

SEQ ID NO: 97 - protein, 4 aa, synthetic construct
  REGION 1..4: note = Synthetic Construct
AKDN

SEQ ID NO: 98 - protein, 4 aa, synthetic construct
  REGION 1..4: note = Synthetic Construct
AKDQ

SEQ ID NO: 99 - protein, 4 aa, synthetic construct
  REGION 1..4: note = Synthetic Construct
AKDR

SEQ ID NO: 100 - protein, 4 aa, synthetic construct
  REGION 1..4: note = Synthetic Construct
AKDS

SEQ ID NO: 101 - protein, 4 aa, synthetic construct
  REGION 1..4: note = Synthetic Construct
AKDT

SEQ ID NO: 102 - protein, 4 aa, synthetic construct
  REGION 1..4: note = Synthetic Construct
AKDY

SEQ ID NO: 103 - protein, 4 aa, synthetic construct
  REGION 1..4: note = Synthetic Construct
AKEA

SEQ ID NO: 104 - protein, 4 aa, synthetic construct
  REGION 1..4: note = Synthetic Construct
AKED

SEQ ID NO: 105 - protein, 4 aa, synthetic construct
  REGION 1..4: note = Synthetic Construct
AKEE

SEQ ID NO: 106 - protein, 4 aa, synthetic construct
  REGION 1..4: note = Synthetic Construct
AKEF

SEQ ID NO: 107 - protein, 4 aa, synthetic construct
  REGION 1..4: note = Synthetic Construct
AKEG

SEQ ID NO: 108 - protein, 4 aa, synthetic construct
  REGION 1..4: note = Synthetic Construct
AKEH

SEQ ID NO: 109 - protein, 4 aa, synthetic construct
  REGION 1..4: note = Synthetic Construct
AKEI

SEQ ID NO: 110 - protein, 4 aa, synthetic construct
  REGION 1..4: note = Synthetic Construct
AKEL

SEQ ID NO: 111 - protein, 4 aa, synthetic construct
  REGION 1..4: note = Synthetic Construct
AKEN

SEQ ID NO: 112 - protein, 4 aa, synthetic construct
  REGION 1..4: note = Synthetic Construct
AKEQ

SEQ ID NO: 113 - protein, 4 aa, synthetic construct
  REGION 1..4: note = Synthetic Construct
AKER

SEQ ID NO: 114 - protein, 4 aa, synthetic construct
  REGION 1..4: note = Synthetic Construct
AKES

SEQ ID NO: 115 - protein, 4 aa, synthetic construct
  REGION 1..4: note = Synthetic Construct
AKET

SEQ ID NO: 116 - protein, 4 aa, synthetic construct
  REGION 1..4: note = Synthetic Construct
AKEY

SEQ ID NO: 117 - protein, 4 aa, synthetic construct
  REGION 1..4: note = Synthetic Construct
AKFA

SEQ ID NO: 118 - protein, 4 aa, synthetic construct
  REGION 1..4: note = Synthetic Construct
AKFD

SEQ ID NO: 119 - protein, 4 aa, synthetic construct
  REGION 1..4: note = Synthetic Construct
AKFE

SEQ ID NO: 120 - protein, 4 aa, synthetic construct
  REGION 1..4: note = Synthetic Construct
AKFF

SEQ ID NO: 121 - protein, 4 aa, synthetic construct
  REGION 1..4: note = Synthetic Construct
AKFG

SEQ ID NO: 122 - protein, 4 aa, synthetic construct
  REGION 1..4: note = Synthetic Construct
AKFH

SEQ ID NO: 123 - protein, 4 aa, synthetic construct
  REGION 1..4: note = Synthetic Construct
AKFI

SEQ ID NO: 124 - protein, 4 aa, synthetic construct
  REGION 1..4: note = Synthetic Construct
AKFL

SEQ ID NO: 125 - protein, 4 aa, synthetic construct
  REGION 1..4: note = Synthetic Construct
AKFN

SEQ ID NO: 126 - protein, 4 aa, synthetic construct
  REGION 1..4: note = Synthetic Construct
AKFQ

SEQ ID NO: 127 - protein, 4 aa, synthetic construct
  REGION 1..4: note = Synthetic Construct
AKFR

SEQ ID NO: 128 - protein, 4 aa, synthetic construct
  REGION 1..4: note = Synthetic Construct
AKFS

SEQ ID NO: 129 - protein, 4 aa, synthetic construct
  REGION 1..4: note = Synthetic Construct
AKFT

SEQ ID NO: 130 - protein, 4 aa, synthetic construct
  REGION 1..4: note = Synthetic Construct
AKFY

SEQ ID NO: 131 - protein, 4 aa, synthetic construct
  REGION 1..4: note = Synthetic Construct
AKGA

SEQ ID NO: 132 - protein, 4 aa, synthetic construct
  REGION 1..4: note = Synthetic Construct
AKGD

SEQ ID NO: 133 - protein, 4 aa, synthetic construct
  REGION 1..4: note = Synthetic Construct
AKGE

SEQ ID NO: 134 - protein, 4 aa, synthetic construct
  REGION 1..4: note = Synthetic Construct
AKGF

SEQ ID NO: 135 - protein, 4 aa, synthetic construct
  REGION 1..4: note = Synthetic Construct
AKGG

SEQ ID NO: 136 - protein, 4 aa, synthetic construct
  REGION 1..4: note = Synthetic Construct
AKGH

SEQ ID NO: 137 - protein, 4 aa, synthetic construct
  REGION 1..4: note = Synthetic Construct
AKGI

SEQ ID NO: 138 - protein, 4 aa, synthetic construct
  REGION 1..4: note = Synthetic Construct
AKGL

SEQ ID NO: 139 - protein, 4 aa, synthetic construct
  REGION 1..4: note = Synthetic Construct
AKGN

SEQ ID NO: 140 - protein, 4 aa, synthetic construct
  REGION 1..4: note = Synthetic Construct
AKGQ

SEQ ID NO: 141 - protein, 4 aa, synthetic construct
  REGION 1..4: note = Synthetic Construct
AKGR

SEQ ID NO: 142 - protein, 4 aa, synthetic construct
  REGION 1..4: note = Synthetic Construct
AKGS

SEQ ID NO: 143 - protein, 4 aa, synthetic construct
  REGION 1..4: note = Synthetic Construct
AKGT

SEQ ID NO: 144 - protein, 4 aa, synthetic construct
  REGION 1..4: note = Synthetic Construct
AKGY

SEQ ID NO: 145 - protein, 4 aa, synthetic construct
  REGION 1..4: note = Synthetic Construct
AKHA

SEQ ID NO: 146 - protein, 4 aa, synthetic construct
  REGION 1..4: note = Synthetic Construct
AKHD

SEQ ID NO: 147 - protein, 4 aa, synthetic construct
  REGION 1..4: note = Synthetic Construct
AKHE

SEQ ID NO: 148 - protein, 4 aa, synthetic construct
  REGION 1..4: note = Synthetic Construct
AKHF

SEQ ID NO: 149 - protein, 4 aa, synthetic construct
  REGION 1..4: note = Synthetic Construct
AKHG

SEQ ID NO: 150 - protein, 4 aa, synthetic construct
  REGION 1..4: note = Synthetic Construct
AKHH

SEQ ID NO: 151 - protein, 4 aa, synthetic construct
  REGION 1..4: note = Synthetic Construct
AKHI

SEQ ID NO: 152 - protein, 4 aa, synthetic construct
  REGION 1..4: note = Synthetic Construct
AKHL

SEQ ID NO: 153 - protein, 4 aa, synthetic construct
  REGION 1..4: note = Synthetic Construct
AKHN

SEQ ID NO: 154 - protein, 4 aa, synthetic construct
  REGION 1..4: note = Synthetic Construct
AKHQ

SEQ ID NO: 155 - protein, 4 aa, synthetic construct
  REGION 1..4: note = Synthetic Construct
AKHR

SEQ ID NO: 156 - protein, 4 aa, synthetic construct
  REGION 1..4: note = Synthetic Construct
AKHS

SEQ ID NO: 157 - protein, 4 aa, synthetic construct
  REGION 1..4: note = Synthetic Construct
AKHT

SEQ ID NO: 158 - protein, 4 aa, synthetic construct
  REGION 1..4: note = Synthetic Construct
AKHY

SEQ ID NO: 159 - protein, 4 aa, synthetic construct
  REGION 1..4: note = Synthetic Construct
AKIA

SEQ ID NO: 160 - protein, 4 aa, synthetic construct
  REGION 1..4: note = Synthetic Construct
AKID

SEQ ID NO: 161 - protein, 4 aa, synthetic construct
  REGION 1..4: note = Synthetic Construct
AKIE

SEQ ID NO: 162 - protein, 4 aa, synthetic construct
  REGION 1..4: note = Synthetic Construct
AKIF

SEQ ID NO: 163 - protein, 4 aa, synthetic construct
  REGION 1..4: note = Synthetic Construct
AKIG

SEQ ID NO: 164 - protein, 4 aa, synthetic construct
  REGION 1..4: note = Synthetic Construct
AKIH

SEQ ID NO: 165 - protein, 4 aa, synthetic construct
  REGION 1..4: note = Synthetic Construct
AKII

SEQ ID NO: 166 - protein, 4 aa, synthetic construct
  REGION 1..4: note = Synthetic Construct
AKIL

SEQ ID NO: 167 - protein, 4 aa, synthetic construct
  REGION 1..4: note = Synthetic Construct
AKIN

SEQ ID NO: 168 - protein, 4 aa, synthetic construct
  REGION 1..4: note = Synthetic Construct
AKIQ

SEQ ID NO: 169 - protein, 4 aa, synthetic construct
  REGION 1..4: note = Synthetic Construct
AKIR

SEQ ID NO: 170 - protein, 4 aa, synthetic construct
  REGION 1..4: note = Synthetic Construct
AKIS

SEQ ID NO: 171 - protein, 4 aa, synthetic construct
  REGION 1..4: note = Synthetic Construct
AKIT

SEQ ID NO: 172 - protein, 4 aa, synthetic construct
  REGION 1..4: note = Synthetic Construct
AKIY

SEQ ID NO: 173 - protein, 4 aa, synthetic construct
  REGION 1..4: note = Synthetic Construct
AKLA

SEQ ID NO: 174 - protein, 4 aa, synthetic construct
  REGION 1..4: note = Synthetic Construct
AKLD

SEQ ID NO: 175 - protein, 4 aa, synthetic construct
  REGION 1..4: note = Synthetic Construct
AKLE

SEQ ID NO: 176 - protein, 4 aa, synthetic construct
  REGION 1..4: note = Synthetic Construct
AKLF

SEQ ID NO: 177 - protein, 4 aa, synthetic construct
  REGION 1..4: note = Synthetic Construct
AKLG

SEQ ID NO: 178 - protein, 4 aa, synthetic construct
  REGION 1..4: note = Synthetic Construct
AKLH

SEQ ID NO: 179 - protein, 4 aa, synthetic construct
  REGION 1..4: note = Synthetic Construct
AKLI

SEQ ID NO: 180 - protein, 4 aa, synthetic construct
  REGION 1..4: note = Synthetic Construct
AKLL

SEQ ID NO: 181 - protein, 4 aa, synthetic construct
  REGION 1..4: note = Synthetic Construct
AKLN

SEQ ID NO: 182 - protein, 4 aa, synthetic construct
  REGION 1..4: note = Synthetic Construct
AKLQ

SEQ ID NO: 183 - protein, 4 aa, synthetic construct
  REGION 1..4: note = Synthetic Construct
AKLR

SEQ ID NO: 184 - protein, 4 aa, synthetic construct
  REGION 1..4: note = Synthetic Construct
AKLS

SEQ ID NO: 185 - protein, 4 aa, synthetic construct
  REGION 1..4: note = Synthetic Construct
AKLT

SEQ ID NO: 186 - protein, 4 aa, synthetic construct
  REGION 1..4: note = Synthetic Construct
AKLY

SEQ ID NO: 187 - protein, 4 aa, synthetic construct
  REGION 1..4: note = Synthetic Construct
AKNA

SEQ ID NO: 188 - protein, 4 aa, synthetic construct
  REGION 1..4: note = Synthetic Construct
AKND

SEQ ID NO: 189 - protein, 4 aa, synthetic construct
  REGION 1..4: note = Synthetic Construct
AKNE

SEQ ID NO: 190 - protein, 4 aa, synthetic construct
  REGION 1..4: note = Synthetic Construct
AKNF

SEQ ID NO: 191 - protein, 4 aa, synthetic construct
  REGION 1..4: note = Synthetic Construct
AKNG

SEQ ID NO: 192 - protein, 4 aa, synthetic construct
  REGION 1..4: note = Synthetic Construct
AKNH

SEQ ID NO: 193 - protein, 4 aa, synthetic construct
  REGION 1..4: note = Synthetic Construct
AKNI

SEQ ID NO: 194 - protein, 4 aa, synthetic construct
  REGION 1..4: note = Synthetic Construct
AKNL

SEQ ID NO: 195 - protein, 4 aa, synthetic construct
  REGION 1..4: note = Synthetic Construct
AKNN

SEQ ID NO: 196 - protein, 4 aa, synthetic construct
  REGION 1..4: note = Synthetic Construct
AKNQ

SEQ ID NO: 197 - protein, 4 aa, synthetic construct
  REGION 1..4: note = Synthetic Construct
AKNR

SEQ ID NO: 198 - protein, 4 aa, synthetic construct
  REGION 1..4: note = Synthetic Construct
AKNS

SEQ ID NO: 199 - protein, 4 aa, synthetic construct
  REGION 1..4: note = Synthetic Construct
AKNT

SEQ ID NO: 200 - protein, 4 aa, synthetic construct
  REGION 1..4: note = Synthetic Construct
AKNY

SEQ ID NO: 201 - protein, 4 aa, synthetic construct
  REGION 1..4: note = Synthetic Construct
AKPA

SEQ ID NO: 202 - protein, 4 aa, synthetic construct
  REGION 1..4: note = Synthetic Construct
AKPD

SEQ ID NO: 203 - protein, 4 aa, synthetic construct
  REGION 1..4: note = Synthetic Construct
AKPE

SEQ ID NO: 204 - protein, 4 aa, synthetic construct
  REGION 1..4: note = Synthetic Construct
AKPF

SEQ ID NO: 205 - protein, 4 aa, synthetic construct
  REGION 1..4: note = Synthetic Construct
AKPG

SEQ ID NO: 206 - protein, 4 aa, synthetic construct
  REGION 1..4: note = Synthetic Construct
AKPH

SEQ ID NO: 207 - protein, 4 aa, synthetic construct
  REGION 1..4: note = Synthetic Construct
AKPI

SEQ ID NO: 208 - protein, 4 aa, synthetic construct
  REGION 1..4: note = Synthetic Construct
AKPL

SEQ ID NO: 209 - protein, 4 aa, synthetic construct
  REGION 1..4: note = Synthetic Construct
AKPN

SEQ ID NO: 210 - protein, 4 aa, synthetic construct
  REGION 1..4: note = Synthetic Construct
AKPQ

SEQ ID NO: 211 - protein, 4 aa, synthetic construct
  REGION 1..4: note = Synthetic Construct
AKPR

SEQ ID NO: 212 - protein, 4 aa, synthetic construct
  REGION 1..4: note = Synthetic Construct
AKPS

SEQ ID NO: 213 - protein, 4 aa, synthetic construct
  REGION 1..4: note = Synthetic Construct
AKPT

SEQ ID NO: 214 - protein, 4 aa, synthetic construct
  REGION 1..4: note = Synthetic Construct
AKPY

SEQ ID NO: 215 - protein, 4 aa, synthetic construct
  REGION 1..4: note = Synthetic Construct
AKQA

SEQ ID NO: 216 - protein, 4 aa, synthetic construct
  REGION 1..4: note = Synthetic Construct
AKQD

SEQ ID NO: 217 - protein, 4 aa, synthetic construct
  REGION 1..4: note = Synthetic Construct
AKQE

SEQ ID NO: 218 - protein, 4 aa, synthetic construct
  REGION 1..4: note = Synthetic Construct
AKQF

SEQ ID NO: 219 - protein, 4 aa, synthetic construct
  REGION 1..4: note = Synthetic Construct
AKQG

SEQ ID NO: 220 - protein, 4 aa, synthetic construct
  REGION 1..4: note = Synthetic Construct
AKQH

SEQ ID NO: 221 - protein, 4 aa, synthetic construct
  REGION 1..4: note = Synthetic Construct
AKQI

SEQ ID NO: 222 - protein, 4 aa, synthetic construct
  REGION 1..4: note = Synthetic Construct
AKQL

SEQ ID NO: 223 - protein, 4 aa, synthetic construct
  REGION 1..4: note = Synthetic Construct
AKQN

SEQ ID NO: 224 - protein, 4 aa, synthetic construct
  REGION 1..4: note = Synthetic Construct
AKQQ

SEQ ID NO: 225 - protein, 4 aa, synthetic construct
  REGION 1..4: note = Synthetic Construct
AKQR

SEQ ID NO: 226 - protein, 4 aa, synthetic construct
  REGION 1..4: note = Synthetic Construct
AKQS

SEQ ID NO: 227 - protein, 4 aa, synthetic construct
  REGION 1..4: note = Synthetic Construct
AKQT

SEQ ID NO: 228 - protein, 4 aa, synthetic construct
  REGION 1..4: note = Synthetic Construct
AKQY

SEQ ID NO: 229 - protein, 4 aa, synthetic construct
  REGION 1..4: note = Synthetic Construct
AKRA

SEQ ID NO: 230 - protein, 4 aa, synthetic construct
  REGION 1..4: note = Synthetic Construct
AKRD

SEQ ID NO: 231 - protein, 4 aa, synthetic construct
  REGION 1..4: note = Synthetic Construct
AKRE

SEQ ID NO: 232 - protein, 4 aa, synthetic construct
  REGION 1..4: note = Synthetic Construct
AKRF

SEQ ID NO: 233 - protein, 4 aa, synthetic construct
  REGION 1..4: note = Synthetic Construct
AKRG

SEQ ID NO: 234 - protein, 4 aa, synthetic construct
  REGION 1..4: note = Synthetic Construct
AKRH

SEQ ID NO: 235 - protein, 4 aa, synthetic construct
  REGION 1..4: note = Synthetic Construct
AKRI

SEQ ID NO: 236 - protein, 4 aa, synthetic construct
  REGION 1..4: note = Synthetic Construct
AKRL

SEQ ID NO: 237 - protein, 4 aa, synthetic construct
  REGION 1..4: note = Synthetic Construct
AKRN

SEQ ID NO: 238 - protein, 4 aa, synthetic construct
  REGION 1..4: note = Synthetic Construct
AKRQ

SEQ ID NO: 239 - protein, 4 aa, synthetic construct
  REGION 1..4: note = Synthetic Construct
AKRR

SEQ ID NO: 240 - protein, 4 aa, synthetic construct
  REGION 1..4: note = Synthetic Construct
AKRS

SEQ ID NO: 241 - protein, 4 aa, synthetic construct
  REGION 1..4: note = Synthetic Construct
AKRT

SEQ ID NO: 242 - protein, 4 aa, synthetic construct
  REGION 1..4: note = Synthetic Construct
AKRY

SEQ ID NO: 243 - protein, 4 aa, synthetic construct
  REGION 1..4: note = Synthetic Construct
AKSA

SEQ ID NO: 244 - protein, 4 aa, synthetic construct
  REGION 1..4: note = Synthetic Construct
AKSD

SEQ ID NO: 245 - protein, 4 aa, synthetic construct
  REGION 1..4: note = Synthetic Construct
AKSE

SEQ ID NO: 246 - protein, 4 aa, synthetic construct
  REGION 1..4: note = Synthetic Construct
AKSF

SEQ ID NO: 247 - protein, 4 aa, synthetic construct
  REGION 1..4: note = Synthetic Construct
AKSG

SEQ ID NO: 248 - protein, 4 aa, synthetic construct
  REGION 1..4: note = Synthetic Construct
AKSH

SEQ ID NO: 249 - protein, 4 aa, synthetic construct
  REGION 1..4: note = Synthetic Construct
AKSI

SEQ ID NO: 250 - protein, 4 aa, synthetic construct
  REGION 1..4: note = Synthetic Construct
AKSL

SEQ ID NO: 251 - protein, 4 aa, synthetic construct
  REGION 1..4: note = Synthetic Construct
AKSN

SEQ ID NO: 252 - protein, 4 aa, synthetic construct
  REGION 1..4: note = Synthetic Construct
AKSQ

SEQ ID NO: 253 - protein, 4 aa, synthetic construct
  REGION 1..4: note = Synthetic Construct
AKSR

SEQ ID NO: 254 - protein, 4 aa, synthetic construct
  REGION 1..4: note = Synthetic Construct
AKSS

SEQ ID NO: 255 - protein, 4 aa, synthetic construct
  REGION 1..4: note = Synthetic Construct
AKST

SEQ ID NO: 256 - protein, 4 aa, synthetic construct
  REGION 1..4: note = Synthetic Construct
AKSY

SEQ ID NO: 257 - protein, 4 aa, synthetic construct
  REGION 1..4: note = Synthetic Construct
AKTA

SEQ ID NO: 258 - protein, 4 aa, synthetic construct
  REGION 1..4: note = Synthetic Construct
AKTD

SEQ ID NO: 259 - protein, 4 aa, synthetic construct
  REGION 1..4: note = Synthetic Construct
AKTE

SEQ ID NO: 260 - protein, 4 aa, synthetic construct
  REGION 1..4: note = Synthetic Construct
AKTF

SEQ ID NO: 261 - protein, 4 aa, synthetic construct
  REGION 1..4: note = Synthetic Construct
AKTG

SEQ ID NO: 262 - protein, 4 aa, synthetic construct
  REGION 1..4: note = Synthetic Construct
AKTH

SEQ ID NO: 263 - protein, 4 aa, synthetic construct
  REGION 1..4: note = Synthetic Construct
AKTI

SEQ ID NO: 264 - protein, 4 aa, synthetic construct
  REGION 1..4: note = Synthetic Construct
AKTL

SEQ ID NO: 265 - protein, 4 aa, synthetic construct
  REGION 1..4: note = Synthetic Construct
AKTN

SEQ ID NO: 266 - protein, 4 aa, synthetic construct
  REGION 1..4: note = Synthetic Construct
AKTQ

SEQ ID NO: 267 - protein, 4 aa, synthetic construct
  REGION 1..4: note = Synthetic Construct
AKTR

SEQ ID NO: 268 - protein, 4 aa, synthetic construct
  REGION 1..4: note = Synthetic Construct
AKTS

SEQ ID NO: 269 - protein, 4 aa, synthetic construct
  REGION 1..4: note = Synthetic Construct
AKTT

SEQ ID NO: 270 - protein, 4 aa, synthetic construct
  REGION 1..4: note = Synthetic Construct
AKTY

SEQ ID NO: 271 - protein, 4 aa, synthetic construct
  REGION 1..4: note = Synthetic Construct
AKYA

SEQ ID NO: 272 - protein, 4 aa, synthetic construct
  REGION 1..4: note = Synthetic Construct
AKYD

SEQ ID NO: 273 - protein, 4 aa, synthetic construct
  REGION 1..4: note = Synthetic Construct
AKYE

SEQ ID NO: 274 - protein, 4 aa, synthetic construct
  REGION 1..4: note = Synthetic Construct
AKYF

SEQ ID NO: 275 - protein, 4 aa, synthetic construct
  REGION 1..4: note = Synthetic Construct
AKYG

SEQ ID NO: 276 - protein, 4 aa, synthetic construct
  REGION 1..4: note = Synthetic Construct
AKYH

SEQ ID NO: 277 - protein, 4 aa, synthetic construct
  REGION 1..4: note = Synthetic Construct
AKYI

SEQ ID NO: 278 - protein, 4 aa, synthetic construct
  REGION 1..4: note = Synthetic Construct
AKYL

SEQ ID NO: 279 - protein, 4 aa, synthetic construct
  REGION 1..4: note = Synthetic Construct
AKYN

SEQ ID NO: 280 - protein, 4 aa, synthetic construct
  REGION 1..4: note = Synthetic Construct
AKYQ

SEQ ID NO: 281 - protein, 4 aa, synthetic construct
  REGION 1..4: note = Synthetic Construct
AKYR

SEQ ID NO: 282 - protein, 4 aa, synthetic construct
  REGION 1..4: note = Synthetic Construct
AKYS

SEQ ID NO: 283 - protein, 4 aa, synthetic construct
  REGION 1..4: note = Synthetic Construct
AKYT

SEQ ID NO: 284 - protein, 4 aa, synthetic construct
  REGION 1..4: note = Synthetic Construct
AKYY

SEQ ID NO: 285 - protein, 4 aa, synthetic construct
  REGION 1..4: note = Synthetic Construct
DKAA

SEQ ID NO: 286 - protein, 4 aa, synthetic construct
  REGION 1..4: note = Synthetic Construct
DKAD

SEQ ID NO: 287 - protein, 4 aa, synthetic construct
  REGION 1..4: note = Synthetic Construct
DKAE

SEQ ID NO: 288 - protein, 4 aa, synthetic construct
  REGION 1..4: note = Synthetic Construct
DKAF

SEQ ID NO: 289 - protein, 4 aa, synthetic construct
  REGION 1..4: note = Synthetic Construct
DKAG

SEQ ID NO: 290 - protein, 4 aa, synthetic construct
  REGION 1..4: note = Synthetic Construct
DKAH

SEQ ID NO: 291 - protein, 4 aa, synthetic construct
  REGION 1..4: note = Synthetic Construct
DKAI

SEQ ID NO: 292 - protein, 4 aa, synthetic construct
  REGION 1..4: note = Synthetic Construct
DKAL

SEQ ID NO: 293 - protein, 4 aa, synthetic construct
  REGION 1..4: note = Synthetic Construct
DKAN

SEQ ID NO: 294 - protein, 4 aa, synthetic construct
  REGION 1..4: note = Synthetic Construct
DKAQ

SEQ ID NO: 295 - protein, 4 aa, synthetic construct
  REGION 1..4: note = Synthetic Construct
DKAR

SEQ ID NO: 296 - protein, 4 aa, synthetic construct
  REGION 1..4: note = Synthetic Construct
DKAS

SEQ ID NO: 297 - protein, 4 aa, synthetic construct
  REGION 1..4: note = Synthetic Construct
DKAT

SEQ ID NO: 298 - protein, 4 aa, synthetic construct
  REGION 1..4: note = Synthetic Construct
DKAY

SEQ ID NO: 299 - protein, 4 aa, synthetic construct
  REGION 1..4: note = Synthetic Construct
DKDA

SEQ ID NO: 300 - protein, 4 aa, synthetic construct
  REGION 1..4: note = Synthetic Construct
DKDD

SEQ ID NO: 301 - protein, 4 aa, synthetic construct
  REGION 1..4: note = Synthetic Construct
DKDE

SEQ ID NO: 302 - protein, 4 aa, synthetic construct
  REGION 1..4: note = Synthetic Construct
DKDF

SEQ ID NO: 303 - protein, 4 aa, synthetic construct
  REGION 1..4: note = Synthetic Construct
DKDG

SEQ ID NO: 304 - protein, 4 aa, synthetic construct
  REGION 1..4: note = Synthetic Construct
DKDH

SEQ ID NO: 305 - protein, 4 aa, synthetic construct
  REGION 1..4: note = Synthetic Construct
DKDI

SEQ ID NO: 306 - protein, 4 aa, synthetic construct
  REGION 1..4: note = Synthetic Construct
DKDL

SEQ ID NO: 307 - protein, 4 aa, synthetic construct
  REGION 1..4: note = Synthetic Construct
DKDN

SEQ ID NO: 308 - protein, 4 aa, synthetic construct
  REGION 1..4: note = Synthetic Construct
DKDQ

SEQ ID NO: 309 - protein, 4 aa, synthetic construct
  REGION 1..4: note = Synthetic Construct
DKDR

SEQ ID NO: 310 - protein, 4 aa, synthetic construct
  REGION 1..4: note = Synthetic Construct
DKDS

SEQ ID NO: 311 - protein, 4 aa, synthetic construct
  REGION 1..4: note = Synthetic Construct
DKDT

SEQ ID NO: 312 - protein, 4 aa, synthetic construct
  REGION 1..4: note = Synthetic Construct
DKDY

SEQ ID NO: 313 - protein, 4 aa, synthetic construct
  REGION 1..4: note = Synthetic Construct
DKEA

SEQ ID NO: 314 - protein, 4 aa, synthetic construct
  REGION 1..4: note = Synthetic Construct
DKED

SEQ ID NO: 315 - protein, 4 aa, synthetic construct
  REGION 1..4: note = Synthetic Construct
DKEE

SEQ ID NO: 316 - protein, 4 aa, synthetic construct
  REGION 1..4: note = Synthetic Construct
DKEF

SEQ ID NO: 317 - protein, 4 aa, synthetic construct
  REGION 1..4: note = Synthetic Construct
DKEG

SEQ ID NO: 318 - protein, 4 aa, synthetic construct
  REGION 1..4: note = Synthetic Construct
DKEH

SEQ ID NO: 319 - protein, 4 aa, synthetic construct
  REGION 1..4: note = Synthetic Construct
DKEI

SEQ ID NO: 320 - protein, 4 aa, synthetic construct
  REGION 1..4: note = Synthetic Construct
DKEL

SEQ ID NO: 321 - protein, 4 aa, synthetic construct
  REGION 1..4: note = Synthetic Construct
DKEN

SEQ ID NO: 322 - protein, 4 aa, synthetic construct
  REGION 1..4: note = Synthetic Construct
DKEQ

SEQ ID NO: 323 - protein, 4 aa, synthetic construct
  REGION 1..4: note = Synthetic Construct
DKER

SEQ ID NO: 324 - protein, 4 aa, synthetic construct
  REGION 1..4: note = Synthetic Construct
DKES

SEQ ID NO: 325 - protein, 4 aa, synthetic construct
  REGION 1..4: note = Synthetic Construct
DKET

SEQ ID NO: 326 - protein, 4 aa, synthetic construct
  REGION 1..4: note = Synthetic Construct
DKEY

SEQ ID NO: 327 - protein, 4 aa, synthetic construct
  REGION 1..4: note = Synthetic Construct
DKFA

SEQ ID NO: 328 - protein, 4 aa, synthetic construct
  REGION 1..4: note = Synthetic Construct
DKFD

SEQ ID NO: 329 - protein, 4 aa, synthetic construct
  REGION 1..4: note = Synthetic Construct
DKFE

SEQ ID NO: 330 - protein, 4 aa, synthetic construct
  REGION 1..4: note = Synthetic Construct
DKFF

SEQ ID NO: 331 - protein, 4 aa, synthetic construct
  REGION 1..4: note = Synthetic Construct
DKFG

SEQ ID NO: 332 - protein, 4 aa, synthetic construct
  REGION 1..4: note = Synthetic Construct
DKFH

SEQ ID NO: 333 - protein, 4 aa, synthetic construct
  REGION 1..4: note = Synthetic Construct
DKFI

SEQ ID NO: 334 - protein, 4 aa, synthetic construct
  REGION 1..4: note = Synthetic Construct
DKFL

SEQ ID NO: 335 - protein, 4 aa, synthetic construct
  REGION 1..4: note = Synthetic Construct
DKFN

SEQ ID NO: 336 - protein, 4 aa, synthetic construct
  REGION 1..4: note = Synthetic Construct
DKFQ

SEQ ID NO: 337 - protein, 4 aa, synthetic construct
  REGION 1..4: note = Synthetic Construct
DKFR

SEQ ID NO: 338 - protein, 4 aa, synthetic construct
  REGION 1..4: note = Synthetic Construct
DKFS

SEQ ID NO: 339 - protein, 4 aa, synthetic construct
  REGION 1..4: note = Synthetic Construct
DKFT

SEQ ID NO: 340 - protein, 4 aa, synthetic construct
  REGION 1..4: note = Synthetic Construct
DKFY

SEQ ID NO: 341 - protein, 4 aa, synthetic construct
  REGION 1..4: note = Synthetic Construct
DKGA

SEQ ID NO: 342 - protein, 4 aa, synthetic construct
  REGION 1..4: note = Synthetic Construct
DKGD

SEQ ID NO: 343 - protein, 4 aa, synthetic construct
  REGION 1..4: note = Synthetic Construct
DKGE

SEQ ID NO: 344 - protein, 4 aa, synthetic construct
  REGION 1..4: note = Synthetic Construct
DKGF

SEQ ID NO: 345 - protein, 4 aa, synthetic construct
  REGION 1..4: note = Synthetic Construct
DKGG

SEQ ID NO: 346 - protein, 4 aa, synthetic construct
  REGION 1..4: note = Synthetic Construct
DKGH

SEQ ID NO: 347 - protein, 4 aa, synthetic construct
  REGION 1..4: note = Synthetic Construct
DKGI

SEQ ID NO: 348 - protein, 4 aa, synthetic construct
  REGION 1..4: note = Synthetic Construct
DKGL

SEQ ID NO: 349 - protein, 4 aa, synthetic construct
  REGION 1..4: note = Synthetic Construct
DKGN

SEQ ID NO: 350 - protein, 4 aa, synthetic construct
  REGION 1..4: note = Synthetic Construct
DKGQ

SEQ ID NO: 351 - protein, 4 aa, synthetic construct
  REGION 1..4: note = Synthetic Construct
DKGR

SEQ ID NO: 352 - protein, 4 aa, synthetic construct
  REGION 1..4: note = Synthetic Construct
DKGS

SEQ ID NO: 353 - protein, 4 aa, synthetic construct
  REGION 1..4: note = Synthetic Construct
DKGT

SEQ ID NO: 354 - protein, 4 aa, synthetic construct
  REGION 1..4: note = Synthetic Construct
DKGY

SEQ ID NO: 355 - protein, 4 aa, synthetic construct
  REGION 1..4: note = Synthetic Construct
DKHA

SEQ ID NO: 356 - protein, 4 aa, synthetic construct
  REGION 1..4: note = Synthetic Construct
DKHD

SEQ ID NO: 357 - protein, 4 aa, synthetic construct
  REGION 1..4: note = Synthetic Construct
DKHE

SEQ ID NO: 358 - protein, 4 aa, synthetic construct
  REGION 1..4: note = Synthetic Construct
DKHF

SEQ ID NO: 359 - protein, 4 aa, synthetic construct
  REGION 1..4: note = Synthetic Construct
DKHG

SEQ ID NO: 360 - protein, 4 aa, synthetic construct
  REGION 1..4: note = Synthetic Construct
DKHH

SEQ ID NO: 361 - protein, 4 aa, synthetic construct
  REGION 1..4: note = Synthetic Construct
DKHI

SEQ ID NO: 362 - protein, 4 aa, synthetic construct
  REGION 1..4: note = Synthetic Construct
DKHL

SEQ ID NO: 363 - protein, 4 aa, synthetic construct
  REGION 1..4: note = Synthetic Construct
DKHN

SEQ ID NO: 364 - protein, 4 aa, synthetic construct
  REGION 1..4: note = Synthetic Construct
DKHQ

SEQ ID NO: 365 - protein, 4 aa, synthetic construct
  REGION 1..4: note = Synthetic Construct
DKHR

SEQ ID NO: 366 - protein, 4 aa, synthetic construct
  REGION 1..4: note = Synthetic Construct
DKHS

SEQ ID NO: 367 - protein, 4 aa, synthetic construct
  REGION 1..4: note = Synthetic Construct
DKHT

SEQ ID NO: 368 - protein, 4 aa, synthetic construct
  REGION 1..4: note = Synthetic Construct
DKHY

SEQ ID NO: 369 - protein, 4 aa, synthetic construct
  REGION 1..4: note = Synthetic Construct
DKIA

SEQ ID NO: 370 - protein, 4 aa, synthetic construct
  REGION 1..4: note = Synthetic Construct
DKID

SEQ ID NO: 371 - protein, 4 aa, synthetic construct
  REGION 1..4: note = Synthetic Construct
DKIE

SEQ ID NO: 372 - protein, 4 aa, synthetic construct
  REGION 1..4: note = Synthetic Construct
DKIF

SEQ ID NO: 373 - protein, 4 aa, synthetic construct
  REGION 1..4: note = Synthetic Construct
DKIG

SEQ ID NO: 374 - protein, 4 aa, synthetic construct
  REGION 1..4: note = Synthetic Construct
DKIH

SEQ ID NO: 375 - protein, 4 aa, synthetic construct
  REGION 1..4: note = Synthetic Construct
DKII

SEQ ID NO: 376 - protein, 4 aa, synthetic construct
  REGION 1..4: note = Synthetic Construct
DKIL

SEQ ID NO: 377 - protein, 4 aa, synthetic construct
  REGION 1..4: note = Synthetic Construct
DKIN

SEQ ID NO: 378 - protein, 4 aa, synthetic construct
  REGION 1..4: note = Synthetic Construct
DKIQ

SEQ ID NO: 379 - protein, 4 aa, synthetic construct
  REGION 1..4: note = Synthetic Construct
DKIR

SEQ ID NO: 380 - protein, 4 aa, synthetic construct
  REGION 1..4: note = Synthetic Construct
DKIS

SEQ ID NO: 381 - protein, 4 aa, synthetic construct
  REGION 1..4: note = Synthetic Construct
DKIT

SEQ ID NO: 382 - protein, 4 aa, synthetic construct
  REGION 1..4: note = Synthetic Construct
DKIY

SEQ ID NO: 383 - protein, 4 aa, synthetic construct
  REGION 1..4: note = Synthetic Construct
DKLA

SEQ ID NO: 384 - protein, 4 aa, synthetic construct
  REGION 1..4: note = Synthetic Construct
DKLD

SEQ ID NO: 385 - protein, 4 aa, synthetic construct
  REGION 1..4: note = Synthetic Construct
DKLE

SEQ ID NO: 386 - protein, 4 aa, synthetic construct
  REGION 1..4: note = Synthetic Construct
DKLF

SEQ ID NO: 387 - protein, 4 aa, synthetic construct
  REGION 1..4: note = Synthetic Construct
DKLG

SEQ ID NO: 388 - protein, 4 aa, synthetic construct
  REGION 1..4: note = Synthetic Construct
DKLH

SEQ ID NO: 389 - protein, 4 aa, synthetic construct
  REGION 1..4: note = Synthetic Construct
DKLI

SEQ ID NO: 390 - protein, 4 aa, synthetic construct
  REGION 1..4: note = Synthetic Construct
DKLL

SEQ ID NO: 391 - protein, 4 aa, synthetic construct
  REGION 1..4: note = Synthetic Construct
DKLN

SEQ ID NO: 392 - protein, 4 aa, synthetic construct
  REGION 1..4: note = Synthetic Construct
DKLQ

SEQ ID NO: 393 - protein, 4 aa, synthetic construct
  REGION 1..4: note = Synthetic Construct
DKLR

SEQ ID NO: 394 - protein, 4 aa, synthetic construct
  REGION 1..4: note = Synthetic Construct
DKLS

SEQ ID NO: 395 - protein, 4 aa, synthetic construct
  REGION 1..4: note = Synthetic Construct
DKLT

SEQ ID NO: 396 - protein, 4 aa, synthetic construct
  REGION 1..4: note = Synthetic Construct
DKLY

SEQ ID NO: 397 - protein, 4 aa, synthetic construct
  REGION 1..4: note = Synthetic Construct
DKNA

SEQ ID NO: 398 - protein, 4 aa, synthetic construct
  REGION 1..4: note = Synthetic Construct
DKND

SEQ ID NO: 399 - protein, 4 aa, synthetic construct
  REGION 1..4: note = Synthetic Construct
DKNE

SEQ ID NO: 400 - protein, 4 aa, synthetic construct
  REGION 1..4: note = Synthetic Construct
DKNF

SEQ ID NO: 401 - protein, 4 aa, synthetic construct
  REGION 1..4: note = Synthetic Construct
DKNG

SEQ ID NO: 402 - protein, 4 aa, synthetic construct
  REGION 1..4: note = Synthetic Construct
DKNH

SEQ ID NO: 403 - protein, 4 aa, synthetic construct
  REGION 1..4: note = Synthetic Construct
DKNI

SEQ ID NO: 404 - protein, 4 aa, synthetic construct
  REGION 1..4: note = Synthetic Construct
DKNL

SEQ ID NO: 405 - protein, 4 aa, synthetic construct
  REGION 1..4: note = Synthetic Construct
DKNN

SEQ ID NO: 406 - protein, 4 aa, synthetic construct
  REGION 1..4: note = Synthetic Construct
DKNQ

SEQ ID NO: 407 - protein, 4 aa, synthetic construct
  REGION 1..4: note = Synthetic Construct
DKNR

SEQ ID NO: 408 - protein, 4 aa, synthetic construct
  REGION 1..4: note = Synthetic Construct
DKNS

SEQ ID NO: 409 - protein, 4 aa, synthetic construct
  REGION 1..4: note = Synthetic Construct
DKNT

SEQ ID NO: 410 - protein, 4 aa, synthetic construct
  REGION 1..4: note = Synthetic Construct
DKNY

SEQ ID NO: 411 - protein, 4 aa, synthetic construct
  REGION 1..4: note = Synthetic Construct
DKPA

SEQ ID NO: 412 - protein, 4 aa, synthetic construct
  REGION 1..4: note = Synthetic Construct
DKPD

SEQ ID NO: 413 - protein, 4 aa, synthetic construct
  REGION 1..4: note = Synthetic Construct
DKPE

SEQ ID NO: 414 - protein, 4 aa, synthetic construct
  REGION 1..4: note = Synthetic Construct
DKPF

SEQ ID NO: 415 - protein, 4 aa, synthetic construct
  REGION 1..4: note = Synthetic Construct
DKPG

SEQ ID NO: 416 - protein, 4 aa, synthetic construct
  REGION 1..4: note = Synthetic Construct
DKPH

SEQ ID NO: 417 - protein, 4 aa, synthetic construct
  REGION 1..4: note = Synthetic Construct
DKPI

SEQ ID NO: 418 - protein, 4 aa, synthetic construct
  REGION 1..4: note = Synthetic Construct
DKPL

SEQ ID NO: 419 - protein, 4 aa, synthetic construct
  REGION 1..4: note = Synthetic Construct
DKPN

SEQ ID NO: 420 - protein, 4 aa, synthetic construct
  REGION 1..4: note = Synthetic Construct
DKPQ

SEQ ID NO: 421 - protein, 4 aa, synthetic construct
  REGION 1..4: note = Synthetic Construct
DKPR

SEQ ID NO: 422 - protein, 4 aa, synthetic construct
  REGION 1..4: note = Synthetic Construct
DKPS

SEQ ID NO: 423 - protein, 4 aa, synthetic construct
  REGION 1..4: note = Synthetic Construct
DKPT

SEQ ID NO: 424 - protein, 4 aa, synthetic construct
  REGION 1..4: note = Synthetic Construct
DKPY

SEQ ID NO: 425 - protein, 4 aa, synthetic construct
  REGION 1..4: note = Synthetic Construct
DKQA

SEQ ID NO: 426 - protein, 4 aa, synthetic construct
  REGION 1..4: note = Synthetic Construct
DKQD

SEQ ID NO: 427 - protein, 4 aa, synthetic construct
  REGION 1..4: note = Synthetic Construct
DKQE

SEQ ID NO: 428 - protein, 4 aa, synthetic construct
  REGION 1..4: note = Synthetic Construct
DKQF

SEQ ID NO: 429 - protein, 4 aa, synthetic construct
  REGION 1..4: note = Synthetic Construct
DKQG

SEQ ID NO: 430 - protein, 4 aa, synthetic construct
  REGION 1..4: note = Synthetic Construct
DKQH

SEQ ID NO: 431 - protein, 4 aa, synthetic construct
  REGION 1..4: note = Synthetic Construct
DKQI

SEQ ID NO: 432 - protein, 4 aa, synthetic construct
  REGION 1..4: note = Synthetic Construct
DKQL

SEQ ID NO: 433 - protein, 4 aa, synthetic construct
  REGION 1..4: note = Synthetic Construct
DKQN

SEQ ID NO: 434 - protein, 4 aa, synthetic construct
  REGION 1..4: note = Synthetic Construct
DKQQ

SEQ ID NO: 435 - protein, 4 aa, synthetic construct
  REGION 1..4: note = Synthetic Construct
DKQR

SEQ ID NO: 436 - protein, 4 aa, synthetic construct
  REGION 1..4: note = Synthetic Construct
DKQS

SEQ ID NO: 437 - protein, 4 aa, synthetic construct
  REGION 1..4: note = Synthetic Construct
DKQT

SEQ ID NO: 438 - protein, 4 aa, synthetic construct
  REGION 1..4: note = Synthetic Construct
DKQY

SEQ ID NO: 439 - protein, 4 aa, synthetic construct
  REGION 1..4: note = Synthetic Construct
DKRA

SEQ ID NO: 440 - protein, 4 aa, synthetic construct
  REGION 1..4: note = Synthetic Construct
DKRD

SEQ ID NO: 441 - protein, 4 aa, synthetic construct
  REGION 1..4: note = Synthetic Construct
DKRE

SEQ ID NO: 442 - protein, 4 aa, synthetic construct
  REGION 1..4: note = Synthetic Construct
DKRF

SEQ ID NO: 443 - protein, 4 aa, synthetic construct
  REGION 1..4: note = Synthetic Construct
DKRG

SEQ ID NO: 444 - protein, 4 aa, synthetic construct
  REGION 1..4: note = Synthetic Construct
DKRH

SEQ ID NO: 445 - protein, 4 aa, synthetic construct
  REGION 1..4: note = Synthetic Construct
DKRI

SEQ ID NO: 446 - protein, 4 aa, synthetic construct
  REGION 1..4: note = Synthetic Construct
DKRL

SEQ ID NO: 447 - protein, 4 aa, synthetic construct
  REGION 1..4: note = Synthetic Construct
DKRN

SEQ ID NO: 448 - protein, 4 aa, synthetic construct
  REGION 1..4: note = Synthetic Construct
DKRQ

SEQ ID NO: 449 - protein, 4 aa, synthetic construct
  REGION 1..4: note = Synthetic Construct
DKRR

SEQ ID NO: 450 - protein, 4 aa, synthetic construct
  REGION 1..4: note = Synthetic Construct
DKRS

SEQ ID NO: 451 - protein, 4 aa, synthetic construct
  REGION 1..4: note = Synthetic Construct
DKRT

SEQ ID NO: 452 - protein, 4 aa, synthetic construct
  REGION 1..4: note = Synthetic Construct
DKRY

SEQ ID NO: 453 - protein, 4 aa, synthetic construct
  REGION 1..4: note = Synthetic Construct
DKSA

SEQ ID NO: 454 - protein, 4 aa, synthetic construct
  REGION 1..4: note = Synthetic Construct
DKSD

SEQ ID NO: 455 - protein, 4 aa, synthetic construct
  REGION 1..4: note = Synthetic Construct
DKSE

SEQ ID NO: 456 - protein, 4 aa, synthetic construct
  REGION 1..4: note = Synthetic Construct
DKSF

SEQ ID NO: 457 - protein, 4 aa, synthetic construct
  REGION 1..4: note = Synthetic Construct
DKSG

SEQ ID NO: 458 - protein, 4 aa, synthetic construct
  REGION 1..4: note = Synthetic Construct
DKSH

SEQ ID NO: 459 - protein, 4 aa, synthetic construct
  REGION 1..4: note = Synthetic Construct
DKSI

SEQ ID NO: 460 - protein, 4 aa, synthetic construct
  REGION 1..4: note = Synthetic Construct
DKSL

SEQ ID NO: 461 - protein, 4 aa, synthetic construct
  REGION 1..4: note = Synthetic Construct
DKSN

SEQ ID NO: 462 - protein, 4 aa, synthetic construct
  REGION 1..4: note = Synthetic Construct
DKSQ

SEQ ID NO: 463 - protein, 4 aa, synthetic construct
  REGION 1..4: note = Synthetic Construct
DKSR

SEQ ID NO: 464 - protein, 4 aa, synthetic construct
  REGION 1..4: note = Synthetic Construct
DKSS

SEQ ID NO: 465 - protein, 4 aa, synthetic construct
  REGION 1..4: note = Synthetic Construct
DKST

SEQ ID NO: 466 - protein, 4 aa, synthetic construct
  REGION 1..4: note = Synthetic Construct
DKSY

SEQ ID NO: 467 - protein, 4 aa, synthetic construct
  REGION 1..4: note = Synthetic Construct
DKTA

SEQ ID NO: 468 - protein, 4 aa, synthetic construct
  REGION 1..4: note = Synthetic Construct
DKTD

SEQ ID NO: 469 - protein, 4 aa, synthetic construct
  REGION 1..4: note = Synthetic Construct
DKTE

SEQ ID NO: 470 - protein, 4 aa, synthetic construct
  REGION 1..4: note = Synthetic Construct
DKTF

SEQ ID NO: 471 - protein, 4 aa, synthetic construct
  REGION 1..4: note = Synthetic Construct
DKTG

SEQ ID NO: 472 - protein, 4 aa, synthetic construct
  REGION 1..4: note = Synthetic Construct
DKTH

SEQ ID NO: 473 - protein, 4 aa, synthetic construct
  REGION 1..4: note = Synthetic Construct
DKTI

SEQ ID NO: 474 - protein, 4 aa, synthetic construct
  REGION 1..4: note = Synthetic Construct
DKTL

SEQ ID NO: 475 - protein, 4 aa, synthetic construct
  REGION 1..4: note = Synthetic Construct
DKTN

SEQ ID NO: 476 - protein, 4 aa, synthetic construct
  REGION 1..4: note = Synthetic Construct
DKTQ

SEQ ID NO: 477 - protein, 4 aa, synthetic construct
  REGION 1..4: note = Synthetic Construct
DKTR

SEQ ID NO: 478 - protein, 4 aa, synthetic construct
  REGION 1..4: note = Synthetic Construct
DKTS

SEQ ID NO: 479 - protein, 4 aa, synthetic construct
  REGION 1..4: note = Synthetic Construct
DKTT

SEQ ID NO: 480 - protein, 4 aa, synthetic construct
  REGION 1..4: note = Synthetic Construct
DKTY

SEQ ID NO: 481 - protein, 4 aa, synthetic construct
  REGION 1..4: note = Synthetic Construct
DKYA

SEQ ID NO: 482 - protein, 4 aa, synthetic construct
  REGION 1..4: note = Synthetic Construct
DKYD

SEQ ID NO: 483 - protein, 4 aa, synthetic construct
  REGION 1..4: note = Synthetic Construct
DKYE

SEQ ID NO: 484 - protein, 4 aa, synthetic construct
  REGION 1..4: note = Synthetic Construct
DKYF

SEQ ID NO: 485 - protein, 4 aa, synthetic construct
  REGION 1..4: note = Synthetic Construct
DKYG

SEQ ID NO: 486 - protein, 4 aa, synthetic construct
  REGION 1..4: note = Synthetic Construct
DKYH

SEQ ID NO: 487 - protein, 4 aa, synthetic construct
  REGION 1..4: note = Synthetic Construct
DKYI

SEQ ID NO: 488 - protein, 4 aa, synthetic construct
  REGION 1..4: note = Synthetic Construct
DKYL

SEQ ID NO: 489 - protein, 4 aa, synthetic construct
  REGION 1..4: note = Synthetic Construct
DKYN

SEQ ID NO: 490 - protein, 4 aa, synthetic construct
  REGION 1..4: note = Synthetic Construct
DKYQ

SEQ ID NO: 491 - protein, 4 aa, synthetic construct
  REGION 1..4: note = Synthetic Construct
DKYR

SEQ ID NO: 492 - protein, 4 aa, synthetic construct
  REGION 1..4: note = Synthetic Construct
DKYS

SEQ ID NO: 493 - protein, 4 aa, synthetic construct
  REGION 1..4: note = Synthetic Construct
DKYT

SEQ ID NO: 494 - protein, 4 aa, synthetic construct
  REGION 1..4: note = Synthetic Construct
DKYY

SEQ ID NO: 495 - protein, 4 aa, synthetic construct
  REGION 1..4: note = Synthetic Construct
EKAA

SEQ ID NO: 496 - protein, 4 aa, synthetic construct
  REGION 1..4: note = Synthetic Construct
EKAD

SEQ ID NO: 497 - protein, 4 aa, synthetic construct
  REGION 1..4: note = Synthetic Construct
EKAE

SEQ ID NO: 498 - protein, 4 aa, synthetic construct
  REGION 1..4: note = Synthetic Construct
EKAF

SEQ ID NO: 499 - protein, 4 aa, synthetic construct
  REGION 1..4: note = Synthetic Construct
EKAG

SEQ ID NO: 500 - protein, 4 aa, synthetic construct
  REGION 1..4: note = Synthetic Construct
EKAH

SEQ ID NO: 501 - protein, 4 aa, synthetic construct
  REGION 1..4: note = Synthetic Construct
EKAI

SEQ ID NO: 502 - protein, 4 aa, synthetic construct
  REGION 1..4: note = Synthetic Construct
EKAL

SEQ ID NO: 503 - protein, 4 aa, synthetic construct
  REGION 1..4: note = Synthetic Construct
EKAN

SEQ ID NO: 504 - protein, 4 aa, synthetic construct
  REGION 1..4: note = Synthetic Construct
EKAQ

SEQ ID NO: 505 - protein, 4 aa, synthetic construct
  REGION 1..4: note = Synthetic Construct
EKAR

SEQ ID NO: 506 - protein, 4 aa, synthetic construct
  REGION 1..4: note = Synthetic Construct
EKAS

SEQ ID NO: 507 - protein, 4 aa, synthetic construct
  REGION 1..4: note = Synthetic Construct
EKAT

SEQ ID NO: 508 - protein, 4 aa, synthetic construct
  REGION 1..4: note = Synthetic Construct
EKAY

SEQ ID NO: 509 - protein, 4 aa, synthetic construct
  REGION 1..4: note = Synthetic Construct
EKDA

SEQ ID NO: 510 - protein, 4 aa, synthetic construct
  REGION 1..4: note = Synthetic Construct
EKDD

SEQ ID NO: 511 - protein, 4 aa, synthetic construct
  REGION 1..4: note = Synthetic Construct
EKDE

SEQ ID NO: 512 - protein, 4 aa, synthetic construct
  REGION 1..4: note = Synthetic Construct
EKDF

SEQ ID NO: 513 - protein, 4 aa, synthetic construct
  REGION 1..4: note = Synthetic Construct
EKDG

SEQ ID NO: 514 - protein, 4 aa, synthetic construct
  REGION 1..4: note = Synthetic Construct
EKDH

SEQ ID NO: 515 - protein, 4 aa, synthetic construct
  REGION 1..4: note = Synthetic Construct
EKDI

SEQ ID NO: 516 - protein, 4 aa, synthetic construct
  REGION 1..4: note = Synthetic Construct
EKDL

SEQ ID NO: 517 - protein, 4 aa, synthetic construct
  REGION 1..4: note = Synthetic Construct
EKDN

SEQ ID NO: 518 - protein, 4 aa, synthetic construct
  REGION 1..4: note = Synthetic Construct
EKDQ

SEQ ID NO: 519 - protein, 4 aa, synthetic construct
  REGION 1..4: note = Synthetic Construct
EKDR

SEQ ID NO: 520 - protein, 4 aa, synthetic construct
  REGION 1..4: note = Synthetic Construct
EKDS

SEQ ID NO: 521 - protein, 4 aa, synthetic construct
  REGION 1..4: note = Synthetic Construct
EKDT

SEQ ID NO: 522 - protein, 4 aa, synthetic construct
  REGION 1..4: note = Synthetic Construct
EKDY

SEQ ID NO: 523 - protein, 4 aa, synthetic construct
  REGION 1..4: note = Synthetic Construct
EKEA

SEQ ID NO: 524 - protein, 4 aa, synthetic construct
  REGION 1..4: note = Synthetic Construct
EKED

SEQ ID NO: 525 - protein, 4 aa, synthetic construct
  REGION 1..4: note = Synthetic Construct
EKEE

SEQ ID NO: 526 - protein, 4 aa, synthetic construct
  REGION 1..4: note = Synthetic Construct
EKEF

SEQ ID NO: 527 - protein, 4 aa, synthetic construct
  REGION 1..4: note = Synthetic Construct
EKEG

SEQ ID NO: 528 - protein, 4 aa, synthetic construct
  REGION 1..4: note = Synthetic Construct
EKEH

SEQ ID NO: 529 - protein, 4 aa, synthetic construct
  REGION 1..4: note = Synthetic Construct
EKEI

SEQ ID NO: 530 - protein, 4 aa, synthetic construct
  REGION 1..4: note = Synthetic Construct
EKEL

SEQ ID NO: 531 - protein, 4 aa, synthetic construct
  REGION 1..4: note = Synthetic Construct
EKEN

SEQ ID NO: 532 - protein, 4 aa, synthetic construct
  REGION 1..4: note = Synthetic Construct
EKEQ

SEQ ID NO: 533 - protein, 4 aa, synthetic construct
  REGION 1..4: note = Synthetic Construct
EKER

SEQ ID NO: 534 - protein, 4 aa, synthetic construct
  REGION 1..4: note = Synthetic Construct
EKES

SEQ ID NO: 535 - protein, 4 aa, synthetic construct
  REGION 1..4: note = Synthetic Construct
EKET

SEQ ID NO: 536 - protein, 4 aa, synthetic construct
  REGION 1..4: note = Synthetic Construct
EKEY

SEQ ID NO: 537 - protein, 4 aa, synthetic construct
  REGION 1..4: note = Synthetic Construct
EKFA

SEQ ID NO: 538 - protein, 4 aa, synthetic construct
  REGION 1..4: note = Synthetic Construct
EKFD

SEQ ID NO: 539 - protein, 4 aa, synthetic construct
  REGION 1..4: note = Synthetic Construct
EKFE

SEQ ID NO: 540 - protein, 4 aa, synthetic construct
  REGION 1..4: note = Synthetic Construct
EKFF

SEQ ID NO: 541 - protein, 4 aa, synthetic construct
  REGION 1..4: note = Synthetic Construct
EKFG

SEQ ID NO: 542 - protein, 4 aa, synthetic construct
  REGION 1..4: note = Synthetic Construct
EKFH

SEQ ID NO: 543 - protein, 4 aa, synthetic construct
  REGION 1..4: note = Synthetic Construct
EKFI

SEQ ID NO: 544 - protein, 4 aa, synthetic construct
  REGION 1..4: note = Synthetic Construct
EKFL

SEQ ID NO: 545 - protein, 4 aa, synthetic construct
  REGION 1..4: note = Synthetic Construct
EKFN

SEQ ID NO: 546 - protein, 4 aa, synthetic construct
  REGION 1..4: note = Synthetic Construct
EKFQ

SEQ ID NO: 547 - protein, 4 aa, synthetic construct
  REGION 1..4: note = Synthetic Construct
EKFR

SEQ ID NO: 548 - protein, 4 aa, synthetic construct
  REGION 1..4: note = Synthetic Construct
EKFS

SEQ ID NO: 549 - protein, 4 aa, synthetic construct
  REGION 1..4: note = Synthetic Construct
EKFT

SEQ ID NO: 550 - protein, 4 aa, synthetic construct
  REGION 1..4: note = Synthetic Construct
EKFY

SEQ ID NO: 551 - protein, 4 aa, synthetic construct
  REGION 1..4: note = Synthetic Construct
EKGA

SEQ ID NO: 552 - protein, 4 aa, synthetic construct
  REGION 1..4: note = Synthetic Construct
EKGD

SEQ ID NO: 553 - protein, 4 aa, synthetic construct
  REGION 1..4: note = Synthetic Construct
EKGE

SEQ ID NO: 554 - protein, 4 aa, synthetic construct
  REGION 1..4: note = Synthetic Construct
EKGF

SEQ ID NO: 555 - protein, 4 aa, synthetic construct
  REGION 1..4: note = Synthetic Construct
EKGG

SEQ ID NO: 556 - protein, 4 aa, synthetic construct
  REGION 1..4: note = Synthetic Construct
EKGH

SEQ ID NO: 557 - protein, 4 aa, synthetic construct
  REGION 1..4: note = Synthetic Construct
EKGI

SEQ ID NO: 558 - protein, 4 aa, synthetic construct
  REGION 1..4: note = Synthetic Construct
EKGL

SEQ ID NO: 559 - protein, 4 aa, synthetic construct
  REGION 1..4: note = Synthetic Construct
EKGN

SEQ ID NO: 560 - protein, 4 aa, synthetic construct
  REGION 1..4: note = Synthetic Construct
EKGQ

SEQ ID NO: 561 - protein, 4 aa, synthetic construct
  REGION 1..4: note = Synthetic Construct
EKGR

SEQ ID NO: 562 - protein, 4 aa, synthetic construct
  REGION 1..4: note = Synthetic Construct
EKGS

SEQ ID NO: 563 - protein, 4 aa, synthetic construct
  REGION 1..4: note = Synthetic Construct
EKGT

SEQ ID NO: 564 - protein, 4 aa, synthetic construct
  REGION 1..4: note = Synthetic Construct
EKGY

SEQ ID NO: 565 - protein, 4 aa, synthetic construct
  REGION 1..4: note = Synthetic Construct
EKHA

SEQ ID NO: 566 - protein, 4 aa, synthetic construct
  REGION 1..4: note = Synthetic Construct
EKHD

SEQ ID NO: 567 - protein, 4 aa, synthetic construct
  REGION 1..4: note = Synthetic Construct
EKHE

SEQ ID NO: 568 - protein, 4 aa, synthetic construct
  REGION 1..4: note = Synthetic Construct
EKHF

SEQ ID NO: 569 - protein, 4 aa, synthetic construct
  REGION 1..4: note = Synthetic Construct
EKHG

SEQ ID NO: 570 - protein, 4 aa, synthetic construct
  REGION 1..4: note = Synthetic Construct
EKHH

SEQ ID NO: 571 - protein, 4 aa, synthetic construct
  REGION 1..4: note = Synthetic Construct
EKHI

SEQ ID NO: 572 - protein, 4 aa, synthetic construct
  REGION 1..4: note = Synthetic Construct
EKHL

SEQ ID NO: 573 - protein, 4 aa, synthetic construct
  REGION 1..4: note = Synthetic Construct
EKHN

SEQ ID NO: 574 - protein, 4 aa, synthetic construct
  REGION 1..4: note = Synthetic Construct
EKHQ

SEQ ID NO: 575 - protein, 4 aa, synthetic construct
  REGION 1..4: note = Synthetic Construct
EKHR

SEQ ID NO: 576 - protein, 4 aa, synthetic construct
  REGION 1..4: note = Synthetic Construct
EKHS

SEQ ID NO: 577 - protein, 4 aa, synthetic construct
  REGION 1..4: note = Synthetic Construct
EKHT

SEQ ID NO: 578 - protein, 4 aa, synthetic construct
  REGION 1..4: note = Synthetic Construct
EKHY

SEQ ID NO: 579 - protein, 4 aa, synthetic construct
  REGION 1..4: note = Synthetic Construct
EKIA

SEQ ID NO: 580 - protein, 4 aa, synthetic construct
  REGION 1..4: note = Synthetic Construct
EKID

SEQ ID NO: 581 - protein, 4 aa, synthetic construct
  REGION 1..4: note = Synthetic Construct
EKIE

SEQ ID NO: 582 - protein, 4 aa, synthetic construct
  REGION 1..4: note = Synthetic Construct
EKIF

SEQ ID NO: 583 - protein, 4 aa, synthetic construct
  REGION 1..4: note = Synthetic Construct
EKIG

SEQ ID NO: 584 - protein, 4 aa, synthetic construct
  REGION 1..4: note = Synthetic Construct
EKIH

SEQ ID NO: 585 - protein, 4 aa, synthetic construct
  REGION 1..4: note = Synthetic Construct
EKII

SEQ ID NO: 586 - protein, 4 aa, synthetic construct
  REGION 1..4: note = Synthetic Construct
EKIL

SEQ ID NO: 587 - protein, 4 aa, synthetic construct
  REGION 1..4: note = Synthetic Construct
EKIN

SEQ ID NO: 588 - protein, 4 aa, synthetic construct
  REGION 1..4: note = Synthetic Construct
EKIQ

SEQ ID NO: 589 - protein, 4 aa, synthetic construct
  REGION 1..4: note = Synthetic Construct
EKIR

SEQ ID NO: 590 - protein, 4 aa, synthetic construct
  REGION 1..4: note = Synthetic Construct
EKIS

SEQ ID NO: 591 - protein, 4 aa, synthetic construct
  REGION 1..4: note = Synthetic Construct
EKIT

SEQ ID NO: 592 - protein, 4 aa, synthetic construct
  REGION 1..4: note = Synthetic Construct
EKIY

SEQ ID NO: 593 - protein, 4 aa, synthetic construct
  REGION 1..4: note = Synthetic Construct
EKLA

SEQ ID NO: 594 - protein, 4 aa, synthetic construct
  REGION 1..4: note = Synthetic Construct
EKLD

SEQ ID NO: 595 - protein, 4 aa, synthetic construct
  REGION 1..4: note = Synthetic Construct
EKLE

SEQ ID NO: 596 - protein, 4 aa, synthetic construct
  REGION 1..4: note = Synthetic Construct
EKLF

SEQ ID NO: 597 - protein, 4 aa, synthetic construct
  REGION 1..4: note = Synthetic Construct
EKLG

SEQ ID NO: 598 - protein, 4 aa, synthetic construct
  REGION 1..4: note = Synthetic Construct
EKLH

SEQ ID NO: 599 - protein, 4 aa, synthetic construct
  REGION 1..4: note = Synthetic Construct
EKLI

SEQ ID NO: 600 - protein, 4 aa, synthetic construct
  REGION 1..4: note = Synthetic Construct
EKLL

SEQ ID NO: 601 - protein, 4 aa, synthetic construct
  REGION 1..4: note = Synthetic Construct
EKLN

SEQ ID NO: 602 - protein, 4 aa, synthetic construct
  REGION 1..4: note = Synthetic Construct
EKLQ

SEQ ID NO: 603 - protein, 4 aa, synthetic construct
  REGION 1..4: note = Synthetic Construct
EKLR

SEQ ID NO: 604 - protein, 4 aa, synthetic construct
  REGION 1..4: note = Synthetic Construct
EKLS

SEQ ID NO: 605 - protein, 4 aa, synthetic construct
  REGION 1..4: note = Synthetic Construct
EKLT

SEQ ID NO: 606 - protein, 4 aa, synthetic construct
  REGION 1..4: note = Synthetic Construct
EKLY

SEQ ID NO: 607 - protein, 4 aa, synthetic construct
  REGION 1..4: note = Synthetic Construct
EKNA

SEQ ID NO: 608 - protein, 4 aa, synthetic construct
  REGION 1..4: note = Synthetic Construct
EKND

SEQ ID NO: 609 - protein, 4 aa, synthetic construct
  REGION 1..4: note = Synthetic Construct
EKNE

SEQ ID NO: 610 - protein, 4 aa, synthetic construct
  REGION 1..4: note = Synthetic Construct
EKNF

SEQ ID NO: 611 - protein, 4 aa, synthetic construct
  REGION 1..4: note = Synthetic Construct
EKNG

SEQ ID NO: 612 - protein, 4 aa, synthetic construct
  REGION 1..4: note = Synthetic Construct
EKNH

SEQ ID NO: 613 - protein, 4 aa, synthetic construct
  REGION 1..4: note = Synthetic Construct
EKNI

SEQ ID NO: 614 - protein, 4 aa, synthetic construct
  REGION 1..4: note = Synthetic Construct
EKNL

SEQ ID NO: 615 - protein, 4 aa, synthetic construct
  REGION 1..4: note = Synthetic Construct
EKNN

SEQ ID NO: 616 - protein, 4 aa, synthetic construct
  REGION 1..4: note = Synthetic Construct
EKNQ

SEQ ID NO: 617 - protein, 4 aa, synthetic construct
  REGION 1..4: note = Synthetic Construct
EKNR

SEQ ID NO: 618 - protein, 4 aa, synthetic construct
  REGION 1..4: note = Synthetic Construct
EKNS

SEQ ID NO: 619 - protein, 4 aa, synthetic construct
  REGION 1..4: note = Synthetic Construct
EKNT

SEQ ID NO: 620 - protein, 4 aa, synthetic construct
  REGION 1..4: note = Synthetic Construct
EKNY

SEQ ID NO: 621 - protein, 4 aa, synthetic construct
  REGION 1..4: note = Synthetic Construct
EKPA

SEQ ID NO: 622 - protein, 4 aa, synthetic construct
  REGION 1..4: note = Synthetic Construct
EKPD

SEQ ID NO: 623 - protein, 4 aa, synthetic construct
  REGION 1..4: note = Synthetic Construct
EKPE

SEQ ID NO: 624 - protein, 4 aa, synthetic construct
  REGION 1..4: note = Synthetic Construct
EKPF

SEQ ID NO: 625 - protein, 4 aa, synthetic construct
  REGION 1..4: note = Synthetic Construct
EKPG

SEQ ID NO: 626 - protein, 4 aa, synthetic construct
  REGION 1..4: note = Synthetic Construct
EKPH

SEQ ID NO: 627 - protein, 4 aa, synthetic construct
  REGION 1..4: note = Synthetic Construct
EKPI

SEQ ID NO: 628 - protein, 4 aa, synthetic construct
  REGION 1..4: note = Synthetic Construct
EKPL

SEQ ID NO: 629 - protein, 4 aa, synthetic construct
  REGION 1..4: note = Synthetic Construct
EKPN

SEQ ID NO: 630 - protein, 4 aa, synthetic construct
  REGION 1..4: note = Synthetic Construct
EKPQ

SEQ ID NO: 631 - protein, 4 aa, synthetic construct
  REGION 1..4: note = Synthetic Construct
EKPR

SEQ ID NO: 632 - protein, 4 aa, synthetic construct
  REGION 1..4: note = Synthetic Construct
EKPS

SEQ ID NO: 633 - protein, 4 aa, synthetic construct
  REGION 1..4: note = Synthetic Construct
EKPT

SEQ ID NO: 634 - protein, 4 aa, synthetic construct
  REGION 1..4: note = Synthetic Construct
EKPY

SEQ ID NO: 635 - protein, 4 aa, synthetic construct
  REGION 1..4: note = Synthetic Construct
EKQA

SEQ ID NO: 636 - protein, 4 aa, synthetic construct
  REGION 1..4: note = Synthetic Construct
EKQD

SEQ ID NO: 637 - protein, 4 aa, synthetic construct
  REGION 1..4: note = Synthetic Construct
EKQE

SEQ ID NO: 638 - protein, 4 aa, synthetic construct
  REGION 1..4: note = Synthetic Construct
EKQF

SEQ ID NO: 639 - protein, 4 aa, synthetic construct
  REGION 1..4: note = Synthetic Construct
EKQG

SEQ ID NO: 640 - protein, 4 aa, synthetic construct
  REGION 1..4: note = Synthetic Construct
EKQH

SEQ ID NO: 641 - protein, 4 aa, synthetic construct
  REGION 1..4: note = Synthetic Construct
EKQI

SEQ ID NO: 642 - protein, 4 aa, synthetic construct
  REGION 1..4: note = Synthetic Construct
EKQL

SEQ ID NO: 643 - protein, 4 aa, synthetic construct
  REGION 1..4: note = Synthetic Construct
EKQN

SEQ ID NO: 644 - protein, 4 aa, synthetic construct
  REGION 1..4: note = Synthetic Construct
EKQQ

SEQ ID NO: 645 - protein, 4 aa, synthetic construct
  REGION 1..4: note = Synthetic Construct
EKQR

SEQ ID NO: 646 - protein, 4 aa, synthetic construct
  REGION 1..4: note = Synthetic Construct
EKQS

SEQ ID NO: 647 - protein, 4 aa, synthetic construct
  REGION 1..4: note = Synthetic Construct
EKQT

SEQ ID NO: 648 - protein, 4 aa, synthetic construct
  REGION 1..4: note = Synthetic Construct
EKQY

SEQ ID NO: 649 - protein, 4 aa, synthetic construct
  REGION 1..4: note = Synthetic Construct
EKRA

SEQ ID NO: 650 - protein, 4 aa, synthetic construct
  REGION 1..4: note = Synthetic Construct
EKRD

SEQ ID NO: 651 - protein, 4 aa, synthetic construct
  REGION 1..4: note = Synthetic Construct
EKRE

SEQ ID NO: 652 - protein, 4 aa, synthetic construct
  REGION 1..4: note = Synthetic Construct
EKRF

SEQ ID NO: 653 - protein, 4 aa, synthetic construct
  REGION 1..4: note = Synthetic Construct
EKRG

SEQ ID NO: 654 - protein, 4 aa, synthetic construct
  REGION 1..4: note = Synthetic Construct
EKRH

SEQ ID NO: 655 - protein, 4 aa, synthetic construct
  REGION 1..4: note = Synthetic Construct
EKRI

SEQ ID NO: 656 - protein, 4 aa, synthetic construct
  REGION 1..4: note = Synthetic Construct
EKRL

SEQ ID NO: 657 - protein, 4 aa, synthetic construct
  REGION 1..4: note = Synthetic Construct
EKRN

SEQ ID NO: 658 - protein, 4 aa, synthetic construct
  REGION 1..4: note = Synthetic Construct
EKRQ

SEQ ID NO: 659 - protein, 4 aa, synthetic construct
  REGION 1..4: note = Synthetic Construct
EKRR

SEQ ID NO: 660 - protein, 4 aa, synthetic construct
  REGION 1..4: note = Synthetic Construct
EKRS

SEQ ID NO: 661 - protein, 4 aa, synthetic construct
  REGION 1..4: note = Synthetic Construct
EKRT

SEQ ID NO: 662 - protein, 4 aa, synthetic construct
  REGION 1..4: note = Synthetic Construct
EKRY

SEQ ID NO: 663 - protein, 4 aa, synthetic construct
  REGION 1..4: note = Synthetic Construct
EKSA

SEQ ID NO: 664 - protein, 4 aa, synthetic construct
  REGION 1..4: note = Synthetic Construct
EKSD

SEQ ID NO: 665 - protein, 4 aa, synthetic construct
  REGION 1..4: note = Synthetic Construct
EKSE

SEQ ID NO: 666 - protein, 4 aa, synthetic construct
  REGION 1..4: note = Synthetic Construct
EKSF

SEQ ID NO: 667 - protein, 4 aa, synthetic construct
  REGION 1..4: note = Synthetic Construct
EKSG

SEQ ID NO: 668 - protein, 4 aa, synthetic construct
  REGION 1..4: note = Synthetic Construct
EKSH

SEQ ID NO: 669 - protein, 4 aa, synthetic construct
  REGION 1..4: note = Synthetic Construct
EKSI

SEQ ID NO: 670 - protein, 4 aa, synthetic construct
  REGION 1..4: note = Synthetic Construct
EKSL

SEQ ID NO: 671 - protein, 4 aa, synthetic construct
  REGION 1..4: note = Synthetic Construct
EKSN

SEQ ID NO: 672 - protein, 4 aa, synthetic construct
  REGION 1..4: note = Synthetic Construct
EKSQ

SEQ ID NO: 673 - protein, 4 aa, synthetic construct
  REGION 1..4: note = Synthetic Construct
EKSR

SEQ ID NO: 674 - protein, 4 aa, synthetic construct
  REGION 1..4: note = Synthetic Construct
EKSS

SEQ ID NO: 675 - protein, 4 aa, synthetic construct
  REGION 1..4: note = Synthetic Construct
EKST

SEQ ID NO: 676 - protein, 4 aa, synthetic construct
  REGION 1..4: note = Synthetic Construct
EKSY

SEQ ID NO: 677 - protein, 4 aa, synthetic construct
  REGION 1..4: note = Synthetic Construct
EKTA

SEQ ID NO: 678 - protein, 4 aa, synthetic construct
  REGION 1..4: note = Synthetic Construct
EKTD

SEQ ID NO: 679 - protein, 4 aa, synthetic construct
  REGION 1..4: note = Synthetic Construct
EKTE

SEQ ID NO: 680 - protein, 4 aa, synthetic construct
  REGION 1..4: note = Synthetic Construct
EKTF

SEQ ID NO: 681 - protein, 4 aa, synthetic construct
  REGION 1..4: note = Synthetic Construct
EKTG

SEQ ID NO: 682 - protein, 4 aa, synthetic construct
  REGION 1..4: note = Synthetic Construct
EKTH

SEQ ID NO: 683 - protein, 4 aa, synthetic construct
  REGION 1..4: note = Synthetic Construct
EKTI

SEQ ID NO: 684 - protein, 4 aa, synthetic construct
  REGION 1..4: note = Synthetic Construct
EKTL

SEQ ID NO: 685 - protein, 4 aa, synthetic construct
  REGION 1..4: note = Synthetic Construct
EKTN

SEQ ID NO: 686 - protein, 4 aa, synthetic construct
  REGION 1..4: note = Synthetic Construct
EKTQ

SEQ ID NO: 687 - protein, 4 aa, synthetic construct
  REGION 1..4: note = Synthetic Construct
EKTR

SEQ ID NO: 688 - protein, 4 aa, synthetic construct
  REGION 1..4: note = Synthetic Construct
EKTS

SEQ ID NO: 689 - protein, 4 aa, synthetic construct
  REGION 1..4: note = Synthetic Construct
EKTT

SEQ ID NO: 690 - protein, 4 aa, synthetic construct
  REGION 1..4: note = Synthetic Construct
EKTY

SEQ ID NO: 691 - protein, 4 aa, synthetic construct
  REGION 1..4: note = Synthetic Construct
EKYA

SEQ ID NO: 692 - protein, 4 aa, synthetic construct
  REGION 1..4: note = Synthetic Construct
EKYD

SEQ ID NO: 693 - protein, 4 aa, synthetic construct
  REGION 1..4: note = Synthetic Construct
EKYE

SEQ ID NO: 694 - protein, 4 aa, synthetic construct
  REGION 1..4: note = Synthetic Construct
EKYF

SEQ ID NO: 695 - protein, 4 aa, synthetic construct
  REGION 1..4: note = Synthetic Construct
EKYG

SEQ ID NO: 696 - protein, 4 aa, synthetic construct
  REGION 1..4: note = Synthetic Construct
EKYH

SEQ ID NO: 697 - protein, 4 aa, synthetic construct
  REGION 1..4: note = Synthetic Construct
EKYI

SEQ ID NO: 698 - protein, 4 aa, synthetic construct
  REGION 1..4: note = Synthetic Construct
EKYL

SEQ ID NO: 699 - protein, 4 aa, synthetic construct
  REGION 1..4: note = Synthetic Construct
EKYN

SEQ ID NO: 700 - protein, 4 aa, synthetic construct
  REGION 1..4: note = Synthetic Construct
EKYQ

SEQ ID NO: 701 - protein, 4 aa, synthetic construct
  REGION 1..4: note = Synthetic Construct
EKYR

SEQ ID NO: 702 - protein, 4 aa, synthetic construct
  REGION 1..4: note = Synthetic Construct
EKYS

SEQ ID NO: 703 - protein, 4 aa, synthetic construct
  REGION 1..4: note = Synthetic Construct
EKYT

SEQ ID NO: 704 - protein, 4 aa, synthetic construct
  REGION 1..4: note = Synthetic Construct
EKYY

SEQ ID NO: 705 - protein, 4 aa, synthetic construct
  REGION 1..4: note = Synthetic Construct
FKAA

SEQ ID NO: 706 - protein, 4 aa, synthetic construct
  REGION 1..4: note = Synthetic Construct
FKAD

SEQ ID NO: 707 - protein, 4 aa, synthetic construct
  REGION 1..4: note = Synthetic Construct
FKAE

SEQ ID NO: 708 - protein, 4 aa, synthetic construct
  REGION 1..4: note = Synthetic Construct
FKAF

SEQ ID NO: 709 - protein, 4 aa, synthetic construct
  REGION 1..4: note = Synthetic Construct
FKAG

SEQ ID NO: 710 - protein, 4 aa, synthetic construct
  REGION 1..4: note = Synthetic Construct
FKAH

SEQ ID NO: 711 - protein, 4 aa, synthetic construct
  REGION 1..4: note = Synthetic Construct
FKAI

SEQ ID NO: 712 - protein, 4 aa, synthetic construct
  REGION 1..4: note = Synthetic Construct
FKAL

SEQ ID NO: 713 - protein, 4 aa, synthetic construct
  REGION 1..4: note = Synthetic Construct
FKAN

SEQ ID NO: 714 - protein, 4 aa, synthetic construct
  REGION 1..4: note = Synthetic Construct
FKAQ

SEQ ID NO: 715 - protein, 4 aa, synthetic construct
  REGION 1..4: note = Synthetic Construct
FKAR

SEQ ID NO: 716 - protein, 4 aa, synthetic construct
  REGION 1..4: note = Synthetic Construct
FKAS

SEQ ID NO: 717 - protein, 4 aa, synthetic construct
  REGION 1..4: note = Synthetic Construct
FKAT

SEQ ID NO: 718 - protein, 4 aa, synthetic construct
  REGION 1..4: note = Synthetic Construct
FKAY

SEQ ID NO: 719 - protein, 4 aa, synthetic construct
  REGION 1..4: note = Synthetic Construct
FKDA

SEQ ID NO: 720 - protein, 4 aa, synthetic construct
  REGION 1..4: note = Synthetic Construct
FKDD

SEQ ID NO: 721 - protein, 4 aa, synthetic construct
  REGION 1..4: note = Synthetic Construct
FKDE

SEQ ID NO: 722 - protein, 4 aa, synthetic construct
  REGION 1..4: note = Synthetic Construct
FKDF

SEQ ID NO: 723 - protein, 4 aa, synthetic construct
  REGION 1..4: note = Synthetic Construct
FKDG

SEQ ID NO: 724 - protein, 4 aa, synthetic construct
  REGION 1..4: note = Synthetic Construct
FKDH

SEQ ID NO: 725 - protein, 4 aa, synthetic construct
  REGION 1..4: note = Synthetic Construct
FKDI

SEQ ID NO: 726 - protein, 4 aa, synthetic construct
  REGION 1..4: note = Synthetic Construct
FKDL

SEQ ID NO: 727 - protein, 4 aa, synthetic construct
  REGION 1..4: note = Synthetic Construct
FKDN

SEQ ID NO: 728 - protein, 4 aa, synthetic construct
  REGION 1..4: note = Synthetic Construct
FKDQ

SEQ ID NO: 729 - protein, 4 aa, synthetic construct
  REGION 1..4: note = Synthetic Construct
FKDR

SEQ ID NO: 730 - protein, 4 aa, synthetic construct
  REGION 1..4: note = Synthetic Construct
FKDS

SEQ ID NO: 731 - protein, 4 aa, synthetic construct
  REGION 1..4: note = Synthetic Construct
FKDT

SEQ ID NO: 732 - protein, 4 aa, synthetic construct
  REGION 1..4: note = Synthetic Construct
FKDY

SEQ ID NO: 733 - protein, 4 aa, synthetic construct
  REGION 1..4: note = Synthetic Construct
FKEA

SEQ ID NO: 734 - protein, 4 aa, synthetic construct
  REGION 1..4: note = Synthetic Construct
FKED

SEQ ID NO: 735 - protein, 4 aa, synthetic construct
  REGION 1..4: note = Synthetic Construct
FKEE

SEQ ID NO: 736 - protein, 4 aa, synthetic construct
  REGION 1..4: note = Synthetic Construct
FKEF

SEQ ID NO: 737 - protein, 4 aa, synthetic construct
  REGION 1..4: note = Synthetic Construct
FKEG

SEQ ID NO: 738 - protein, 4 aa, synthetic construct
  REGION 1..4: note = Synthetic Construct
FKEH

SEQ ID NO: 739 - protein, 4 aa, synthetic construct
  REGION 1..4: note = Synthetic Construct
FKEI

SEQ ID NO: 740 - protein, 4 aa, synthetic construct
  REGION 1..4: note = Synthetic Construct
FKEL

SEQ ID NO: 741 - protein, 4 aa, synthetic construct
  REGION 1..4: note = Synthetic Construct
FKEN

SEQ ID NO: 742 - protein, 4 aa, synthetic construct
  REGION 1..4: note = Synthetic Construct
FKEQ

SEQ ID NO: 743 - protein, 4 aa, synthetic construct
  REGION 1..4: note = Synthetic Construct
FKER

SEQ ID NO: 744 - protein, 4 aa, synthetic construct
  REGION 1..4: note = Synthetic Construct
FKES

SEQ ID NO: 745 - protein, 4 aa, synthetic construct
  REGION 1..4: note = Synthetic Construct
FKET

SEQ ID NO: 746 - protein, 4 aa, synthetic construct
  REGION 1..4: note = Synthetic Construct
FKEY

SEQ ID NO: 747 - protein, 4 aa, synthetic construct
  REGION 1..4: note = Synthetic Construct
FKFA

SEQ ID NO: 748 - protein, 4 aa, synthetic construct
  REGION 1..4: note = Synthetic Construct
FKFD

SEQ ID NO: 749 - protein, 4 aa, synthetic construct
  REGION 1..4: note = Synthetic Construct
FKFE

SEQ ID NO: 750 - protein, 4 aa, synthetic construct
  REGION 1..4: note = Synthetic Construct
FKFF

SEQ ID NO: 751 - protein, 4 aa, synthetic construct
  REGION 1..4: note = Synthetic Construct
FKFG

SEQ ID NO: 752 - protein, 4 aa, synthetic construct
  REGION 1..4: note = Synthetic Construct
FKFH

SEQ ID NO: 753 - protein, 4 aa, synthetic construct
  REGION 1..4: note = Synthetic Construct
FKFI

SEQ ID NO: 754 - protein, 4 aa, synthetic construct
  REGION 1..4: note = Synthetic Construct
FKFL

SEQ ID NO: 755 - protein, 4 aa, synthetic construct
  REGION 1..4: note = Synthetic Construct
FKFN

SEQ ID NO: 756 - protein, 4 aa, synthetic construct
  REGION 1..4: note = Synthetic Construct
FKFQ

SEQ ID NO: 757 - protein, 4 aa, synthetic construct
  REGION 1..4: note = Synthetic Construct
FKFR

SEQ ID NO: 758 - protein, 4 aa, synthetic construct
  REGION 1..4: note = Synthetic Construct
FKFS

SEQ ID NO: 759 - protein, 4 aa, synthetic construct
  REGION 1..4: note = Synthetic Construct
FKFT

SEQ ID NO: 760 - protein, 4 aa, synthetic construct
  REGION 1..4: note = Synthetic Construct
FKFY

SEQ ID NO: 761 - protein, 4 aa, synthetic construct
  REGION 1..4: note = Synthetic Construct
FKGA

SEQ ID NO: 762 - protein, 4 aa, synthetic construct
  REGION 1..4: note = Synthetic Construct
FKGD

SEQ ID NO: 763 - protein, 4 aa, synthetic construct
  REGION 1..4: note = Synthetic Construct
FKGE

SEQ ID NO: 764 - protein, 4 aa, synthetic construct
  REGION 1..4: note = Synthetic Construct
FKGF

SEQ ID NO: 765 - protein, 4 aa, synthetic construct
  REGION 1..4: note = Synthetic Construct
FKGG

SEQ ID NO: 766 - protein, 4 aa, synthetic construct
  REGION 1..4: note = Synthetic Construct
FKGH

SEQ ID NO: 767 - protein, 4 aa, synthetic construct
  REGION 1..4: note = Synthetic Construct
FKGI

SEQ ID NO: 768 - protein, 4 aa, synthetic construct
  REGION 1..4: note = Synthetic Construct
FKGL

SEQ ID NO: 769 - protein, 4 aa, synthetic construct
  REGION 1..4: note = Synthetic Construct
FKGN

SEQ ID NO: 770 - protein, 4 aa, synthetic construct
  REGION 1..4: note = Synthetic Construct
FKGQ

SEQ ID NO: 771 - protein, 4 aa, synthetic construct
  REGION 1..4: note = Synthetic Construct
FKGR

SEQ ID NO: 772 - protein, 4 aa, synthetic construct
  REGION 1..4: note = Synthetic Construct
FKGS

SEQ ID NO: 773 - protein, 4 aa, synthetic construct
  REGION 1..4: note = Synthetic Construct
FKGT

SEQ ID NO: 774 - protein, 4 aa, synthetic construct
  REGION 1..4: note = Synthetic Construct
FKGY

SEQ ID NO: 775 - protein, 4 aa, synthetic construct
  REGION 1..4: note = Synthetic Construct
FKHA

SEQ ID NO: 776 - protein, 4 aa, synthetic construct
  REGION 1..4: note = Synthetic Construct
FKHD

SEQ ID NO: 777 - protein, 4 aa, synthetic construct
  REGION 1..4: note = Synthetic Construct
FKHE

SEQ ID NO: 778 - protein, 4 aa, synthetic construct
  REGION 1..4: note = Synthetic Construct
FKHF

SEQ ID NO: 779 - protein, 4 aa, synthetic construct
  REGION 1..4: note = Synthetic Construct
FKHG

SEQ ID NO: 780 - protein, 4 aa, synthetic construct
  REGION 1..4: note = Synthetic Construct
FKHH

SEQ ID NO: 781 - protein, 4 aa, synthetic construct
  REGION 1..4: note = Synthetic Construct
FKHI

SEQ ID NO: 782 - protein, 4 aa, synthetic construct
  REGION 1..4: note = Synthetic Construct
FKHL

SEQ ID NO: 783 - protein, 4 aa, synthetic construct
  REGION 1..4: note = Synthetic Construct
FKHN

SEQ ID NO: 784 - protein, 4 aa, synthetic construct
  REGION 1..4: note = Synthetic Construct
FKHQ

SEQ ID NO: 785 - protein, 4 aa, synthetic construct
  REGION 1..4: note = Synthetic Construct
FKHR

SEQ ID NO: 786 - protein, 4 aa, synthetic construct
  REGION 1..4: note = Synthetic Construct
FKHS

SEQ ID NO: 787 - protein, 4 aa, synthetic construct
  REGION 1..4: note = Synthetic Construct
FKHT

SEQ ID NO: 788 - protein, 4 aa, synthetic construct
  REGION 1..4: note = Synthetic Construct
FKHY

SEQ ID NO: 789 - protein, 4 aa, synthetic construct
  REGION 1..4: note = Synthetic Construct
FKIA

SEQ ID NO: 790 - protein, 4 aa, synthetic construct
  REGION 1..4: note = Synthetic Construct
FKID

SEQ ID NO: 791 - protein, 4 aa, synthetic construct
  REGION 1..4: note = Synthetic Construct
FKIE

SEQ ID NO: 792 - protein, 4 aa, synthetic construct
  REGION 1..4: note = Synthetic Construct
FKIF

SEQ ID NO: 793 - protein, 4 aa, synthetic construct
  REGION 1..4: note = Synthetic Construct
FKIG

SEQ ID NO: 794 - protein, 4 aa, synthetic construct
  REGION 1..4: note = Synthetic Construct
FKIH

SEQ ID NO: 795 - protein, 4 aa, synthetic construct
  REGION 1..4: note = Synthetic Construct
FKII

SEQ ID NO: 796 - protein, 4 aa, synthetic construct
  REGION 1..4: note = Synthetic Construct
FKIL

SEQ ID NO: 797 - protein, 4 aa, synthetic construct
  REGION 1..4: note = Synthetic Construct
FKIN

SEQ ID NO: 798 - protein, 4 aa, synthetic construct
  REGION 1..4: note = Synthetic Construct
FKIQ

SEQ ID NO: 799 - protein, 4 aa, synthetic construct
  REGION 1..4: note = Synthetic Construct
FKIR

SEQ ID NO: 800 - protein, 4 aa, synthetic construct
  REGION 1..4: note = Synthetic Construct
FKIS

SEQ ID NO: 801 - protein, 4 aa, synthetic construct
  REGION 1..4: note = Synthetic Construct
FKIT

SEQ ID NO: 802 - protein, 4 aa, synthetic construct
  REGION 1..4: note = Synthetic Construct
FKIY

SEQ ID NO: 803 - protein, 4 aa, synthetic construct
  REGION 1..4: note = Synthetic Construct
FKLA

SEQ ID NO: 804 - protein, 4 aa, synthetic construct
  REGION 1..4: note = Synthetic Construct
FKLD

SEQ ID NO: 805 - protein, 4 aa, synthetic construct
  REGION 1..4: note = Synthetic Construct
FKLE

SEQ ID NO: 806 - protein, 4 aa, synthetic construct
  REGION 1..4: note = Synthetic Construct
FKLF

SEQ ID NO: 807 - protein, 4 aa, synthetic construct
  REGION 1..4: note = Synthetic Construct
FKLG

SEQ ID NO: 808 - protein, 4 aa, synthetic construct
  REGION 1..4: note = Synthetic Construct
FKLH

SEQ ID NO: 809 - protein, 4 aa, synthetic construct
  REGION 1..4: note = Synthetic Construct
FKLI

SEQ ID NO: 810 - protein, 4 aa, synthetic construct
  REGION 1..4: note = Synthetic Construct
FKLL

SEQ ID NO: 811 - protein, 4 aa, synthetic construct
  REGION 1..4: note = Synthetic Construct
FKLN

SEQ ID NO: 812 - protein, 4 aa, synthetic construct
  REGION 1..4: note = Synthetic Construct
FKLQ

SEQ ID NO: 813 - protein, 4 aa, synthetic construct
  REGION 1..4: note = Synthetic Construct
FKLR

SEQ ID NO: 814 - protein, 4 aa, synthetic construct
  REGION 1..4: note = Synthetic Construct
FKLS

SEQ ID NO: 815 - protein, 4 aa, synthetic construct
  REGION 1..4: note = Synthetic Construct
FKLT

SEQ ID NO: 816 - protein, 4 aa, synthetic construct
  REGION 1..4: note = Synthetic Construct
FKLY

SEQ ID NO: 817 - protein, 4 aa, synthetic construct
  REGION 1..4: note = Synthetic Construct
FKNA

SEQ ID NO: 818 - protein, 4 aa, synthetic construct
  REGION 1..4: note = Synthetic Construct
FKND

SEQ ID NO: 819 - protein, 4 aa, synthetic construct
  REGION 1..4: note = Synthetic Construct
FKNE

SEQ ID NO: 820 - protein, 4 aa, synthetic construct
  REGION 1..4: note = Synthetic Construct
FKNF

SEQ ID NO: 821 - protein, 4 aa, synthetic construct
  REGION 1..4: note = Synthetic Construct
FKNG

SEQ ID NO: 822 - protein, 4 aa, synthetic construct
  REGION 1..4: note = Synthetic Construct
FKNH

SEQ ID NO: 823 - protein, 4 aa, synthetic construct
  REGION 1..4: note = Synthetic Construct
FKNI

SEQ ID NO: 824 - protein, 4 aa, synthetic construct
  REGION 1..4: note = Synthetic Construct
FKNL

SEQ ID NO: 825 - protein, 4 aa, synthetic construct
  REGION 1..4: note = Synthetic Construct
FKNN

SEQ ID NO: 826 - protein, 4 aa, synthetic construct
  REGION 1..4: note = Synthetic Construct
FKNQ

SEQ ID NO: 827 - protein, 4 aa, synthetic construct
  REGION 1..4: note = Synthetic Construct
FKNR

SEQ ID NO: 828 - protein, 4 aa, synthetic construct
  REGION 1..4: note = Synthetic Construct
FKNS

SEQ ID NO: 829 - protein, 4 aa, synthetic construct
  REGION 1..4: note = Synthetic Construct
FKNT

SEQ ID NO: 830 - protein, 4 aa, synthetic construct
  REGION 1..4: note = Synthetic Construct
FKNY

SEQ ID NO: 831 - protein, 4 aa, synthetic construct
  REGION 1..4: note = Synthetic Construct
FKPA

SEQ ID NO: 832 - protein, 4 aa, synthetic construct
  REGION 1..4: note = Synthetic Construct
FKPD

SEQ ID NO: 833 - protein, 4 aa, synthetic construct
  REGION 1..4: note = Synthetic Construct
FKPE

SEQ ID NO: 834 - protein, 4 aa, synthetic construct
  REGION 1..4: note = Synthetic Construct
FKPF

SEQ ID NO: 835 - protein, 4 aa, synthetic construct
  REGION 1..4: note = Synthetic Construct
FKPG

SEQ ID NO: 836 - protein, 4 aa, synthetic construct
  REGION 1..4: note = Synthetic Construct
FKPH

SEQ ID NO: 837 - protein, 4 aa, synthetic construct
  REGION 1..4: note = Synthetic Construct
FKPI

SEQ ID NO: 838 - protein, 4 aa, synthetic construct
  REGION 1..4: note = Synthetic Construct
FKPL

SEQ ID NO: 839 - protein, 4 aa, synthetic construct
  REGION 1..4: note = Synthetic Construct
FKPN

SEQ ID NO: 840 - protein, 4 aa, synthetic construct
  REGION 1..4: note = Synthetic Construct
FKPQ

SEQ ID NO: 841 - protein, 4 aa, synthetic construct
  REGION 1..4: note = Synthetic Construct
FKPR

SEQ ID NO: 842 - protein, 4 aa, synthetic construct
  REGION 1..4: note = Synthetic Construct
FKPS

SEQ ID NO: 843 - protein, 4 aa, synthetic construct
  REGION 1..4: note = Synthetic Construct
FKPT

SEQ ID NO: 844 - protein, 4 aa, synthetic construct
  REGION 1..4: note = Synthetic Construct
FKPY

SEQ ID NO: 845 - protein, 4 aa, synthetic construct
  REGION 1..4: note = Synthetic Construct
FKQA

SEQ ID NO: 846 - protein, 4 aa, synthetic construct
  REGION 1..4: note = Synthetic Construct
FKQD

SEQ ID NO: 847 - protein, 4 aa, synthetic construct
  REGION 1..4: note = Synthetic Construct
FKQE

SEQ ID NO: 848 - protein, 4 aa, synthetic construct
  REGION 1..4: note = Synthetic Construct
FKQF

SEQ ID NO: 849 - protein, 4 aa, synthetic construct
  REGION 1..4: note = Synthetic Construct
FKQG

SEQ ID NO: 850 - protein, 4 aa, synthetic construct
  REGION 1..4: note = Synthetic Construct
FKQH

SEQ ID NO: 851 - protein, 4 aa, synthetic construct
  REGION 1..4: note = Synthetic Construct
FKQI

SEQ ID NO: 852 - protein, 4 aa, synthetic construct
  REGION 1..4: note = Synthetic Construct
FKQL

SEQ ID NO: 853 - protein, 4 aa, synthetic construct
  REGION 1..4: note = Synthetic Construct
FKQN

SEQ ID NO: 854 - protein, 4 aa, synthetic construct
  REGION 1..4: note = Synthetic Construct
FKQQ

SEQ ID NO: 855 - protein, 4 aa, synthetic construct
  REGION 1..4: note = Synthetic Construct
FKQR

SEQ ID NO: 856 - protein, 4 aa, synthetic construct
  REGION 1..4: note = Synthetic Construct
FKQS

SEQ ID NO: 857 - protein, 4 aa, synthetic construct
  REGION 1..4: note = Synthetic Construct
FKQT

SEQ ID NO: 858 - protein, 4 aa, synthetic construct
  REGION 1..4: note = Synthetic Construct
FKQY

SEQ ID NO: 859 - protein, 4 aa, synthetic construct
  REGION 1..4: note = Synthetic Construct
FKRA

SEQ ID NO: 860 - protein, 4 aa, synthetic construct
  REGION 1..4: note = Synthetic Construct
FKRD

SEQ ID NO: 861 - protein, 4 aa, synthetic construct
  REGION 1..4: note = Synthetic Construct
FKRE

SEQ ID NO: 862 - protein, 4 aa, synthetic construct
  REGION 1..4: note = Synthetic Construct
FKRF

SEQ ID NO: 863 - protein, 4 aa, synthetic construct
  REGION 1..4: note = Synthetic Construct
FKRG

SEQ ID NO: 864 - protein, 4 aa, synthetic construct
  REGION 1..4: note = Synthetic Construct
FKRH

SEQ ID NO: 865 - protein, 4 aa, synthetic construct
  REGION 1..4: note = Synthetic Construct
FKRI

SEQ ID NO: 866 - protein, 4 aa, synthetic construct
  REGION 1..4: note = Synthetic Construct
FKRL

SEQ ID NO: 867 - protein, 4 aa, synthetic construct
  REGION 1..4: note = Synthetic Construct
FKRN

SEQ ID NO: 868 - protein, 4 aa, synthetic construct
  REGION 1..4: note = Synthetic Construct
FKRQ

SEQ ID NO: 869 - protein, 4 aa, synthetic construct
  REGION 1..4: note = Synthetic Construct
FKRR

SEQ ID NO: 870 - protein, 4 aa, synthetic construct
  REGION 1..4: note = Synthetic Construct
FKRS

SEQ ID NO: 871 - protein, 4 aa, synthetic construct
  REGION 1..4: note = Synthetic Construct
FKRT

SEQ ID NO: 872 - protein, 4 aa, synthetic construct
  REGION 1..4: note = Synthetic Construct
FKRY

SEQ ID NO: 873 - protein, 4 aa, synthetic construct
  REGION 1..4: note = Synthetic Construct
FKSA

SEQ ID NO: 874 - protein, 4 aa, synthetic construct
  REGION 1..4: note = Synthetic Construct
FKSD

SEQ ID NO: 875 - protein, 4 aa, synthetic construct
  REGION 1..4: note = Synthetic Construct
FKSE

SEQ ID NO: 876 - protein, 4 aa, synthetic construct
  REGION 1..4: note = Synthetic Construct
FKSF

SEQ ID NO: 877 - protein, 4 aa, synthetic construct
  REGION 1..4: note = Synthetic Construct
FKSG

SEQ ID NO: 878 - protein, 4 aa, synthetic construct
  REGION 1..4: note = Synthetic Construct
FKSH

SEQ ID NO: 879 - protein, 4 aa, synthetic construct
  REGION 1..4: note = Synthetic Construct
FKSI

SEQ ID NO: 880 - protein, 4 aa, synthetic construct
  REGION 1..4: note = Synthetic Construct
FKSL

SEQ ID NO: 881 - protein, 4 aa, synthetic construct
  REGION 1..4: note = Synthetic Construct
FKSN

SEQ ID NO: 882 - protein, 4 aa, synthetic construct
  REGION 1..4: note = Synthetic Construct
FKSQ

SEQ ID NO: 883 - protein, 4 aa, synthetic construct
  REGION 1..4: note = Synthetic Construct
FKSR

SEQ ID NO: 884 - protein, 4 aa, synthetic construct
  REGION 1..4: note = Synthetic Construct
FKSS

SEQ ID NO: 885 - protein, 4 aa, synthetic construct
  REGION 1..4: note = Synthetic Construct
FKST

SEQ ID NO: 886 - protein, 4 aa, synthetic construct
  REGION 1..4: note = Synthetic Construct
FKSY

SEQ ID NO: 887 - protein, 4 aa, synthetic construct
  REGION 1..4: note = Synthetic Construct
FKTA

SEQ ID NO: 888 - protein, 4 aa, synthetic construct
  REGION 1..4: note = Synthetic Construct
FKTD

SEQ ID NO: 889 - protein, 4 aa, synthetic construct
  REGION 1..4: note = Synthetic Construct
FKTE

SEQ ID NO: 890 - protein, 4 aa, synthetic construct
  REGION 1..4: note = Synthetic Construct
FKTF

SEQ ID NO: 891 - protein, 4 aa, synthetic construct
  REGION 1..4: note = Synthetic Construct
FKTG

SEQ ID NO: 892 - protein, 4 aa, synthetic construct
  REGION 1..4: note = Synthetic Construct
FKTH

SEQ ID NO: 893 - protein, 4 aa, synthetic construct
  REGION 1..4: note = Synthetic Construct
FKTI

SEQ ID NO: 894 - protein, 4 aa, synthetic construct
  REGION 1..4: note = Synthetic Construct
FKTL

SEQ ID NO: 895 - protein, 4 aa, synthetic construct
  REGION 1..4: note = Synthetic Construct
FKTN

SEQ ID NO: 896 - protein, 4 aa, synthetic construct
  REGION 1..4: note = Synthetic Construct
FKTQ

SEQ ID NO: 897 - protein, 4 aa, synthetic construct
  REGION 1..4: note = Synthetic Construct
FKTR

SEQ ID NO: 898 - protein, 4 aa, synthetic construct
  REGION 1..4: note = Synthetic Construct
FKTS

SEQ ID NO: 899 - protein, 4 aa, synthetic construct
  REGION 1..4: note = Synthetic Construct
FKTT

SEQ ID NO: 900 - protein, 4 aa, synthetic construct
  REGION 1..4: note = Synthetic Construct
FKTY

SEQ ID NO: 901 - protein, 4 aa, synthetic construct
  REGION 1..4: note = Synthetic Construct
FKYA

SEQ ID NO: 902 - protein, 4 aa, synthetic construct
  REGION 1..4: note = Synthetic Construct
FKYD

SEQ ID NO: 903 - protein, 4 aa, synthetic construct
  REGION 1..4: note = Synthetic Construct
FKYE

SEQ ID NO: 904 - protein, 4 aa, synthetic construct
  REGION 1..4: note = Synthetic Construct
FKYF

SEQ ID NO: 905 - protein, 4 aa, synthetic construct
  REGION 1..4: note = Synthetic Construct
FKYG

SEQ ID NO: 906 - protein, 4 aa, synthetic construct
  REGION 1..4: note = Synthetic Construct
FKYH

SEQ ID NO: 907 - protein, 4 aa, synthetic construct
  REGION 1..4: note = Synthetic Construct
FKYI

SEQ ID NO: 908 - protein, 4 aa, synthetic construct
  REGION 1..4: note = Synthetic Construct
FKYL

SEQ ID NO: 909 - protein, 4 aa, synthetic construct
  REGION 1..4: note = Synthetic Construct
FKYN

SEQ ID NO: 910 - protein, 4 aa, synthetic construct
  REGION 1..4: note = Synthetic Construct
FKYQ

SEQ ID NO: 911 - protein, 4 aa, synthetic construct
  REGION 1..4: note = Synthetic Construct
FKYR

SEQ ID NO: 912 - protein, 4 aa, synthetic construct
  REGION 1..4: note = Synthetic Construct
FKYS

SEQ ID NO: 913 - protein, 4 aa, synthetic construct
  REGION 1..4: note = Synthetic Construct
FKYT

SEQ ID NO: 914 - protein, 4 aa, synthetic construct
  REGION 1..4: note = Synthetic Construct
FKYY

SEQ ID NO: 915 - protein, 4 aa, synthetic construct
  REGION 1..4: note = Synthetic Construct
GKAA

SEQ ID NO: 916 - protein, 4 aa, synthetic construct
  REGION 1..4: note = Synthetic Construct
GKAD

SEQ ID NO: 917 - protein, 4 aa, synthetic construct
  REGION 1..4: note = Synthetic Construct
GKAE

SEQ ID NO: 918 - protein, 4 aa, synthetic construct
  REGION 1..4: note = Synthetic Construct
GKAF

SEQ ID NO: 919 - protein, 4 aa, synthetic construct
  REGION 1..4: note = Synthetic Construct
GKAG

SEQ ID NO: 920 - protein, 4 aa, synthetic construct
  REGION 1..4: note = Synthetic Construct
GKAH

SEQ ID NO: 921 - protein, 4 aa, synthetic construct
  REGION 1..4: note = Synthetic Construct
GKAI

SEQ ID NO: 922 - protein, 4 aa, synthetic construct
  REGION 1..4: note = Synthetic Construct
GKAL

SEQ ID NO: 923 - protein, 4 aa, synthetic construct
  REGION 1..4: note = Synthetic Construct
GKAN

SEQ ID NO: 924 - protein, 4 aa, synthetic construct
  REGION 1..4: note = Synthetic Construct
GKAQ

SEQ ID NO: 925 - protein, 4 aa, synthetic construct
  REGION 1..4: note = Synthetic Construct
GKAR

SEQ ID NO: 926 - protein, 4 aa, synthetic construct
  REGION 1..4: note = Synthetic Construct
GKAS

SEQ ID NO: 927 - protein, 4 aa, synthetic construct
  REGION 1..4: note = Synthetic Construct
GKAT

SEQ ID NO: 928 - protein, 4 aa, synthetic construct
  REGION 1..4: note = Synthetic Construct
GKAY

SEQ ID NO: 929 - protein, 4 aa, synthetic construct
  REGION 1..4: note = Synthetic Construct
GKDA

SEQ ID NO: 930 - protein, 4 aa, synthetic construct
  REGION 1..4: note = Synthetic Construct
GKDD

SEQ ID NO: 931 - protein, 4 aa, synthetic construct
  REGION 1..4: note = Synthetic Construct
GKDE

SEQ ID NO: 932 - protein, 4 aa, synthetic construct
  REGION 1..4: note = Synthetic Construct
GKDF

SEQ ID NO: 933 - protein, 4 aa, synthetic construct
  REGION 1..4: note = Synthetic Construct
GKDG

SEQ ID NO: 934 - protein, 4 aa, synthetic construct
  REGION 1..4: note = Synthetic Construct
GKDH

SEQ ID NO: 935 - protein, 4 aa, synthetic construct
  REGION 1..4: note = Synthetic Construct
GKDI

SEQ ID NO: 936 - protein, 4 aa, synthetic construct
  REGION 1..4: note = Synthetic Construct
GKDL

SEQ ID NO: 937 - protein, 4 aa, synthetic construct
  REGION 1..4: note = Synthetic Construct
GKDN

SEQ ID NO: 938 - protein, 4 aa, synthetic construct
  REGION 1..4: note = Synthetic Construct
GKDQ

SEQ ID NO: 939 - protein, 4 aa, synthetic construct
  REGION 1..4: note = Synthetic Construct
GKDR

SEQ ID NO: 940 - protein, 4 aa, synthetic construct
  REGION 1..4: note = Synthetic Construct
GKDS

SEQ ID NO: 941 - protein, 4 aa, synthetic construct
  REGION 1..4: note = Synthetic Construct
GKDT

SEQ ID NO: 942 - protein, 4 aa, synthetic construct
  REGION 1..4: note = Synthetic Construct
GKDY

SEQ ID NO: 943 - protein, 4 aa, synthetic construct
  REGION 1..4: note = Synthetic Construct
GKEA

SEQ ID NO: 944 - protein, 4 aa, synthetic construct
  REGION 1..4: note = Synthetic Construct
GKED

SEQ ID NO: 945 - protein, 4 aa, synthetic construct
  REGION 1..4: note = Synthetic Construct
GKEE

SEQ ID NO: 946 - protein, 4 aa, synthetic construct
  REGION 1..4: note = Synthetic Construct
GKEF

SEQ ID NO: 947 - protein, 4 aa, synthetic construct
  REGION 1..4: note = Synthetic Construct
GKEG

SEQ ID NO: 948 - protein, 4 aa, synthetic construct
  REGION 1..4: note = Synthetic Construct
GKEH

SEQ ID NO: 949 - protein, 4 aa, synthetic construct
  REGION 1..4: note = Synthetic Construct
GKEI

SEQ ID NO: 950 - protein, 4 aa, synthetic construct
  REGION 1..4: note = Synthetic Construct
GKEL

SEQ ID NO: 951 - protein, 4 aa, synthetic construct
  REGION 1..4: note = Synthetic Construct
GKEN

SEQ ID NO: 952 - protein, 4 aa, synthetic construct
  REGION 1..4: note = Synthetic Construct
GKEQ

SEQ ID NO: 953 - protein, 4 aa, synthetic construct
  REGION 1..4: note = Synthetic Construct
GKER

SEQ ID NO: 954 - protein, 4 aa, synthetic construct
  REGION 1..4: note = Synthetic Construct
GKES

SEQ ID NO: 955 - protein, 4 aa, synthetic construct
  REGION 1..4: note = Synthetic Construct
GKET

SEQ ID NO: 956 - protein, 4 aa, synthetic construct
  REGION 1..4: note = Synthetic Construct
GKEY

SEQ ID NO: 957 - protein, 4 aa, synthetic construct
  REGION 1..4: note = Synthetic Construct
GKFA

SEQ ID NO: 958 - protein, 4 aa, synthetic construct
  REGION 1..4: note = Synthetic Construct
GKFD

SEQ ID NO: 959 - protein, 4 aa, synthetic construct
  REGION 1..4: note = Synthetic Construct
GKFE

SEQ ID NO: 960 - protein, 4 aa, synthetic construct
  REGION 1..4: note = Synthetic Construct
GKFF

SEQ ID NO: 961 - protein, 4 aa, synthetic construct
  REGION 1..4: note = Synthetic Construct
GKFG

SEQ ID NO: 962 - protein, 4 aa, synthetic construct
  REGION 1..4: note = Synthetic Construct
GKFH

SEQ ID NO: 963 - protein, 4 aa, synthetic construct
  REGION 1..4: note = Synthetic Construct
GKFI

SEQ ID NO: 964 - protein, 4 aa, synthetic construct
  REGION 1..4: note = Synthetic Construct
GKFL

SEQ ID NO: 965 - protein, 4 aa, synthetic construct
  REGION 1..4: note = Synthetic Construct
GKFN

SEQ ID NO: 966 - protein, 4 aa, synthetic construct
  REGION 1..4: note = Synthetic Construct
GKFQ

SEQ ID NO: 967 - protein, 4 aa, synthetic construct
  REGION 1..4: note = Synthetic Construct
GKFR

SEQ ID NO: 968 - protein, 4 aa, synthetic construct
  REGION 1..4: note = Synthetic Construct
GKFS

SEQ ID NO: 969 - protein, 4 aa, synthetic construct
  REGION 1..4: note = Synthetic Construct
GKFT

SEQ ID NO: 970 - protein, 4 aa, synthetic construct
  REGION 1..4: note = Synthetic Construct
GKFY

SEQ ID NO: 971 - protein, 4 aa, synthetic construct
  REGION 1..4: note = Synthetic Construct
GKGA

SEQ ID NO: 972 - protein, 4 aa, synthetic construct
  REGION 1..4: note = Synthetic Construct
GKGD

SEQ ID NO: 973 - protein, 4 aa, synthetic construct
  REGION 1..4: note = Synthetic Construct
GKGE

SEQ ID NO: 974 - protein, 4 aa, synthetic construct
  REGION 1..4: note = Synthetic Construct
GKGF

SEQ ID NO: 975 - protein, 4 aa, synthetic construct
  REGION 1..4: note = Synthetic Construct
GKGG

SEQ ID NO: 976 - protein, 4 aa, synthetic construct
  REGION 1..4: note = Synthetic Construct
GKGH

SEQ ID NO: 977 - protein, 4 aa, synthetic construct
  REGION 1..4: note = Synthetic Construct
GKGI

SEQ ID NO: 978 - protein, 4 aa, synthetic construct
  REGION 1..4: note = Synthetic Construct
GKGL

SEQ ID NO: 979 - protein, 4 aa, synthetic construct
  REGION 1..4: note = Synthetic Construct
GKGN

SEQ ID NO: 980 - protein, 4 aa, synthetic construct
  REGION 1..4: note = Synthetic Construct
GKGQ

SEQ ID NO: 981 - protein, 4 aa, synthetic construct
  REGION 1..4: note = Synthetic Construct
GKGR

SEQ ID NO: 982 - protein, 4 aa, synthetic construct
  REGION 1..4: note = Synthetic Construct
GKGS

SEQ ID NO: 983 - protein, 4 aa, synthetic construct
  REGION 1..4: note = Synthetic Construct
GKGT

SEQ ID NO: 984 - protein, 4 aa, synthetic construct
  REGION 1..4: note = Synthetic Construct
GKGY

SEQ ID NO: 985 - protein, 4 aa, synthetic construct
  REGION 1..4: note = Synthetic Construct
GKHA

SEQ ID NO: 986 - protein, 4 aa, synthetic construct
  REGION 1..4: note = Synthetic Construct
GKHD

SEQ ID NO: 987 - protein, 4 aa, synthetic construct
  REGION 1..4: note = Synthetic Construct
GKHE

SEQ ID NO: 988 - protein, 4 aa, synthetic construct
  REGION 1..4: note = Synthetic Construct
GKHF

SEQ ID NO: 989 - protein, 4 aa, synthetic construct
  REGION 1..4: note = Synthetic Construct
GKHG

SEQ ID NO: 990 - protein, 4 aa, synthetic construct
  REGION 1..4: note = Synthetic Construct
GKHH

SEQ ID NO: 991 - protein, 4 aa, synthetic construct
  REGION 1..4: note = Synthetic Construct
GKHI

SEQ ID NO: 992 - protein, 4 aa, synthetic construct
  REGION 1..4: note = Synthetic Construct
GKHL

SEQ ID NO: 993 - protein, 4 aa, synthetic construct
  REGION 1..4: note = Synthetic Construct
GKHN

SEQ ID NO: 994 - protein, 4 aa, synthetic construct
  REGION 1..4: note = Synthetic Construct
GKHQ

SEQ ID NO: 995 - protein, 4 aa, synthetic construct
  REGION 1..4: note = Synthetic Construct
GKHR

SEQ ID NO: 996 - protein, 4 aa, synthetic construct
  REGION 1..4: note = Synthetic Construct
GKHS

SEQ ID NO: 997 - protein, 4 aa, synthetic construct
  REGION 1..4: note = Synthetic Construct
GKHT

SEQ ID NO: 998 - protein, 4 aa, synthetic construct
  REGION 1..4: note = Synthetic Construct
GKHY

SEQ ID NO: 999 - protein, 4 aa, synthetic construct
  REGION 1..4: note = Synthetic Construct
GKIA

SEQ ID NO: 1000 - protein, 4 aa, synthetic construct
  REGION 1..4: note = Synthetic Construct
GKID

SEQ ID NO: 1001 - protein, 4 aa, synthetic construct
  REGION 1..4: note = Synthetic Construct
GKIE

SEQ ID NO: 1002 - protein, 4 aa, synthetic construct
  REGION 1..4: note = Synthetic Construct
GKIF

SEQ ID NO: 1003 - protein, 4 aa, synthetic construct
  REGION 1..4: note = Synthetic Construct
GKIG

SEQ ID NO: 1004 - protein, 4 aa, synthetic construct
  REGION 1..4: note = Synthetic Construct
GKIH

SEQ ID NO: 1005 - protein, 4 aa, synthetic construct
  REGION 1..4: note = Synthetic Construct
GKII

SEQ ID NO: 1006 - protein, 4 aa, synthetic construct
  REGION 1..4: note = Synthetic Construct
GKIL

SEQ ID NO: 1007 - protein, 4 aa, synthetic construct
  REGION 1..4: note = Synthetic Construct
GKIN

SEQ ID NO: 1008 - protein, 4 aa, synthetic construct
  REGION 1..4: note = Synthetic Construct
GKIQ

SEQ ID NO: 1009 - protein, 4 aa, synthetic construct
  REGION 1..4: note = Synthetic Construct
GKIR

SEQ ID NO: 1010 - protein, 4 aa, synthetic construct
  REGION 1..4: note = Synthetic Construct
GKIS

SEQ ID NO: 1011 - protein, 4 aa, synthetic construct
  REGION 1..4: note = Synthetic Construct
GKIT

SEQ ID NO: 1012 - protein, 4 aa, synthetic construct
  REGION 1..4: note = Synthetic Construct
GKIY

SEQ ID NO: 1013 - protein, 4 aa, synthetic construct
  REGION 1..4: note = Synthetic Construct
GKLA

SEQ ID NO: 1014 - protein, 4 aa, synthetic construct
  REGION 1..4: note = Synthetic Construct
GKLD

SEQ ID NO: 1015 - protein, 4 aa, synthetic construct
  REGION 1..4: note = Synthetic Construct
GKLE

SEQ ID NO: 1016 - protein, 4 aa, synthetic construct
  REGION 1..4: note = Synthetic Construct
GKLF

SEQ ID NO: 1017 - protein, 4 aa, synthetic construct
  REGION 1..4: note = Synthetic Construct
GKLG

SEQ ID NO: 1018 - protein, 4 aa, synthetic construct
  REGION 1..4: note = Synthetic Construct
GKLH

SEQ ID NO: 1019 - protein, 4 aa, synthetic construct
  REGION 1..4: note = Synthetic Construct
GKLI

SEQ ID NO: 1020 - protein, 4 aa, synthetic construct
  REGION 1..4: note = Synthetic Construct
GKLL

SEQ ID NO: 1021 - protein, 4 aa, synthetic construct
  REGION 1..4: note = Synthetic Construct
GKLN

SEQ ID NO: 1022 - protein, 4 aa, synthetic construct
  REGION 1..4: note = Synthetic Construct
GKLQ

SEQ ID NO: 1023 - protein, 4 aa, synthetic construct
  REGION 1..4: note = Synthetic Construct
GKLR

SEQ ID NO: 1024 - protein, 4 aa, synthetic construct
  REGION 1..4: note = Synthetic Construct
GKLS

SEQ ID NO: 1025 - protein, 4 aa, synthetic construct
  REGION 1..4: note = Synthetic Construct
GKLT

SEQ ID NO: 1026 - protein, 4 aa, synthetic construct
  REGION 1..4: note = Synthetic Construct
GKLY

SEQ ID NO: 1027 - protein, 4 aa, synthetic construct
  REGION 1..4: note = Synthetic Construct
GKNA

SEQ ID NO: 1028 - protein, 4 aa, synthetic construct
  REGION 1..4: note = Synthetic Construct
GKND

SEQ ID NO: 1029 - protein, 4 aa, synthetic construct
  REGION 1..4: note = Synthetic Construct
GKNE

SEQ ID NO: 1030 - protein, 4 aa, synthetic construct
  REGION 1..4: note = Synthetic Construct
GKNF

SEQ ID NO: 1031 - protein, 4 aa, synthetic construct
  REGION 1..4: note = Synthetic Construct
GKNG

SEQ ID NO: 1032 - protein, 4 aa, synthetic construct
  REGION 1..4: note = Synthetic Construct
GKNH

SEQ ID NO: 1033 - protein, 4 aa, synthetic construct
  REGION 1..4: note = Synthetic Construct
GKNI

SEQ ID NO: 1034 - protein, 4 aa, synthetic construct
  REGION 1..4: note = Synthetic Construct
GKNL

SEQ ID NO: 1035 - protein, 4 aa, synthetic construct
  REGION 1..4: note = Synthetic Construct
GKNN

SEQ ID NO: 1036 - protein, 4 aa, synthetic construct
  REGION 1..4: note = Synthetic Construct
GKNQ

SEQ ID NO: 1037 - protein, 4 aa, synthetic construct
  REGION 1..4: note = Synthetic Construct
GKNR

SEQ ID NO: 1038 - protein, 4 aa, synthetic construct
  REGION 1..4: note = Synthetic Construct
GKNS

SEQ ID NO: 1039 - protein, 4 aa, synthetic construct
  REGION 1..4: note = Synthetic Construct
GKNT

SEQ ID NO: 1040 - protein, 4 aa, synthetic construct
  REGION 1..4: note = Synthetic Construct
GKNY

SEQ ID NO: 1041 - protein, 4 aa, synthetic construct
  REGION 1..4: note = Synthetic Construct
GKPA

SEQ ID NO: 1042 - protein, 4 aa, synthetic construct
  REGION 1..4: note = Synthetic Construct
GKPD

SEQ ID NO: 1043 - protein, 4 aa, synthetic construct
  REGION 1..4: note = Synthetic Construct
GKPE

SEQ ID NO: 1044 - protein, 4 aa, synthetic construct
  REGION 1..4: note = Synthetic Construct
GKPF

SEQ ID NO: 1045 - protein, 4 aa, synthetic construct
  REGION 1..4: note = Synthetic Construct
GKPG

SEQ ID NO: 1046 - protein, 4 aa, synthetic construct
  REGION 1..4: note = Synthetic Construct
GKPH

SEQ ID NO: 1047 - protein, 4 aa, synthetic construct
  REGION 1..4: note = Synthetic Construct
GKPI

SEQ ID NO: 1048 - protein, 4 aa, synthetic construct
  REGION 1..4: note = Synthetic Construct
GKPL

SEQ ID NO: 1049 - protein, 4 aa, synthetic construct
  REGION 1..4: note = Synthetic Construct
GKPN

SEQ ID NO: 1050 - protein, 4 aa, synthetic construct
  REGION 1..4: note = Synthetic Construct
GKPQ

SEQ ID NO: 1051 - protein, 4 aa, synthetic construct
  REGION 1..4: note = Synthetic Construct
GKPR

SEQ ID NO: 1052 - protein, 4 aa, synthetic construct
  REGION 1..4: note = Synthetic Construct
GKPS

SEQ ID NO: 1053 - protein, 4 aa, synthetic construct
  REGION 1..4: note = Synthetic Construct
GKPT

SEQ ID NO: 1054 - protein, 4 aa, synthetic construct
  REGION 1..4: note = Synthetic Construct
GKPY

SEQ ID NO: 1055 - protein, 4 aa, synthetic construct
  REGION 1..4: note = Synthetic Construct
GKQA

SEQ ID NO: 1056 - protein, 4 aa, synthetic construct
  REGION 1..4: note = Synthetic Construct
GKQD

SEQ ID NO: 1057 - protein, 4 aa, synthetic construct
  REGION 1..4: note = Synthetic Construct
GKQE

SEQ ID NO: 1058 - protein, 4 aa, synthetic construct
  REGION 1..4: note = Synthetic Construct
GKQF

SEQ ID NO: 1059 - protein, 4 aa, synthetic construct
  REGION 1..4: note = Synthetic Construct
GKQG

SEQ ID NO: 1060 - protein, 4 aa, synthetic construct
  REGION 1..4: note = Synthetic Construct
GKQH

SEQ ID NO: 1061 - protein, 4 aa, synthetic construct
  REGION 1..4: note = Synthetic Construct
GKQI

SEQ ID NO: 1062 - protein, 4 aa, synthetic construct
  REGION 1..4: note = Synthetic Construct
GKQL

SEQ ID NO: 1063 - protein, 4 aa, synthetic construct
  REGION 1..4: note = Synthetic Construct
GKQN

SEQ ID NO: 1064 - protein, 4 aa, synthetic construct
  REGION 1..4: note = Synthetic Construct
GKQQ

SEQ ID NO: 1065 - protein, 4 aa, synthetic construct
  REGION 1..4: note = Synthetic Construct
GKQR

SEQ ID NO: 1066 - protein, 4 aa, synthetic construct
  REGION 1..4: note = Synthetic Construct
GKQS

SEQ ID NO: 1067 - protein, 4 aa, synthetic construct
  REGION 1..4: note = Synthetic Construct
GKQT

SEQ ID NO: 1068 - protein, 4 aa, synthetic construct
  REGION 1..4: note = Synthetic Construct
GKQY

SEQ ID NO: 1069 - protein, 4 aa, synthetic construct
  REGION 1..4: note = Synthetic Construct
GKRA

SEQ ID NO: 1070 - protein, 4 aa, synthetic construct
  REGION 1..4: note = Synthetic Construct
GKRD

SEQ ID NO: 1071 - protein, 4 aa, synthetic construct
  REGION 1..4: note = Synthetic Construct
GKRE

SEQ ID NO: 1072 - protein, 4 aa, synthetic construct
  REGION 1..4: note = Synthetic Construct
GKRF

SEQ ID NO: 1073 - protein, 4 aa, synthetic construct
  REGION 1..4: note = Synthetic Construct
GKRG

SEQ ID NO: 1074 - protein, 4 aa, synthetic construct
  REGION 1..4: note = Synthetic Construct
GKRH

SEQ ID NO: 1075 - protein, 4 aa, synthetic construct
  REGION 1..4: note = Synthetic Construct
GKRI

SEQ ID NO: 1076 - protein, 4 aa, synthetic construct
  REGION 1..4: note = Synthetic Construct
GKRL

SEQ ID NO: 1077 - protein, 4 aa, synthetic construct
  REGION 1..4: note = Synthetic Construct
GKRN

SEQ ID NO: 1078 - protein, 4 aa, synthetic construct
  REGION 1..4: note = Synthetic Construct
GKRQ

SEQ ID NO: 1079 - protein, 4 aa, synthetic construct
  REGION 1..4: note = Synthetic Construct
GKRR

SEQ ID NO: 1080 - protein, 4 aa, synthetic construct
  REGION 1..4: note = Synthetic Construct
GKRS

SEQ ID NO: 1081 - protein, 4 aa, synthetic construct
  REGION 1..4: note = Synthetic Construct
GKRT

SEQ ID NO: 1082 - protein, 4 aa, synthetic construct
  REGION 1..4: note = Synthetic Construct
GKRY

SEQ ID NO: 1083 - protein, 4 aa, synthetic construct
  REGION 1..4: note = Synthetic Construct
GKSA

SEQ ID NO: 1084 - protein, 4 aa, synthetic construct
  REGION 1..4: note = Synthetic Construct
GKSD

SEQ ID NO: 1085 - protein, 4 aa, synthetic construct
  REGION 1..4: note = Synthetic Construct
GKSE

SEQ ID NO: 1086 - protein, 4 aa, synthetic construct
  REGION 1..4: note = Synthetic Construct
GKSF

SEQ ID NO: 1087 - protein, 4 aa, synthetic construct
  REGION 1..4: note = Synthetic Construct
GKSG

SEQ ID NO: 1088 - protein, 4 aa, synthetic construct
  REGION 1..4: note = Synthetic Construct
GKSH

SEQ ID NO: 1089 - protein, 4 aa, synthetic construct
  REGION 1..4: note = Synthetic Construct
GKSI

SEQ ID NO: 1090 - protein, 4 aa, synthetic construct
  REGION 1..4: note = Synthetic Construct
GKSL

SEQ ID NO: 1091 - protein, 4 aa, synthetic construct
  REGION 1..4: note = Synthetic Construct
GKSN

SEQ ID NO: 1092 - protein, 4 aa, synthetic construct
  REGION 1..4: note = Synthetic Construct
GKSQ

SEQ ID NO: 1093 - protein, 4 aa, synthetic construct
  REGION 1..4: note = Synthetic Construct
GKSR

SEQ ID NO: 1094 - protein, 4 aa, synthetic construct
  REGION 1..4: note = Synthetic Construct
GKSS

SEQ ID NO: 1095 - protein, 4 aa, synthetic construct
  REGION 1..4: note = Synthetic Construct
GKST

SEQ ID NO: 1096 - protein, 4 aa, synthetic construct
  REGION 1..4: note = Synthetic Construct
GKSY

SEQ ID NO: 1097 - protein, 4 aa, synthetic construct
  REGION 1..4: note = Synthetic Construct
GKTA

SEQ ID NO: 1098 - protein, 4 aa, synthetic construct
  REGION 1..4: note = Synthetic Construct
GKTD

SEQ ID NO: 1099 - protein, 4 aa, synthetic construct
  REGION 1..4: note = Synthetic Construct
GKTE

SEQ ID NO: 1100 - protein, 4 aa, synthetic construct
  REGION 1..4: note = Synthetic Construct
GKTF

SEQ ID NO: 1101 - protein, 4 aa, synthetic construct
  REGION 1..4: note = Synthetic Construct
GKTG

SEQ ID NO: 1102 - protein, 4 aa, synthetic construct
  REGION 1..4: note = Synthetic Construct
GKTH

SEQ ID NO: 1103 - protein, 4 aa, synthetic construct
  REGION 1..4: note = Synthetic Construct
GKTI

SEQ ID NO: 1104 - protein, 4 aa, synthetic construct
  REGION 1..4: note = Synthetic Construct
GKTL

SEQ ID NO: 1105 - protein, 4 aa, synthetic construct
  REGION 1..4: note = Synthetic Construct
GKTN

SEQ ID NO: 1106 - protein, 4 aa, synthetic construct
  REGION 1..4: note = Synthetic Construct
GKTQ

SEQ ID NO: 1107 - protein, 4 aa, synthetic construct
  REGION 1..4: note = Synthetic Construct
GKTR

SEQ ID NO: 1108 - protein, 4 aa, synthetic construct
  REGION 1..4: note = Synthetic Construct
GKTS

SEQ ID NO: 1109 - protein, 4 aa, synthetic construct
  REGION 1..4: note = Synthetic Construct
GKTT

SEQ ID NO: 1110 - protein, 4 aa, synthetic construct
  REGION 1..4: note = Synthetic Construct
GKTY

SEQ ID NO: 1111 - protein, 4 aa, synthetic construct
  REGION 1..4: note = Synthetic Construct
GKYA

SEQ ID NO: 1112 - protein, 4 aa, synthetic construct
  REGION 1..4: note = Synthetic Construct
GKYD

SEQ ID NO: 1113 - protein, 4 aa, synthetic construct
  REGION 1..4: note = Synthetic Construct
GKYE

SEQ ID NO: 1114 - protein, 4 aa, synthetic construct
  REGION 1..4: note = Synthetic Construct
GKYF

SEQ ID NO: 1115 - protein, 4 aa, synthetic construct
  REGION 1..4: note = Synthetic Construct
GKYG

SEQ ID NO: 1116 - protein, 4 aa, synthetic construct
  REGION 1..4: note = Synthetic Construct
GKYH

SEQ ID NO: 1117 - protein, 4 aa, synthetic construct
  REGION 1..4: note = Synthetic Construct
GKYI

SEQ ID NO: 1118 - protein, 4 aa, synthetic construct
  REGION 1..4: note = Synthetic Construct
GKYL

SEQ ID NO: 1119 - protein, 4 aa, synthetic construct
  REGION 1..4: note = Synthetic Construct
GKYN

SEQ ID NO: 1120 - protein, 4 aa, synthetic construct
  REGION 1..4: note = Synthetic Construct
GKYQ

SEQ ID NO: 1121 - protein, 4 aa, synthetic construct
  REGION 1..4: note = Synthetic Construct
GKYR

SEQ ID NO: 1122 - protein, 4 aa, synthetic construct
  REGION 1..4: note = Synthetic Construct
GKYS

SEQ ID NO: 1123 - protein, 4 aa, synthetic construct
  REGION 1..4: note = Synthetic Construct
GKYT

SEQ ID NO: 1124 - protein, 4 aa, synthetic construct
  REGION 1..4: note = Synthetic Construct
GKYY

SEQ ID NO: 1125 - protein, 4 aa, synthetic construct
  REGION 1..4: note = Synthetic Construct
HKAA

SEQ ID NO: 1126 - protein, 4 aa, synthetic construct
  REGION 1..4: note = Synthetic Construct
HKAD

SEQ ID NO: 1127 - protein, 4 aa, synthetic construct
  REGION 1..4: note = Synthetic Construct
HKAE

SEQ ID NO: 1128 - protein, 4 aa, synthetic construct
  REGION 1..4: note = Synthetic Construct
HKAF

SEQ ID NO: 1129 - protein, 4 aa, synthetic construct
  REGION 1..4: note = Synthetic Construct
HKAG

SEQ ID NO: 1130 - protein, 4 aa, synthetic construct
  REGION 1..4: note = Synthetic Construct
HKAH

SEQ ID NO: 1131 - protein, 4 aa, synthetic construct
  REGION 1..4: note = Synthetic Construct
HKAI

SEQ ID NO: 1132 - protein, 4 aa, synthetic construct
  REGION 1..4: note = Synthetic Construct
HKAL

SEQ ID NO: 1133 - protein, 4 aa, synthetic construct
  REGION 1..4: note = Synthetic Construct
HKAN

SEQ ID NO: 1134 - protein, 4 aa, synthetic construct
  REGION 1..4: note = Synthetic Construct
HKAQ

SEQ ID NO: 1135 - protein, 4 aa, synthetic construct
  REGION 1..4: note = Synthetic Construct
HKAR

SEQ ID NO: 1136 - protein, 4 aa, synthetic construct
  REGION 1..4: note = Synthetic Construct
HKAS

SEQ ID NO: 1137 - protein, 4 aa, synthetic construct
  REGION 1..4: note = Synthetic Construct
HKAT

SEQ ID NO: 1138 - protein, 4 aa, synthetic construct
  REGION 1..4: note = Synthetic Construct
HKAY

SEQ ID NO: 1139 - protein, 4 aa, synthetic construct
  REGION 1..4: note = Synthetic Construct
HKDA

SEQ ID NO: 1140 - protein, 4 aa, synthetic construct
  REGION 1..4: note = Synthetic Construct
HKDD

SEQ ID NO: 1141 - protein, 4 aa, synthetic construct
  REGION 1..4: note = Synthetic Construct
HKDE

SEQ ID NO: 1142 - protein, 4 aa, synthetic construct
  REGION 1..4: note = Synthetic Construct
HKDF

SEQ ID NO: 1143 - protein, 4 aa, synthetic construct
  REGION 1..4: note = Synthetic Construct
HKDG

SEQ ID NO: 1144 - protein, 4 aa, synthetic construct
  REGION 1..4: note = Synthetic Construct
HKDH

SEQ ID NO: 1145 - protein, 4 aa, synthetic construct
  REGION 1..4: note = Synthetic Construct
HKDI

SEQ ID NO: 1146 - protein, 4 aa, synthetic construct
  REGION 1..4: note = Synthetic Construct
HKDL

SEQ ID NO: 1147 - protein, 4 aa, synthetic construct
  REGION 1..4: note = Synthetic Construct
HKDN

SEQ ID NO: 1148 - protein, 4 aa, synthetic construct
  REGION 1..4: note = Synthetic Construct
HKDQ

SEQ ID NO: 1149 - protein, 4 aa, synthetic construct
  REGION 1..4: note = Synthetic Construct
HKDR

SEQ ID NO: 1150 - protein, 4 aa, synthetic construct
  REGION 1..4: note = Synthetic Construct
HKDS

SEQ ID NO: 1151 - protein, 4 aa, synthetic construct
  REGION 1..4: note = Synthetic Construct
HKDT

SEQ ID NO: 1152 - protein, 4 aa, synthetic construct
  REGION 1..4: note = Synthetic Construct
HKDY

SEQ ID NO: 1153 - protein, 4 aa, synthetic construct
  REGION 1..4: note = Synthetic Construct
HKEA

SEQ ID NO: 1154 - protein, 4 aa, synthetic construct
  REGION 1..4: note = Synthetic Construct
HKED

SEQ ID NO: 1155 - protein, 4 aa, synthetic construct
  REGION 1..4: note = Synthetic Construct
HKEE

SEQ ID NO: 1156 - protein, 4 aa, synthetic construct
  REGION 1..4: note = Synthetic Construct
HKEF

SEQ ID NO: 1157 - protein, 4 aa, synthetic construct
  REGION 1..4: note = Synthetic Construct
HKEG

SEQ ID NO: 1158 - protein, 4 aa, synthetic construct
  REGION 1..4: note = Synthetic Construct
HKEH

SEQ ID NO: 1159 - protein, 4 aa, synthetic construct
  REGION 1..4: note = Synthetic Construct
HKEI

SEQ ID NO: 1160 - protein, 4 aa, synthetic construct
  REGION 1..4: note = Synthetic Construct
HKEL

SEQ ID NO: 1161 - protein, 4 aa, synthetic construct
  REGION 1..4: note = Synthetic Construct
HKEN

SEQ ID NO: 1162 - protein, 4 aa, synthetic construct
  REGION 1..4: note = Synthetic Construct
HKEQ

SEQ ID NO: 1163 - protein, 4 aa, synthetic construct
  REGION 1..4: note = Synthetic Construct
HKER

SEQ ID NO: 1164 - protein, 4 aa, synthetic construct
  REGION 1..4: note = Synthetic Construct
HKES

SEQ ID NO: 1165 - protein, 4 aa, synthetic construct
  REGION 1..4: note = Synthetic Construct
HKET

SEQ ID NO: 1166 - protein, 4 aa, synthetic construct
  REGION 1..4: note = Synthetic Construct
HKEY

SEQ ID NO: 1167 - protein, 4 aa, synthetic construct
  REGION 1..4: note = Synthetic Construct
HKFA

SEQ ID NO: 1168 - protein, 4 aa, synthetic construct
  REGION 1..4: note = Synthetic Construct
HKFD

SEQ ID NO: 1169 - protein, 4 aa, synthetic construct
  REGION 1..4: note = Synthetic Construct
HKFE

SEQ ID NO: 1170 - protein, 4 aa, synthetic construct
  REGION 1..4: note = Synthetic Construct
HKFF

SEQ ID NO: 1171 - protein, 4 aa, synthetic construct
  REGION 1..4: note = Synthetic Construct
HKFG

SEQ ID NO: 1172 - protein, 4 aa, synthetic construct
  REGION 1..4: note = Synthetic Construct
HKFH

SEQ ID NO: 1173 - protein, 4 aa, synthetic construct
  REGION 1..4: note = Synthetic Construct
HKFI

SEQ ID NO: 1174 - protein, 4 aa, synthetic construct
  REGION 1..4: note = Synthetic Construct
HKFL

SEQ ID NO: 1175 - protein, 4 aa, synthetic construct
  REGION 1..4: note = Synthetic Construct
HKFN

SEQ ID NO: 1176 - protein, 4 aa, synthetic construct
  REGION 1..4: note = Synthetic Construct
HKFQ

SEQ ID NO: 1177 - protein, 4 aa, synthetic construct
  REGION 1..4: note = Synthetic Construct
HKFR

SEQ ID NO: 1178 - protein, 4 aa, synthetic construct
  REGION 1..4: note = Synthetic Construct
HKFS

SEQ ID NO: 1179 - protein, 4 aa, synthetic construct
  REGION 1..4: note = Synthetic Construct
HKFT

SEQ ID NO: 1180 - protein, 4 aa, synthetic construct
  REGION 1..4: note = Synthetic Construct
HKFY

SEQ ID NO: 1181 - protein, 4 aa, synthetic construct
  REGION 1..4: note = Synthetic Construct
HKGA

SEQ ID NO: 1182 - protein, 4 aa, synthetic construct
  REGION 1..4: note = Synthetic Construct
HKGD

SEQ ID NO: 1183 - protein, 4 aa, synthetic construct
  REGION 1..4: note = Synthetic Construct
HKGE

SEQ ID NO: 1184 - protein, 4 aa, synthetic construct
  REGION 1..4: note = Synthetic Construct
HKGF

SEQ ID NO: 1185 - protein, 4 aa, synthetic construct
  REGION 1..4: note = Synthetic Construct
HKGG

SEQ ID NO: 1186 - protein, 4 aa, synthetic construct
  REGION 1..4: note = Synthetic Construct
HKGH

SEQ ID NO: 1187 - protein, 4 aa, synthetic construct
  REGION 1..4: note = Synthetic Construct
HKGI

SEQ ID NO: 1188 - protein, 4 aa, synthetic construct
  REGION 1..4: note = Synthetic Construct
HKGL

SEQ ID NO: 1189 - protein, 4 aa, synthetic construct
  REGION 1..4: note = Synthetic Construct
HKGN

SEQ ID NO: 1190 - protein, 4 aa, synthetic construct
  REGION 1..4: note = Synthetic Construct
HKGQ

SEQ ID NO: 1191 - protein, 4 aa, synthetic construct
  REGION 1..4: note = Synthetic Construct
HKGR

SEQ ID NO: 1192 - protein, 4 aa, synthetic construct
  REGION 1..4: note = Synthetic Construct
HKGS

SEQ ID NO: 1193 - protein, 4 aa, synthetic construct
  REGION 1..4: note = Synthetic Construct
HKGT

SEQ ID NO: 1194 - protein, 4 aa, synthetic construct
  REGION 1..4: note = Synthetic Construct
HKGY

SEQ ID NO: 1195 - protein, 4 aa, synthetic construct
  REGION 1..4: note = Synthetic Construct
HKHA

SEQ ID NO: 1196 - protein, 4 aa, synthetic construct
  REGION 1..4: note = Synthetic Construct
HKHD

SEQ ID NO: 1197 - protein, 4 aa, synthetic construct
  REGION 1..4: note = Synthetic Construct
HKHE

SEQ ID NO: 1198 - protein, 4 aa, synthetic construct
  REGION 1..4: note = Synthetic Construct
HKHF

SEQ ID NO: 1199 - protein, 4 aa, synthetic construct
  REGION 1..4: note = Synthetic Construct
HKHG

SEQ ID NO: 1200 - protein, 4 aa, synthetic construct
  REGION 1..4: note = Synthetic Construct
HKHH

SEQ ID NO: 1201 - protein, 4 aa, synthetic construct
  REGION 1..4: note = Synthetic Construct
HKHI

SEQ ID NO: 1202 - protein, 4 aa, synthetic construct
  REGION 1..4: note = Synthetic Construct
HKHL

SEQ ID NO: 1203 - protein, 4 aa, synthetic construct
  REGION 1..4: note = Synthetic Construct
HKHN

SEQ ID NO: 1204 - protein, 4 aa, synthetic construct
  REGION 1..4: note = Synthetic Construct
HKHQ

SEQ ID NO: 1205 - protein, 4 aa, synthetic construct
  REGION 1..4: note = Synthetic Construct
HKHR

SEQ ID NO: 1206 - protein, 4 aa, synthetic construct
  REGION 1..4: note = Synthetic Construct
HKHS

SEQ ID NO: 1207 - protein, 4 aa, synthetic construct
  REGION 1..4: note = Synthetic Construct
HKHT

SEQ ID NO: 1208 - protein, 4 aa, synthetic construct
  REGION 1..4: note = Synthetic Construct
HKHY

SEQ ID NO: 1209 - protein, 4 aa, synthetic construct
  REGION 1..4: note = Synthetic Construct
HKIA

SEQ ID NO: 1210 - protein, 4 aa, synthetic construct
  REGION 1..4: note = Synthetic Construct
HKID

SEQ ID NO: 1211 - protein, 4 aa, synthetic construct
  REGION 1..4: note = Synthetic Construct
HKIE

SEQ ID NO: 1212 - protein, 4 aa, synthetic construct
  REGION 1..4: note = Synthetic Construct
HKIF

SEQ ID NO: 1213 - protein, 4 aa, synthetic construct
  REGION 1..4: note = Synthetic Construct
HKIG

SEQ ID NO: 1214 - protein, 4 aa, synthetic construct
  REGION 1..4: note = Synthetic Construct
HKIH

SEQ ID NO: 1215 - protein, 4 aa, synthetic construct
  REGION 1..4: note = Synthetic Construct
HKII

SEQ ID NO: 1216 - protein, 4 aa, synthetic construct
  REGION 1..4: note = Synthetic Construct
HKIL

SEQ ID NO: 1217 - protein, 4 aa, synthetic construct
  REGION 1..4: note = Synthetic Construct
HKIN

SEQ ID NO: 1218 - protein, 4 aa, synthetic construct
  REGION 1..4: note = Synthetic Construct
HKIQ

SEQ ID NO: 1219 - protein, 4 aa, synthetic construct
  REGION 1..4: note = Synthetic Construct
HKIR

SEQ ID NO: 1220 - protein, 4 aa, synthetic construct
  REGION 1..4: note = Synthetic Construct
HKIS

SEQ ID NO: 1221 - protein, 4 aa, synthetic construct
  REGION 1..4: note = Synthetic Construct
HKIT

SEQ ID NO: 1222 - protein, 4 aa, synthetic construct
  REGION 1..4: note = Synthetic Construct
HKIY

SEQ ID NO: 1223 - protein, 4 aa, synthetic construct
  REGION 1..4: note = Synthetic Construct
HKLA

SEQ ID NO: 1224 - protein, 4 aa, synthetic construct
  REGION 1..4: note = Synthetic Construct
HKLD

SEQ ID NO: 1225 - protein, 4 aa, synthetic construct
  REGION 1..4: note = Synthetic Construct
HKLE

SEQ ID NO: 1226 - protein, 4 aa, synthetic construct
  REGION 1..4: note = Synthetic Construct
HKLF

SEQ ID NO: 1227 - protein, 4 aa, synthetic construct
  REGION 1..4: note = Synthetic Construct
HKLG

SEQ ID NO: 1228 - protein, 4 aa, synthetic construct
  REGION 1..4: note = Synthetic Construct
HKLH

SEQ ID NO: 1229 - protein, 4 aa, synthetic construct
  REGION 1..4: note = Synthetic Construct
HKLI

SEQ ID NO: 1230 - protein, 4 aa, synthetic construct
  REGION 1..4: note = Synthetic Construct
HKLL

SEQ ID NO: 1231 - protein, 4 aa, synthetic construct
  REGION 1..4: note = Synthetic Construct
HKLN

SEQ ID NO: 1232 - protein, 4 aa, synthetic construct
  REGION 1..4: note = Synthetic Construct
HKLQ

SEQ ID NO: 1233 - protein, 4 aa, synthetic construct
  REGION 1..4: note = Synthetic Construct
HKLR

SEQ ID NO: 1234 - protein, 4 aa, synthetic construct
  REGION 1..4: note = Synthetic Construct
HKLS

SEQ ID NO: 1235 - protein, 4 aa, synthetic construct
  REGION 1..4: note = Synthetic Construct
HKLT

SEQ ID NO: 1236 - protein, 4 aa, synthetic construct
  REGION 1..4: note = Synthetic Construct
HKLY

SEQ ID NO: 1237 - protein, 4 aa, synthetic construct
  REGION 1..4: note = Synthetic Construct
HKNA

SEQ ID NO: 1238 - protein, 4 aa, synthetic construct
  REGION 1..4: note = Synthetic Construct
HKND

SEQ ID NO: 1239 - protein, 4 aa, synthetic construct
  REGION 1..4: note = Synthetic Construct
HKNE

SEQ ID NO: 1240 - protein, 4 aa, synthetic construct
  REGION 1..4: note = Synthetic Construct
HKNF

SEQ ID NO: 1241 - protein, 4 aa, synthetic construct
  REGION 1..4: note = Synthetic Construct
HKNG

SEQ ID NO: 1242 - protein, 4 aa, synthetic construct
  REGION 1..4: note = Synthetic Construct
HKNH

SEQ ID NO: 1243 - protein, 4 aa, synthetic construct
  REGION 1..4: note = Synthetic Construct
HKNI

SEQ ID NO: 1244 - protein, 4 aa, synthetic construct
  REGION 1..4: note = Synthetic Construct
HKNL

SEQ ID NO: 1245 - protein, 4 aa, synthetic construct
  REGION 1..4: note = Synthetic Construct
HKNN

SEQ ID NO: 1246 - protein, 4 aa, synthetic construct
  REGION 1..4: note = Synthetic Construct
HKNQ

SEQ ID NO: 1247 - protein, 4 aa, synthetic construct
  REGION 1..4: note = Synthetic Construct
HKNR

SEQ ID NO: 1248 - protein, 4 aa, synthetic construct
  REGION 1..4: note = Synthetic Construct
HKNS

SEQ ID NO: 1249 - protein, 4 aa, synthetic construct
  REGION 1..4: note = Synthetic Construct
HKNT

SEQ ID NO: 1250 - protein, 4 aa, synthetic construct
  REGION 1..4: note = Synthetic Construct
HKNY

SEQ ID NO: 1251 - protein, 4 aa, synthetic construct
  REGION 1..4: note = Synthetic Construct
HKPA

SEQ ID NO: 1252 - protein, 4 aa, synthetic construct
  REGION 1..4: note = Synthetic Construct
HKPD

SEQ ID NO: 1253 - protein, 4 aa, synthetic construct
  REGION 1..4: note = Synthetic Construct
HKPE

SEQ ID NO: 1254 - protein, 4 aa, synthetic construct
  REGION 1..4: note = Synthetic Construct
HKPF

SEQ ID NO: 1255 - protein, 4 aa, synthetic construct
  REGION 1..4: note = Synthetic Construct
HKPG

SEQ ID NO: 1256 - protein, 4 aa, synthetic construct
  REGION 1..4: note = Synthetic Construct
HKPH

SEQ ID NO: 1257 - protein, 4 aa, synthetic construct
  REGION 1..4: note = Synthetic Construct
HKPI

SEQ ID NO: 1258 - protein, 4 aa, synthetic construct
  REGION 1..4: note = Synthetic Construct
HKPL

SEQ ID NO: 1259 - protein, 4 aa, synthetic construct
  REGION 1..4: note = Synthetic Construct
HKPN

SEQ ID NO: 1260 - protein, 4 aa, synthetic construct
  REGION 1..4: note = Synthetic Construct
HKPQ

SEQ ID NO: 1261 - protein, 4 aa, synthetic construct
  REGION 1..4: note = Synthetic Construct
HKPR

SEQ ID NO: 1262 - protein, 4 aa, synthetic construct
  REGION 1..4: note = Synthetic Construct
HKPS

SEQ ID NO: 1263 - protein, 4 aa, synthetic construct
  REGION 1..4: note = Synthetic Construct
HKPT

SEQ ID NO: 1264 - protein, 4 aa, synthetic construct
  REGION 1..4: note = Synthetic Construct
HKPY

SEQ ID NO: 1265 - protein, 4 aa, synthetic construct
  REGION 1..4: note = Synthetic Construct
HKQA

SEQ ID NO: 1266 - protein, 4 aa, synthetic construct
  REGION 1..4: note = Synthetic Construct
HKQD

SEQ ID NO: 1267 - protein, 4 aa, synthetic construct
  REGION 1..4: note = Synthetic Construct
HKQE

SEQ ID NO: 1268 - protein, 4 aa, synthetic construct
  REGION 1..4: note = Synthetic Construct
HKQF

SEQ ID NO: 1269 - protein, 4 aa, synthetic construct
  REGION 1..4: note = Synthetic Construct
HKQG

SEQ ID NO: 1270 - protein, 4 aa, synthetic construct
  REGION 1..4: note = Synthetic Construct
HKQH

SEQ ID NO: 1271 - protein, 4 aa, synthetic construct
  REGION 1..4: note = Synthetic Construct
HKQI

SEQ ID NO: 1272 - protein, 4 aa, synthetic construct
  REGION 1..4: note = Synthetic Construct
HKQL

SEQ ID NO: 1273 - protein, 4 aa, synthetic construct
  REGION 1..4: note = Synthetic Construct
HKQN

SEQ ID NO: 1274 - protein, 4 aa, synthetic construct
  REGION 1..4: note = Synthetic Construct
HKQQ

SEQ ID NO: 1275 - protein, 4 aa, synthetic construct
  REGION 1..4: note = Synthetic Construct
HKQR

SEQ ID NO: 1276 - protein, 4 aa, synthetic construct
  REGION 1..4: note = Synthetic Construct
HKQS

SEQ ID NO: 1277 - protein, 4 aa, synthetic construct
  REGION 1..4: note = Synthetic Construct
HKQT

SEQ ID NO: 1278 - protein, 4 aa, synthetic construct
  REGION 1..4: note = Synthetic Construct
HKQY

SEQ ID NO: 1279 - protein, 4 aa, synthetic construct
  REGION 1..4: note = Synthetic Construct
HKRA

SEQ ID NO: 1280 - protein, 4 aa, synthetic construct
  REGION 1..4: note = Synthetic Construct
HKRD

SEQ ID NO: 1281 - protein, 4 aa, synthetic construct
  REGION 1..4: note = Synthetic Construct
HKRE

SEQ ID NO: 1282 - protein, 4 aa, synthetic construct
  REGION 1..4: note = Synthetic Construct
HKRF

SEQ ID NO: 1283 - protein, 4 aa, synthetic construct
  REGION 1..4: note = Synthetic Construct
HKRG

SEQ ID NO: 1284 - protein, 4 aa, synthetic construct
  REGION 1..4: note = Synthetic Construct
HKRH

SEQ ID NO: 1285 - protein, 4 aa, synthetic construct
  REGION 1..4: note = Synthetic Construct
HKRI

SEQ ID NO: 1286 - protein, 4 aa, synthetic construct
  REGION 1..4: note = Synthetic Construct
HKRL

SEQ ID NO: 1287 - protein, 4 aa, synthetic construct
  REGION 1..4: note = Synthetic Construct
HKRN

SEQ ID NO: 1288 - protein, 4 aa, synthetic construct
  REGION 1..4: note = Synthetic Construct
HKRQ

SEQ ID NO: 1289 - protein, 4 aa, synthetic construct
  REGION 1..4: note = Synthetic Construct
HKRR

SEQ ID NO: 1290 - protein, 4 aa, synthetic construct
  REGION 1..4: note = Synthetic Construct
HKRS

SEQ ID NO: 1291 - protein, 4 aa, synthetic construct
  REGION 1..4: note = Synthetic Construct
HKRT

SEQ ID NO: 1292 - protein, 4 aa, synthetic construct
  REGION 1..4: note = Synthetic Construct
HKRY

SEQ ID NO: 1293 - protein, 4 aa, synthetic construct
  REGION 1..4: note = Synthetic Construct
HKSA

SEQ ID NO: 1294 - protein, 4 aa, synthetic construct
  REGION 1..4: note = Synthetic Construct
HKSD

SEQ ID NO: 1295 - protein, 4 aa, synthetic construct
  REGION 1..4: note = Synthetic Construct
HKSE

SEQ ID NO: 1296 - protein, 4 aa, synthetic construct
  REGION 1..4: note = Synthetic Construct
HKSF

SEQ ID NO: 1297 - protein, 4 aa, synthetic construct
  REGION 1..4: note = Synthetic Construct
HKSG

SEQ ID NO: 1298 - protein, 4 aa, synthetic construct
  REGION 1..4: note = Synthetic Construct
HKSH

SEQ ID NO: 1299 - protein, 4 aa, synthetic construct
  REGION 1..4: note = Synthetic Construct
HKSI

SEQ ID NO: 1300 - protein, 4 aa, synthetic construct
  REGION 1..4: note = Synthetic Construct
HKSL

SEQ ID NO: 1301 - protein, 4 aa, synthetic construct
  REGION 1..4: note = Synthetic Construct
HKSN

SEQ ID NO: 1302 - protein, 4 aa, synthetic construct
  REGION 1..4: note = Synthetic Construct
HKSQ

SEQ ID NO: 1303 - protein, 4 aa, synthetic construct
  REGION 1..4: note = Synthetic Construct
HKSR

SEQ ID NO: 1304 - protein, 4 aa, synthetic construct
  REGION 1..4: note = Synthetic Construct
HKSS

SEQ ID NO: 1305 - protein, 4 aa, synthetic construct
  REGION 1..4: note = Synthetic Construct
HKST

SEQ ID NO: 1306 - protein, 4 aa, synthetic construct
  REGION 1..4: note = Synthetic Construct
HKSY

SEQ ID NO: 1307 - protein, 4 aa, synthetic construct
  REGION 1..4: note = Synthetic Construct
HKTA

SEQ ID NO: 1308 - protein, 4 aa, synthetic construct
  REGION 1..4: note = Synthetic Construct
HKTD

SEQ ID NO: 1309 - protein, 4 aa, synthetic construct
  REGION 1..4: note = Synthetic Construct
HKTE

SEQ ID NO: 1310 - protein, 4 aa, synthetic construct
  REGION 1..4: note = Synthetic Construct
HKTF

SEQ ID NO: 1311 - protein, 4 aa, synthetic construct
  REGION 1..4: note = Synthetic Construct
HKTG

SEQ ID NO: 1312 - protein, 4 aa, synthetic construct
  REGION 1..4: note = Synthetic Construct
HKTH

SEQ ID NO: 1313 - protein, 4 aa, synthetic construct
  REGION 1..4: note = Synthetic Construct
HKTI

SEQ ID NO: 1314 - protein, 4 aa, synthetic construct
  REGION 1..4: note = Synthetic Construct
HKTL

SEQ ID NO: 1315 - protein, 4 aa, synthetic construct
  REGION 1..4: note = Synthetic Construct
HKTN

SEQ ID NO: 1316 - protein, 4 aa, synthetic construct
  REGION 1..4: note = Synthetic Construct
HKTQ

SEQ ID NO: 1317 - protein, 4 aa, synthetic construct
  REGION 1..4: note = Synthetic Construct
HKTR

SEQ ID NO: 1318 - protein, 4 aa, synthetic construct
  REGION 1..4: note = Synthetic Construct
HKTS

SEQ ID NO: 1319 - protein, 4 aa, synthetic construct
  REGION 1..4: note = Synthetic Construct
HKTT

SEQ ID NO: 1320 - protein, 4 aa, synthetic construct
  REGION 1..4: note = Synthetic Construct
HKTY

SEQ ID NO: 1321 - protein, 4 aa, synthetic construct
  REGION 1..4: note = Synthetic Construct
HKYA

SEQ ID NO: 1322 - protein, 4 aa, synthetic construct
  REGION 1..4: note = Synthetic Construct
HKYD

SEQ ID NO: 1323 - protein, 4 aa, synthetic construct
  REGION 1..4: note = Synthetic Construct
HKYE

SEQ ID NO: 1324 - protein, 4 aa, synthetic construct
  REGION 1..4: note = Synthetic Construct
HKYF

SEQ ID NO: 1325 - protein, 4 aa, synthetic construct
  REGION 1..4: note = Synthetic Construct
HKYG

SEQ ID NO: 1326 - protein, 4 aa, synthetic construct
  REGION 1..4: note = Synthetic Construct
HKYH

SEQ ID NO: 1327 - protein, 4 aa, synthetic construct
  REGION 1..4: note = Synthetic Construct
HKYI

SEQ ID NO: 1328 - protein, 4 aa, synthetic construct
  REGION 1..4: note = Synthetic Construct
HKYL

SEQ ID NO: 1329 - protein, 4 aa, synthetic construct
  REGION 1..4: note = Synthetic Construct
HKYN

SEQ ID NO: 1330 - protein, 4 aa, synthetic construct
  REGION 1..4: note = Synthetic Construct
HKYQ

SEQ ID NO: 1331 - protein, 4 aa, synthetic construct
  REGION 1..4: note = Synthetic Construct
HKYR

SEQ ID NO: 1332 - protein, 4 aa, synthetic construct
  REGION 1..4: note = Synthetic Construct
HKYS

SEQ ID NO: 1333 - protein, 4 aa, synthetic construct
  REGION 1..4: note = Synthetic Construct
HKYT

SEQ ID NO: 1334 - protein, 4 aa, synthetic construct
  REGION 1..4: note = Synthetic Construct
HKYY

SEQ ID NO: 1335 - protein, 4 aa, synthetic construct
  REGION 1..4: note = Synthetic Construct
IKAA

SEQ ID NO: 1336 - protein, 4 aa, synthetic construct
  REGION 1..4: note = Synthetic Construct
IKAD

SEQ ID NO: 1337 - protein, 4 aa, synthetic construct
  REGION 1..4: note = Synthetic Construct
IKAE

SEQ ID NO: 1338 - protein, 4 aa, synthetic construct
  REGION 1..4: note = Synthetic Construct
IKAF

SEQ ID NO: 1339 - protein, 4 aa, synthetic construct
  REGION 1..4: note = Synthetic Construct
IKAG

SEQ ID NO: 1340 - protein, 4 aa, synthetic construct
  REGION 1..4: note = Synthetic Construct
IKAH

SEQ ID NO: 1341 - protein, 4 aa, synthetic construct
  REGION 1..4: note = Synthetic Construct
IKAI

SEQ ID NO: 1342 - protein, 4 aa, synthetic construct
  REGION 1..4: note = Synthetic Construct
IKAL

SEQ ID NO: 1343 - protein, 4 aa, synthetic construct
  REGION 1..4: note = Synthetic Construct
IKAN

SEQ ID NO: 1344 - protein, 4 aa, synthetic construct
  REGION 1..4: note = Synthetic Construct
IKAQ

SEQ ID NO: 1345 - protein, 4 aa, synthetic construct
  REGION 1..4: note = Synthetic Construct
IKAR

SEQ ID NO: 1346 - protein, 4 aa, synthetic construct
  REGION 1..4: note = Synthetic Construct
IKAS

SEQ ID NO: 1347 - protein, 4 aa, synthetic construct
  REGION 1..4: note = Synthetic Construct
IKAT

SEQ ID NO: 1348 - protein, 4 aa, synthetic construct
  REGION 1..4: note = Synthetic Construct
IKAY

SEQ ID NO: 1349 - protein, 4 aa, synthetic construct
  REGION 1..4: note = Synthetic Construct
IKDA

SEQ ID NO: 1350 - protein, 4 aa, synthetic construct
  REGION 1..4: note = Synthetic Construct
IKDD

SEQ ID NO: 1351 - protein, 4 aa, synthetic construct
  REGION 1..4: note = Synthetic Construct
IKDE

SEQ ID NO: 1352 - protein, 4 aa, synthetic construct
  REGION 1..4: note = Synthetic Construct
IKDF

SEQ ID NO: 1353 - protein, 4 aa, synthetic construct
  REGION 1..4: note = Synthetic Construct
IKDG

SEQ ID NO: 1354 - protein, 4 aa, synthetic construct
  REGION 1..4: note = Synthetic Construct
IKDH

SEQ ID NO: 1355 - protein, 4 aa, synthetic construct
  REGION 1..4: note = Synthetic Construct
IKDI

SEQ ID NO: 1356 - protein, 4 aa, synthetic construct
  REGION 1..4: note = Synthetic Construct
IKDL

SEQ ID NO: 1357 - protein, 4 aa, synthetic construct
  REGION 1..4: note = Synthetic Construct
IKDN

SEQ ID NO: 1358 - protein, 4 aa, synthetic construct
  REGION 1..4: note = Synthetic Construct
IKDQ

SEQ ID NO: 1359 - protein, 4 aa, synthetic construct
  REGION 1..4: note = Synthetic Construct
IKDR

SEQ ID NO: 1360 - protein, 4 aa, synthetic construct
  REGION 1..4: note = Synthetic Construct
IKDS

SEQ ID NO: 1361 - protein, 4 aa, synthetic construct
  REGION 1..4: note = Synthetic Construct
IKDT

SEQ ID NO: 1362 - protein, 4 aa, synthetic construct
  REGION 1..4: note = Synthetic Construct
IKDY

SEQ ID NO: 1363 - protein, 4 aa, synthetic construct
  REGION 1..4: note = Synthetic Construct
IKEA

SEQ ID NO: 1364 - protein, 4 aa, synthetic construct
  REGION 1..4: note = Synthetic Construct
IKED

SEQ ID NO: 1365 - protein, 4 aa, synthetic construct
  REGION 1..4: note = Synthetic Construct
IKEE

SEQ ID NO: 1366 - protein, 4 aa, synthetic construct
  REGION 1..4: note = Synthetic Construct
IKEF

SEQ ID NO: 1367 - protein, 4 aa, synthetic construct
  REGION 1..4: note = Synthetic Construct
IKEG

SEQ ID NO: 1368 - protein, 4 aa, synthetic construct
  REGION 1..4: note = Synthetic Construct
IKEH

SEQ ID NO: 1369 - protein, 4 aa, synthetic construct
  REGION 1..4: note = Synthetic Construct
IKEI

SEQ ID NO: 1370 - protein, 4 aa, synthetic construct
  REGION 1..4: note = Synthetic Construct
IKEL

SEQ ID NO: 1371 - protein, 4 aa, synthetic construct
  REGION 1..4: note = Synthetic Construct
IKEN

SEQ ID NO: 1372 - protein, 4 aa, synthetic construct
  REGION 1..4: note = Synthetic Construct
IKEQ

SEQ ID NO: 1373 - protein, 4 aa, synthetic construct
  REGION 1..4: note = Synthetic Construct
IKER

SEQ ID NO: 1374 - protein, 4 aa, synthetic construct
  REGION 1..4: note = Synthetic Construct
IKES

SEQ ID NO: 1375 - protein, 4 aa, synthetic construct
  REGION 1..4: note = Synthetic Construct
IKET

SEQ ID NO: 1376 - protein, 4 aa, synthetic construct
  REGION 1..4: note = Synthetic Construct
IKEY

SEQ ID NO: 1377 - protein, 4 aa, synthetic construct
  REGION 1..4: note = Synthetic Construct
IKFA

SEQ ID NO: 1378 - protein, 4 aa, synthetic construct
  REGION 1..4: note = Synthetic Construct
IKFD

SEQ ID NO: 1379 - protein, 4 aa, synthetic construct
  REGION 1..4: note = Synthetic Construct
IKFE

SEQ ID NO: 1380 - protein, 4 aa, synthetic construct
  REGION 1..4: note = Synthetic Construct
IKFF

SEQ ID NO: 1381 - protein, 4 aa, synthetic construct
  REGION 1..4: note = Synthetic Construct
IKFG

SEQ ID NO: 1382 - protein, 4 aa, synthetic construct
  REGION 1..4: note = Synthetic Construct
IKFH

SEQ ID NO: 1383 - protein, 4 aa, synthetic construct
  REGION 1..4: note = Synthetic Construct
IKFI

SEQ ID NO: 1384 - protein, 4 aa, synthetic construct
  REGION 1..4: note = Synthetic Construct
IKFL

SEQ ID NO: 1385 - protein, 4 aa, synthetic construct
  REGION 1..4: note = Synthetic Construct
IKFN

SEQ ID NO: 1386 - protein, 4 aa, synthetic construct
  REGION 1..4: note = Synthetic Construct
IKFQ

SEQ ID NO: 1387 - protein, 4 aa, synthetic construct
  REGION 1..4: note = Synthetic Construct
IKFR

SEQ ID NO: 1388 - protein, 4 aa, synthetic construct
  REGION 1..4: note = Synthetic Construct
IKFS

SEQ ID NO: 1389 - protein, 4 aa, synthetic construct
  REGION 1..4: note = Synthetic Construct
IKFT

SEQ ID NO: 1390 - protein, 4 aa, synthetic construct
  REGION 1..4: note = Synthetic Construct
IKFY

SEQ ID NO: 1391 - protein, 4 aa, synthetic construct
  REGION 1..4: note = Synthetic Construct
IKGA

SEQ ID NO: 1392 - protein, 4 aa, synthetic construct
  REGION 1..4: note = Synthetic Construct
IKGD

SEQ ID NO: 1393 - protein, 4 aa, synthetic construct
  REGION 1..4: note = Synthetic Construct
IKGE

SEQ ID NO: 1394 - protein, 4 aa, synthetic construct
  REGION 1..4: note = Synthetic Construct
IKGF

SEQ ID NO: 1395 - protein, 4 aa, synthetic construct
  REGION 1..4: note = Synthetic Construct
IKGG

SEQ ID NO: 1396 - protein, 4 aa, synthetic construct
  REGION 1..4: note = Synthetic Construct
IKGH

SEQ ID NO: 1397 - protein, 4 aa, synthetic construct
  REGION 1..4: note = Synthetic Construct
IKGI

SEQ ID NO: 1398 - protein, 4 aa, synthetic construct
  REGION 1..4: note = Synthetic Construct
IKGL

SEQ ID NO: 1399 - protein, 4 aa, synthetic construct
  REGION 1..4: note = Synthetic Construct
IKGN

SEQ ID NO: 1400 - protein, 4 aa, synthetic construct
  REGION 1..4: note = Synthetic Construct
IKGQ

SEQ ID NO: 1401 - protein, 4 aa, synthetic construct
  REGION 1..4: note = Synthetic Construct
IKGR

SEQ ID NO: 1402 - protein, 4 aa, synthetic construct
  REGION 1..4: note = Synthetic Construct
IKGS

SEQ ID NO: 1403 - protein, 4 aa, synthetic construct
  REGION 1..4: note = Synthetic Construct
IKGT

SEQ ID NO: 1404 - protein, 4 aa, synthetic construct
  REGION 1..4: note = Synthetic Construct
IKGY

SEQ ID NO: 1405 - protein, 4 aa, synthetic construct
  REGION 1..4: note = Synthetic Construct
IKHA

SEQ ID NO: 1406 - protein, 4 aa, synthetic construct
  REGION 1..4: note = Synthetic Construct
IKHD

SEQ ID NO: 1407 - protein, 4 aa, synthetic construct
  REGION 1..4: note = Synthetic Construct
IKHE

SEQ ID NO: 1408 - protein, 4 aa, synthetic construct
  REGION 1..4: note = Synthetic Construct
IKHF

SEQ ID NO: 1409 - protein, 4 aa, synthetic construct
  REGION 1..4: note = Synthetic Construct
IKHG

SEQ ID NO: 1410 - protein, 4 aa, synthetic construct
  REGION 1..4: note = Synthetic Construct
IKHH

SEQ ID NO: 1411 - protein, 4 aa, synthetic construct
  REGION 1..4: note = Synthetic Construct
IKHI

SEQ ID NO: 1412 - protein, 4 aa, synthetic construct
  REGION 1..4: note = Synthetic Construct
IKHL

SEQ ID NO: 1413 - protein, 4 aa, synthetic construct
  REGION 1..4: note = Synthetic Construct
IKHN

SEQ ID NO: 1414 - protein, 4 aa, synthetic construct
  REGION 1..4: note = Synthetic Construct
IKHQ

SEQ ID NO: 1415 - protein, 4 aa, synthetic construct
  REGION 1..4: note = Synthetic Construct
IKHR

SEQ ID NO: 1416 - protein, 4 aa, synthetic construct
  REGION 1..4: note = Synthetic Construct
IKHS

SEQ ID NO: 1417 - protein, 4 aa, synthetic construct
  REGION 1..4: note = Synthetic Construct
IKHT

SEQ ID NO: 1418 - protein, 4 aa, synthetic construct
  REGION 1..4: note = Synthetic Construct
IKHY

SEQ ID NO: 1419 - protein, 4 aa, synthetic construct
  REGION 1..4: note = Synthetic Construct
IKIA

SEQ ID NO: 1420 - protein, 4 aa, synthetic construct
  REGION 1..4: note = Synthetic Construct
IKID

SEQ ID NO: 1421 - protein, 4 aa, synthetic construct
  REGION 1..4: note = Synthetic Construct
IKIE

SEQ ID NO: 1422 - protein, 4 aa, synthetic construct
  REGION 1..4: note = Synthetic Construct
IKIF

SEQ ID NO: 1423 - protein, 4 aa, synthetic construct
  REGION 1..4: note = Synthetic Construct
IKIG

SEQ ID NO: 1424 - protein, 4 aa, synthetic construct
  REGION 1..4: note = Synthetic Construct
IKIH

SEQ ID NO: 1425 - protein, 4 aa, synthetic construct
  REGION 1..4: note = Synthetic Construct
IKII

SEQ ID NO: 1426 - protein, 4 aa, synthetic construct
  REGION 1..4: note = Synthetic Construct
IKIL

SEQ ID NO: 1427 - protein, 4 aa, synthetic construct
  REGION 1..4: note = Synthetic Construct
IKIN

SEQ ID NO: 1428 - protein, 4 aa, synthetic construct
  REGION 1..4: note = Synthetic Construct
IKIQ

SEQ ID NO: 1429 - protein, 4 aa, synthetic construct
  REGION 1..4: note = Synthetic Construct
IKIR

SEQ ID NO: 1430 - protein, 4 aa, synthetic construct
  REGION 1..4: note = Synthetic Construct
IKIS

SEQ ID NO: 1431 - protein, 4 aa, synthetic construct
  REGION 1..4: note = Synthetic Construct
IKIT

SEQ ID NO: 1432 - protein, 4 aa, synthetic construct
  REGION 1..4: note = Synthetic Construct
IKIY

SEQ ID NO: 1433 - protein, 4 aa, synthetic construct
  REGION 1..4: note = Synthetic Construct
IKLA

SEQ ID NO: 1434 - protein, 4 aa, synthetic construct
  REGION 1..4: note = Synthetic Construct
IKLD

SEQ ID NO: 1435 - protein, 4 aa, synthetic construct
  REGION 1..4: note = Synthetic Construct
IKLE

SEQ ID NO: 1436 - protein, 4 aa, synthetic construct
  REGION 1..4: note = Synthetic Construct
IKLF

SEQ ID NO: 1437 - protein, 4 aa, synthetic construct
  REGION 1..4: note = Synthetic Construct
IKLG

SEQ ID NO: 1438 - protein, 4 aa, synthetic construct
  REGION 1..4: note = Synthetic Construct
IKLH

SEQ ID NO: 1439 - protein, 4 aa, synthetic construct
  REGION 1..4: note = Synthetic Construct
IKLI

SEQ ID NO: 1440 - protein, 4 aa, synthetic construct
  REGION 1..4: note = Synthetic Construct
IKLL

SEQ ID NO: 1441 - protein, 4 aa, synthetic construct
  REGION 1..4: note = Synthetic Construct
IKLN

SEQ ID NO: 1442 - protein, 4 aa, synthetic construct
  REGION 1..4: note = Synthetic Construct
IKLQ

SEQ ID NO: 1443 - protein, 4 aa, synthetic construct
  REGION 1..4: note = Synthetic Construct
IKLR

SEQ ID NO: 1444 - protein, 4 aa, synthetic construct
  REGION 1..4: note = Synthetic Construct
IKLS

SEQ ID NO: 1445 - protein, 4 aa, synthetic construct
  REGION 1..4: note = Synthetic Construct
IKLT

SEQ ID NO: 1446 - protein, 4 aa, synthetic construct
  REGION 1..4: note = Synthetic Construct
IKLY

SEQ ID NO: 1447 - protein, 4 aa, synthetic construct
  REGION 1..4: note = Synthetic Construct
IKNA

SEQ ID NO: 1448 - protein, 4 aa, synthetic construct
  REGION 1..4: note = Synthetic Construct
IKND

SEQ ID NO: 1449 - protein, 4 aa, synthetic construct
  REGION 1..4: note = Synthetic Construct
IKNE

SEQ ID NO: 1450 - protein, 4 aa, synthetic construct
  REGION 1..4: note = Synthetic Construct
IKNF

SEQ ID NO: 1451 - protein, 4 aa, synthetic construct
  REGION 1..4: note = Synthetic Construct
IKNG

SEQ ID NO: 1452 - protein, 4 aa, synthetic construct
  REGION 1..4: note = Synthetic Construct
IKNH

SEQ ID NO: 1453 - protein, 4 aa, synthetic construct
  REGION 1..4: note = Synthetic Construct
IKNI

SEQ ID NO: 1454 - protein, 4 aa, synthetic construct
  REGION 1..4: note = Synthetic Construct
IKNL

SEQ ID NO: 1455 - protein, 4 aa, synthetic construct
  REGION 1..4: note = Synthetic Construct
IKNN

SEQ ID NO: 1456 - protein, 4 aa, synthetic construct
  REGION 1..4: note = Synthetic Construct
IKNQ

SEQ ID NO: 1457 - protein, 4 aa, synthetic construct
  REGION 1..4: note = Synthetic Construct
IKNR

SEQ ID NO: 1458 - protein, 4 aa, synthetic construct
  REGION 1..4: note = Synthetic Construct
IKNS

SEQ ID NO: 1459 - protein, 4 aa, synthetic construct
  REGION 1..4: note = Synthetic Construct
IKNT

SEQ ID NO: 1460 - protein, 4 aa, synthetic construct
  REGION 1..4: note = Synthetic Construct
IKNY

SEQ ID NO: 1461 - protein, 4 aa, synthetic construct
  REGION 1..4: note = Synthetic Construct
IKPA

SEQ ID NO: 1462 - protein, 4 aa, synthetic construct
  REGION 1..4: note = Synthetic Construct
IKPD

SEQ ID NO: 1463 - protein, 4 aa, synthetic construct
  REGION 1..4: note = Synthetic Construct
IKPE

SEQ ID NO: 1464 - protein, 4 aa, synthetic construct
  REGION 1..4: note = Synthetic Construct
IKPF

SEQ ID NO: 1465 - protein, 4 aa, synthetic construct
  REGION 1..4: note = Synthetic Construct
IKPG

SEQ ID NO: 1466 - protein, 4 aa, synthetic construct
  REGION 1..4: note = Synthetic Construct
IKPH

SEQ ID NO: 1467 - protein, 4 aa, synthetic construct
  REGION 1..4: note = Synthetic Construct
IKPI

SEQ ID NO: 1468 - protein, 4 aa, synthetic construct
  REGION 1..4: note = Synthetic Construct
IKPL

SEQ ID NO: 1469 - protein, 4 aa, synthetic construct
  REGION 1..4: note = Synthetic Construct
IKPN

SEQ ID NO: 1470 - protein, 4 aa, synthetic construct
  REGION 1..4: note = Synthetic Construct
IKPQ

SEQ ID NO: 1471 - protein, 4 aa, synthetic construct
  REGION 1..4: note = Synthetic Construct
IKPR

SEQ ID NO: 1472 - protein, 4 aa, synthetic construct
  REGION 1..4: note = Synthetic Construct
IKPS

SEQ ID NO: 1473 - protein, 4 aa, synthetic construct
  REGION 1..4: note = Synthetic Construct
IKPT

SEQ ID NO: 1474 - protein, 4 aa, synthetic construct
  REGION 1..4: note = Synthetic Construct
IKPY

SEQ ID NO: 1475 - protein, 4 aa, synthetic construct
  REGION 1..4: note = Synthetic Construct
IKQA

SEQ ID NO: 1476 - protein, 4 aa, synthetic construct
  REGION 1..4: note = Synthetic Construct
IKQD

SEQ ID NO: 1477 - protein, 4 aa, synthetic construct
  REGION 1..4: note = Synthetic Construct
IKQE

SEQ ID NO: 1478 - protein, 4 aa, synthetic construct
  REGION 1..4: note = Synthetic Construct
IKQF

SEQ ID NO: 1479 - protein, 4 aa, synthetic construct
  REGION 1..4: note = Synthetic Construct
IKQG

SEQ ID NO: 1480 - protein, 4 aa, synthetic construct
  REGION 1..4: note = Synthetic Construct
IKQH

SEQ ID NO: 1481 - protein, 4 aa, synthetic construct
  REGION 1..4: note = Synthetic Construct
IKQI

SEQ ID NO: 1482 - protein, 4 aa, synthetic construct
  REGION 1..4: note = Synthetic Construct
IKQL

SEQ ID NO: 1483 - protein, 4 aa, synthetic construct
  REGION 1..4: note = Synthetic Construct
IKQN

SEQ ID NO: 1484 - protein, 4 aa, synthetic construct
  REGION 1..4: note = Synthetic Construct
IKQQ

SEQ ID NO: 1485 - protein, 4 aa, synthetic construct
  REGION 1..4: note = Synthetic Construct
IKQR

SEQ ID NO: 1486 - protein, 4 aa, synthetic construct
  REGION 1..4: note = Synthetic Construct
IKQS

SEQ ID NO: 1487 - protein, 4 aa, synthetic construct
  REGION 1..4: note = Synthetic Construct
IKQT

SEQ ID NO: 1488 - protein, 4 aa, synthetic construct
  REGION 1..4: note = Synthetic Construct
IKQY

SEQ ID NO: 1489 - protein, 4 aa, synthetic construct
  REGION 1..4: note = Synthetic Construct
IKRA

SEQ ID NO: 1490 - protein, 4 aa, synthetic construct
  REGION 1..4: note = Synthetic Construct
IKRD

SEQ ID NO: 1491 - protein, 4 aa, synthetic construct
  REGION 1..4: note = Synthetic Construct
IKRE

SEQ ID NO: 1492 - protein, 4 aa, synthetic construct
  REGION 1..4: note = Synthetic Construct
IKRF

SEQ ID NO: 1493 - protein, 4 aa, synthetic construct
  REGION 1..4: note = Synthetic Construct
IKRG

SEQ ID NO: 1494 - protein, 4 aa, synthetic construct
  REGION 1..4: note = Synthetic Construct
IKRH

SEQ ID NO: 1495 - protein, 4 aa, synthetic construct
  REGION 1..4: note = Synthetic Construct
IKRI

SEQ ID NO: 1496 - protein, 4 aa, synthetic construct
  REGION 1..4: note = Synthetic Construct
IKRL

SEQ ID NO: 1497 - protein, 4 aa, synthetic construct
  REGION 1..4: note = Synthetic Construct
IKRN

SEQ ID NO: 1498 - protein, 4 aa, synthetic construct
  REGION 1..4: note = Synthetic Construct
IKRQ

SEQ ID NO: 1499 - protein, 4 aa, synthetic construct
  REGION 1..4: note = Synthetic Construct
IKRR

SEQ ID NO: 1500 - protein, 4 aa, synthetic construct
  REGION 1..4: note = Synthetic Construct
IKRS

SEQ ID NO: 1501 - protein, 4 aa, synthetic construct
  REGION 1..4: note = Synthetic Construct
IKRT

SEQ ID NO: 1502 - protein, 4 aa, synthetic construct
  REGION 1..4: note = Synthetic Construct
IKRY

SEQ ID NO: 1503 - protein, 4 aa, synthetic construct
  REGION 1..4: note = Synthetic Construct
IKSA

SEQ ID NO: 1504 - protein, 4 aa, synthetic construct
  REGION 1..4: note = Synthetic Construct
IKSD

SEQ ID NO: 1505 - protein, 4 aa, synthetic construct
  REGION 1..4: note = Synthetic Construct
IKSE

SEQ ID NO: 1506 - protein, 4 aa, synthetic construct
  REGION 1..4: note = Synthetic Construct
IKSF

SEQ ID NO: 1507 - protein, 4 aa, synthetic construct
  REGION 1..4: note = Synthetic Construct
IKSG

SEQ ID NO: 1508 - protein, 4 aa, synthetic construct
  REGION 1..4: note = Synthetic Construct
IKSH

SEQ ID NO: 1509 - protein, 4 aa, synthetic construct
  REGION 1..4: note = Synthetic Construct
IKSI

SEQ ID NO: 1510 - protein, 4 aa, synthetic construct
  REGION 1..4: note = Synthetic Construct
IKSL

SEQ ID NO: 1511 - protein, 4 aa, synthetic construct
  REGION 1..4: note = Synthetic Construct
IKSN

SEQ ID NO: 1512 - protein, 4 aa, synthetic construct
  REGION 1..4: note = Synthetic Construct
IKSQ

SEQ ID NO: 1513 - protein, 4 aa, synthetic construct
  REGION 1..4: note = Synthetic Construct
IKSR

SEQ ID NO: 1514 - protein, 4 aa, synthetic construct
  REGION 1..4: note = Synthetic Construct
IKSS

SEQ ID NO: 1515 - protein, 4 aa, synthetic construct
  REGION 1..4: note = Synthetic Construct
IKST

SEQ ID NO: 1516 - protein, 4 aa, synthetic construct
  REGION 1..4: note = Synthetic Construct
IKSY

SEQ ID NO: 1517 - protein, 4 aa, synthetic construct
  REGION 1..4: note = Synthetic Construct
IKTA

SEQ ID NO: 1518 - protein, 4 aa, synthetic construct
  REGION 1..4: note = Synthetic Construct
IKTD

SEQ ID NO: 1519 - protein, 4 aa, synthetic construct
  REGION 1..4: note = Synthetic Construct
IKTE

SEQ ID NO: 1520 - protein, 4 aa, synthetic construct
  REGION 1..4: note = Synthetic Construct
IKTF

SEQ ID NO: 1521 - protein, 4 aa, synthetic construct
  REGION 1..4: note = Synthetic Construct
IKTG

SEQ ID NO: 1522 - protein, 4 aa, synthetic construct
  REGION 1..4: note = Synthetic Construct
IKTH

SEQ ID NO: 1523 - protein, 4 aa, synthetic construct
  REGION 1..4: note = Synthetic Construct
IKTI

SEQ ID NO: 1524 - protein, 4 aa, synthetic construct
  REGION 1..4: note = Synthetic Construct
IKTL

SEQ ID NO: 1525 - protein, 4 aa, synthetic construct
  REGION 1..4: note = Synthetic Construct
IKTN

SEQ ID NO: 1526 - protein, 4 aa, synthetic construct
  REGION 1..4: note = Synthetic Construct
IKTQ

SEQ ID NO: 1527 - protein, 4 aa, synthetic construct
  REGION 1..4: note = Synthetic Construct
IKTR

SEQ ID NO: 1528 - protein, 4 aa, synthetic construct
  REGION 1..4: note = Synthetic Construct
IKTS

SEQ ID NO: 1529 - protein, 4 aa, synthetic construct
  REGION 1..4: note = Synthetic Construct
IKTT

SEQ ID NO: 1530 - protein, 4 aa, synthetic construct
  REGION 1..4: note = Synthetic Construct
IKTY

SEQ ID NO: 1531 - protein, 4 aa, synthetic construct
  REGION 1..4: note = Synthetic Construct
IKYA

SEQ ID NO: 1532 - protein, 4 aa, synthetic construct
  REGION 1..4: note = Synthetic Construct
IKYD

SEQ ID NO: 1533 - protein, 4 aa, synthetic construct
  REGION 1..4: note = Synthetic Construct
IKYE

SEQ ID NO: 1534 - protein, 4 aa, synthetic construct
  REGION 1..4: note = Synthetic Construct
IKYF

SEQ ID NO: 1535 - protein, 4 aa, synthetic construct
  REGION 1..4: note = Synthetic Construct
IKYG

SEQ ID NO: 1536 - protein, 4 aa, synthetic construct
  REGION 1..4: note = Synthetic Construct
IKYH

SEQ ID NO: 1537 - protein, 4 aa, synthetic construct
  REGION 1..4: note = Synthetic Construct
IKYI

SEQ ID NO: 1538 - protein, 4 aa, synthetic construct
  REGION 1..4: note = Synthetic Construct
IKYL

SEQ ID NO: 1539 - protein, 4 aa, synthetic construct
  REGION 1..4: note = Synthetic Construct
IKYN

SEQ ID NO: 1540 - protein, 4 aa, synthetic construct
  REGION 1..4: note = Synthetic Construct
IKYQ

SEQ ID NO: 1541 - protein, 4 aa, synthetic construct
  REGION 1..4: note = Synthetic Construct
IKYR

SEQ ID NO: 1542 - protein, 4 aa, synthetic construct
  REGION 1..4: note = Synthetic Construct
IKYS

SEQ ID NO: 1543 - protein, 4 aa, synthetic construct
  REGION 1..4: note = Synthetic Construct
IKYT

SEQ ID NO: 1544 - protein, 4 aa, synthetic construct
  REGION 1..4: note = Synthetic Construct
IKYY

SEQ ID NO: 1545 - protein, 4 aa, synthetic construct
  REGION 1..4: note = Synthetic Construct
LKAA

SEQ ID NO: 1546 - protein, 4 aa, synthetic construct
  REGION 1..4: note = Synthetic Construct
LKAD

SEQ ID NO: 1547 - protein, 4 aa, synthetic construct
  REGION 1..4: note = Synthetic Construct
LKAE

SEQ ID NO: 1548 - protein, 4 aa, synthetic construct
  REGION 1..4: note = Synthetic Construct
LKAF

SEQ ID NO: 1549 - protein, 4 aa, synthetic construct
  REGION 1..4: note = Synthetic Construct
LKAG

SEQ ID NO: 1550 - protein, 4 aa, synthetic construct
  REGION 1..4: note = Synthetic Construct
LKAH

SEQ ID NO: 1551 - protein, 4 aa, synthetic construct
  REGION 1..4: note = Synthetic Construct
LKAI

SEQ ID NO: 1552 - protein, 4 aa, synthetic construct
  REGION 1..4: note = Synthetic Construct
LKAL

SEQ ID NO: 1553 - protein, 4 aa, synthetic construct
  REGION 1..4: note = Synthetic Construct
LKAN

SEQ ID NO: 1554 - protein, 4 aa, synthetic construct
  REGION 1..4: note = Synthetic Construct
LKAQ

SEQ ID NO: 1555 - protein, 4 aa, synthetic construct
  REGION 1..4: note = Synthetic Construct
LKAR

SEQ ID NO: 1556 - protein, 4 aa, synthetic construct
  REGION 1..4: note = Synthetic Construct
LKAS

SEQ ID NO: 1557 - protein, 4 aa, synthetic construct
  REGION 1..4: note = Synthetic Construct
LKAT

SEQ ID NO: 1558 - protein, 4 aa, synthetic construct
  REGION 1..4: note = Synthetic Construct
LKAY

SEQ ID NO: 1559 - protein, 4 aa, synthetic construct
  REGION 1..4: note = Synthetic Construct
LKDA

SEQ ID NO: 1560 - protein, 4 aa, synthetic construct
  REGION 1..4: note = Synthetic Construct
LKDD

SEQ ID NO: 1561 - protein, 4 aa, synthetic construct
  REGION 1..4: note = Synthetic Construct
LKDE

SEQ ID NO: 1562 - protein, 4 aa, synthetic construct
  REGION 1..4: note = Synthetic Construct
LKDF

SEQ ID NO: 1563 - protein, 4 aa, synthetic construct
  REGION 1..4: note = Synthetic Construct
LKDG

SEQ ID NO: 1564 - protein, 4 aa, synthetic construct
  REGION 1..4: note = Synthetic Construct
LKDH

SEQ ID NO: 1565 - protein, 4 aa, synthetic construct
  REGION 1..4: note = Synthetic Construct
LKDI

SEQ ID NO: 1566 - protein, 4 aa, synthetic construct
  REGION 1..4: note = Synthetic Construct
LKDL

SEQ ID NO: 1567 - protein, 4 aa, synthetic construct
  REGION 1..4: note = Synthetic Construct
LKDN

SEQ ID NO: 1568 - protein, 4 aa, synthetic construct
  REGION 1..4: note = Synthetic Construct
LKDQ

SEQ ID NO: 1569 - protein, 4 aa, synthetic construct
  REGION 1..4: note = Synthetic Construct
LKDR

SEQ ID NO: 1570 - protein, 4 aa, synthetic construct
  REGION 1..4: note = Synthetic Construct
LKDS

SEQ ID NO: 1571 - protein, 4 aa, synthetic construct
  REGION 1..4: note = Synthetic Construct
LKDT

SEQ ID NO: 1572 - protein, 4 aa, synthetic construct
  REGION 1..4: note = Synthetic Construct
LKDY

SEQ ID NO: 1573 - protein, 4 aa, synthetic construct
  REGION 1..4: note = Synthetic Construct
LKEA

SEQ ID NO: 1574 - protein, 4 aa, synthetic construct
  REGION 1..4: note = Synthetic Construct
LKED

SEQ ID NO: 1575 - protein, 4 aa, synthetic construct
  REGION 1..4: note = Synthetic Construct
LKEE

SEQ ID NO: 1576 - protein, 4 aa, synthetic construct
  REGION 1..4: note = Synthetic Construct
LKEF

SEQ ID NO: 1577 - protein, 4 aa, synthetic construct
  REGION 1..4: note = Synthetic Construct
LKEG

SEQ ID NO: 1578 - protein, 4 aa, synthetic construct
  REGION 1..4: note = Synthetic Construct
LKEH

SEQ ID NO: 1579 - protein, 4 aa, synthetic construct
  REGION 1..4: note = Synthetic Construct
LKEI

SEQ ID NO: 1580 - protein, 4 aa, synthetic construct
  REGION 1..4: note = Synthetic Construct
LKEL

SEQ ID NO: 1581 - protein, 4 aa, synthetic construct
  REGION 1..4: note = Synthetic Construct
LKEN

SEQ ID NO: 1582 - protein, 4 aa, synthetic construct
  REGION 1..4: note = Synthetic Construct
LKEQ

SEQ ID NO: 1583 - protein, 4 aa, synthetic construct
  REGION 1..4: note = Synthetic Construct
LKER

SEQ ID NO: 1584 - protein, 4 aa, synthetic construct
  REGION 1..4: note = Synthetic Construct
LKES

SEQ ID NO: 1585 - protein, 4 aa, synthetic construct
  REGION 1..4: note = Synthetic Construct
LKET

SEQ ID NO: 1586 - protein, 4 aa, synthetic construct
  REGION 1..4: note = Synthetic Construct
LKEY

SEQ ID NO: 1587 - protein, 4 aa, synthetic construct
  REGION 1..4: note = Synthetic Construct
LKFA

SEQ ID NO: 1588 - protein, 4 aa, synthetic construct
  REGION 1..4: note = Synthetic Construct
LKFD

SEQ ID NO: 1589 - protein, 4 aa, synthetic construct
  REGION 1..4: note = Synthetic Construct
LKFE

SEQ ID NO: 1590 - protein, 4 aa, synthetic construct
  REGION 1..4: note = Synthetic Construct
LKFF

SEQ ID NO: 1591 - protein, 4 aa, synthetic construct
  REGION 1..4: note = Synthetic Construct
LKFG

SEQ ID NO: 1592 - protein, 4 aa, synthetic construct
  REGION 1..4: note = Synthetic Construct
LKFH

SEQ ID NO: 1593 - protein, 4 aa, synthetic construct
  REGION 1..4: note = Synthetic Construct
LKFI

SEQ ID NO: 1594 - protein, 4 aa, synthetic construct
  REGION 1..4: note = Synthetic Construct
LKFL

SEQ ID NO: 1595 - protein, 4 aa, synthetic construct
  REGION 1..4: note = Synthetic Construct
LKFN

SEQ ID NO: 1596 - protein, 4 aa, synthetic construct
  REGION 1..4: note = Synthetic Construct
LKFQ

SEQ ID NO: 1597 - protein, 4 aa, synthetic construct
  REGION 1..4: note = Synthetic Construct
LKFR

SEQ ID NO: 1598 - protein, 4 aa, synthetic construct
  REGION 1..4: note = Synthetic Construct
LKFS

SEQ ID NO: 1599 - protein, 4 aa, synthetic construct
  REGION 1..4: note = Synthetic Construct
LKFT

SEQ ID NO: 1600 - protein, 4 aa, synthetic construct
  REGION 1..4: note = Synthetic Construct
LKFY

SEQ ID NO: 1601 - protein, 4 aa, synthetic construct
  REGION 1..4: note = Synthetic Construct
LKGA

SEQ ID NO: 1602 - protein, 4 aa, synthetic construct
  REGION 1..4: note = Synthetic Construct
LKGD

SEQ ID NO: 1603 - protein, 4 aa, synthetic construct
  REGION 1..4: note = Synthetic Construct
LKGE

SEQ ID NO: 1604 - protein, 4 aa, synthetic construct
  REGION 1..4: note = Synthetic Construct
LKGF

SEQ ID NO: 1605 - protein, 4 aa, synthetic construct
  REGION 1..4: note = Synthetic Construct
LKGG

SEQ ID NO: 1606 - protein, 4 aa, synthetic construct
  REGION 1..4: note = Synthetic Construct
LKGH

SEQ ID NO: 1607 - protein, 4 aa, synthetic construct
  REGION 1..4: note = Synthetic Construct
LKGI

SEQ ID NO: 1608 - protein, 4 aa, synthetic construct
  REGION 1..4: note = Synthetic Construct
LKGL

SEQ ID NO: 1609 - protein, 4 aa, synthetic construct
  REGION 1..4: note = Synthetic Construct
LKGN

SEQ ID NO: 1610 - protein, 4 aa, synthetic construct
  REGION 1..4: note = Synthetic Construct
LKGQ

SEQ ID NO: 1611 - protein, 4 aa, synthetic construct
  REGION 1..4: note = Synthetic Construct
LKGR

SEQ ID NO: 1612 - protein, 4 aa, synthetic construct
  REGION 1..4: note = Synthetic Construct
LKGS

SEQ ID NO: 1613 - protein, 4 aa, synthetic construct
  REGION 1..4: note = Synthetic Construct
LKGT

SEQ ID NO: 1614 - protein, 4 aa, synthetic construct
  REGION 1..4: note = Synthetic Construct
LKGY

SEQ ID NO: 1615 - protein, 4 aa, synthetic construct
  REGION 1..4: note = Synthetic Construct
LKHA

SEQ ID NO: 1616 - protein, 4 aa, synthetic construct
  REGION 1..4: note = Synthetic Construct
LKHD

SEQ ID NO: 1617 - protein, 4 aa, synthetic construct
  REGION 1..4: note = Synthetic Construct
LKHE

SEQ ID NO: 1618 - protein, 4 aa, synthetic construct
  REGION 1..4: note = Synthetic Construct
LKHF

SEQ ID NO: 1619 - protein, 4 aa, synthetic construct
  REGION 1..4: note = Synthetic Construct
LKHG

SEQ ID NO: 1620 - protein, 4 aa, synthetic construct
  REGION 1..4: note = Synthetic Construct
LKHH

SEQ ID NO: 1621 - protein, 4 aa, synthetic construct
  REGION 1..4: note = Synthetic Construct
LKHI

SEQ ID NO: 1622 - protein, 4 aa, synthetic construct
  REGION 1..4: note = Synthetic Construct
LKHL

SEQ ID NO: 1623 - protein, 4 aa, synthetic construct
  REGION 1..4: note = Synthetic Construct
LKHN

SEQ ID NO: 1624 - protein, 4 aa, synthetic construct
  REGION 1..4: note = Synthetic Construct
LKHQ

SEQ ID NO: 1625 - protein, 4 aa, synthetic construct
  REGION 1..4: note = Synthetic Construct
LKHR

SEQ ID NO: 1626 - protein, 4 aa, synthetic construct
  REGION 1..4: note = Synthetic Construct
LKHS

SEQ ID NO: 1627 - protein, 4 aa, synthetic construct
  REGION 1..4: note = Synthetic Construct
LKHT

SEQ ID NO: 1628 - protein, 4 aa, synthetic construct
  REGION 1..4: note = Synthetic Construct
LKHY

SEQ ID NO: 1629 - protein, 4 aa, synthetic construct
  REGION 1..4: note = Synthetic Construct
LKIA

SEQ ID NO: 1630 - protein, 4 aa, synthetic construct
  REGION 1..4: note = Synthetic Construct
LKID

SEQ ID NO: 1631 - protein, 4 aa, synthetic construct
  REGION 1..4: note = Synthetic Construct
LKIE

SEQ ID NO: 1632 - protein, 4 aa, synthetic construct
  REGION 1..4: note = Synthetic Construct
LKIF

SEQ ID NO: 1633 - protein, 4 aa, synthetic construct
  REGION 1..4: note = Synthetic Construct
LKIG

SEQ ID NO: 1634 - protein, 4 aa, synthetic construct
  REGION 1..4: note = Synthetic Construct
LKIH

SEQ ID NO: 1635 - protein, 4 aa, synthetic construct
  REGION 1..4: note = Synthetic Construct
LKII

SEQ ID NO: 1636 - protein, 4 aa, synthetic construct
  REGION 1..4: note = Synthetic Construct
LKIL

SEQ ID NO: 1637 - protein, 4 aa, synthetic construct
  REGION 1..4: note = Synthetic Construct
LKIN

SEQ ID NO: 1638 - protein, 4 aa, synthetic construct
  REGION 1..4: note = Synthetic Construct
LKIQ

SEQ ID NO: 1639 - protein, 4 aa, synthetic construct
  REGION 1..4: note = Synthetic Construct
LKIR

SEQ ID NO: 1640 - protein, 4 aa, synthetic construct
  REGION 1..4: note = Synthetic Construct
LKIS

SEQ ID NO: 1641 - protein, 4 aa, synthetic construct
  REGION 1..4: note = Synthetic Construct
LKIT

SEQ ID NO: 1642 - protein, 4 aa, synthetic construct
  REGION 1..4: note = Synthetic Construct
LKIY

SEQ ID NO: 1643 - protein, 4 aa, synthetic construct
  REGION 1..4: note = Synthetic Construct
LKLA

SEQ ID NO: 1644 - protein, 4 aa, synthetic construct
  REGION 1..4: note = Synthetic Construct
LKLD

SEQ ID NO: 1645 - protein, 4 aa, synthetic construct
  REGION 1..4: note = Synthetic Construct
LKLE

SEQ ID NO: 1646 - protein, 4 aa, synthetic construct
  REGION 1..4: note = Synthetic Construct
LKLF

SEQ ID NO: 1647 - protein, 4 aa, synthetic construct
  REGION 1..4: note = Synthetic Construct
LKLG

SEQ ID NO: 1648 - protein, 4 aa, synthetic construct
  REGION 1..4: note = Synthetic Construct
LKLH

SEQ ID NO: 1649 - protein, 4 aa, synthetic construct
  REGION 1..4: note = Synthetic Construct
LKLI

SEQ ID NO: 1650 - protein, 4 aa, synthetic construct
  REGION 1..4: note = Synthetic Construct
LKLL

SEQ ID NO: 1651 - protein, 4 aa, synthetic construct
  REGION 1..4: note = Synthetic Construct
LKLN

SEQ ID NO: 1652 - protein, 4 aa, synthetic construct
  REGION 1..4: note = Synthetic Construct
LKLQ

SEQ ID NO: 1653 - protein, 4 aa, synthetic construct
  REGION 1..4: note = Synthetic Construct
LKLR

SEQ ID NO: 1654 - protein, 4 aa, synthetic construct
  REGION 1..4: note = Synthetic Construct
LKLS

SEQ ID NO: 1655 - protein, 4 aa, synthetic construct
  REGION 1..4: note = Synthetic Construct
LKLT

SEQ ID NO: 1656 - protein, 4 aa, synthetic construct
  REGION 1..4: note = Synthetic Construct
LKLY

SEQ ID NO: 1657 - protein, 4 aa, synthetic construct
  REGION 1..4: note = Synthetic Construct
LKNA

SEQ ID NO: 1658 - protein, 4 aa, synthetic construct
  REGION 1..4: note = Synthetic Construct
LKND

SEQ ID NO: 1659 - protein, 4 aa, synthetic construct
  REGION 1..4: note = Synthetic Construct
LKNE

SEQ ID NO: 1660 - protein, 4 aa, synthetic construct
  REGION 1..4: note = Synthetic Construct
LKNF

SEQ ID NO: 1661 - protein, 4 aa, synthetic construct
  REGION 1..4: note = Synthetic Construct
LKNG

SEQ ID NO: 1662 - protein, 4 aa, synthetic construct
  REGION 1..4: note = Synthetic Construct
LKNH

SEQ ID NO: 1663 - protein, 4 aa, synthetic construct
  REGION 1..4: note = Synthetic Construct
LKNI

SEQ ID NO: 1664 - protein, 4 aa, synthetic construct
  REGION 1..4: note = Synthetic Construct
LKNL

SEQ ID NO: 1665 - protein, 4 aa, synthetic construct
  REGION 1..4: note = Synthetic Construct
LKNN

SEQ ID NO: 1666 - protein, 4 aa, synthetic construct
  REGION 1..4: note = Synthetic Construct
LKNQ

SEQ ID NO: 1667 - protein, 4 aa, synthetic construct
  REGION 1..4: note = Synthetic Construct
LKNR

SEQ ID NO: 1668 - protein, 4 aa, synthetic construct
  REGION 1..4: note = Synthetic Construct
LKNS

SEQ ID NO: 1669 - protein, 4 aa, synthetic construct
  REGION 1..4: note = Synthetic Construct
LKNT

SEQ ID NO: 1670 - protein, 4 aa, synthetic construct
  REGION 1..4: note = Synthetic Construct
LKNY

SEQ ID NO: 1671 - protein, 4 aa, synthetic construct
  REGION 1..4: note = Synthetic Construct
LKPA

SEQ ID NO: 1672 - protein, 4 aa, synthetic construct
  REGION 1..4: note = Synthetic Construct
LKPD

SEQ ID NO: 1673 - protein, 4 aa, synthetic construct
  REGION 1..4: note = Synthetic Construct
LKPE

SEQ ID NO: 1674 - protein, 4 aa, synthetic construct
  REGION 1..4: note = Synthetic Construct
LKPF

SEQ ID NO: 1675 - protein, 4 aa, synthetic construct
  REGION 1..4: note = Synthetic Construct
LKPG

SEQ ID NO: 1676 - protein, 4 aa, synthetic construct
  REGION 1..4: note = Synthetic Construct
LKPH

SEQ ID NO: 1677 - protein, 4 aa, synthetic construct
  REGION 1..4: note = Synthetic Construct
LKPI

SEQ ID NO: 1678 - protein, 4 aa, synthetic construct
  REGION 1..4: note = Synthetic Construct
LKPL

SEQ ID NO: 1679 - protein, 4 aa, synthetic construct
  REGION 1..4: note = Synthetic Construct
LKPN

SEQ ID NO: 1680 - protein, 4 aa, synthetic construct
  REGION 1..4: note = Synthetic Construct
LKPQ

SEQ ID NO: 1681 - protein, 4 aa, synthetic construct
  REGION 1..4: note = Synthetic Construct
LKPR

SEQ ID NO: 1682 - protein, 4 aa, synthetic construct
  REGION 1..4: note = Synthetic Construct
LKPS

SEQ ID NO: 1683 - protein, 4 aa, synthetic construct
  REGION 1..4: note = Synthetic Construct
LKPT

SEQ ID NO: 1684 - protein, 4 aa, synthetic construct
  REGION 1..4: note = Synthetic Construct
LKPY

SEQ ID NO: 1685 - protein, 4 aa, synthetic construct
  REGION 1..4: note = Synthetic Construct
LKQA

SEQ ID NO: 1686 - protein, 4 aa, synthetic construct
  REGION 1..4: note = Synthetic Construct
LKQD

SEQ ID NO: 1687 - protein, 4 aa, synthetic construct
  REGION 1..4: note = Synthetic Construct
LKQE

SEQ ID NO: 1688 - protein, 4 aa, synthetic construct
  REGION 1..4: note = Synthetic Construct
LKQF

SEQ ID NO: 1689 - protein, 4 aa, synthetic construct
  REGION 1..4: note = Synthetic Construct
LKQG

SEQ ID NO: 1690 - protein, 4 aa, synthetic construct
  REGION 1..4: note = Synthetic Construct
LKQH

SEQ ID NO: 1691 - protein, 4 aa, synthetic construct
  REGION 1..4: note = Synthetic Construct
LKQI

SEQ ID NO: 1692 - protein, 4 aa, synthetic construct
  REGION 1..4: note = Synthetic Construct
LKQL

SEQ ID NO: 1693 - protein, 4 aa, synthetic construct
  REGION 1..4: note = Synthetic Construct
LKQN

SEQ ID NO: 1694 - protein, 4 aa, synthetic construct
  REGION 1..4: note = Synthetic Construct
LKQQ

SEQ ID NO: 1695 - protein, 4 aa, synthetic construct
  REGION 1..4: note = Synthetic Construct
LKQR

SEQ ID NO: 1696 - protein, 4 aa, synthetic construct
  REGION 1..4: note = Synthetic Construct
LKQS

SEQ ID NO: 1697 - protein, 4 aa, synthetic construct
  REGION 1..4: note = Synthetic Construct
LKQT

SEQ ID NO: 1698 - protein, 4 aa, synthetic construct
  REGION 1..4: note = Synthetic Construct
LKQY

SEQ ID NO: 1699 - protein, 4 aa, synthetic construct
  REGION 1..4: note = Synthetic Construct
LKRA

SEQ ID NO: 1700 - protein, 4 aa, synthetic construct
  REGION 1..4: note = Synthetic Construct
LKRD

SEQ ID NO: 1701 - protein, 4 aa, synthetic construct
  REGION 1..4: note = Synthetic Construct
LKRE

SEQ ID NO: 1702 - protein, 4 aa, synthetic construct
  REGION 1..4: note = Synthetic Construct
LKRF

SEQ ID NO: 1703 - protein, 4 aa, synthetic construct
  REGION 1..4: note = Synthetic Construct
LKRG

SEQ ID NO: 1704 - protein, 4 aa, synthetic construct
  REGION 1..4: note = Synthetic Construct
LKRH

SEQ ID NO: 1705 - protein, 4 aa, synthetic construct
  REGION 1..4: note = Synthetic Construct
LKRI

SEQ ID NO: 1706 - protein, 4 aa, synthetic construct
  REGION 1..4: note = Synthetic Construct
LKRL

SEQ ID NO: 1707 - protein, 4 aa, synthetic construct
  REGION 1..4: note = Synthetic Construct
LKRN

SEQ ID NO: 1708 - protein, 4 aa, synthetic construct
  REGION 1..4: note = Synthetic Construct
LKRQ

SEQ ID NO: 1709 - protein, 4 aa, synthetic construct
  REGION 1..4: note = Synthetic Construct
LKRR

SEQ ID NO: 1710 - protein, 4 aa, synthetic construct
  REGION 1..4: note = Synthetic Construct
LKRS

SEQ ID NO: 1711 - protein, 4 aa, synthetic construct
  REGION 1..4: note = Synthetic Construct
LKRT

SEQ ID NO: 1712 - protein, 4 aa, synthetic construct
  REGION 1..4: note = Synthetic Construct
LKRY

SEQ ID NO: 1713 - protein, 4 aa, synthetic construct
  REGION 1..4: note = Synthetic Construct
LKSA

SEQ ID NO: 1714 - protein, 4 aa, synthetic construct
  REGION 1..4: note = Synthetic Construct
LKSD

SEQ ID NO: 1715 - protein, 4 aa, synthetic construct
  REGION 1..4: note = Synthetic Construct
LKSE

SEQ ID NO: 1716 - protein, 4 aa, synthetic construct
  REGION 1..4: note = Synthetic Construct
LKSF

SEQ ID NO: 1717 - protein, 4 aa, synthetic construct
  REGION 1..4: note = Synthetic Construct
LKSG

SEQ ID NO: 1718 - protein, 4 aa, synthetic construct
  REGION 1..4: note = Synthetic Construct
LKSH

SEQ ID NO: 1719 - protein, 4 aa, synthetic construct
  REGION 1..4: note = Synthetic Construct
LKSI

SEQ ID NO: 1720 - protein, 4 aa, synthetic construct
  REGION 1..4: note = Synthetic Construct
LKSL

SEQ ID NO: 1721 - protein, 4 aa, synthetic construct
  REGION 1..4: note = Synthetic Construct
LKSN

SEQ ID NO: 1722 - protein, 4 aa, synthetic construct
  REGION 1..4: note = Synthetic Construct
LKSQ

SEQ ID NO: 1723 - protein, 4 aa, synthetic construct
  REGION 1..4: note = Synthetic Construct
LKSR

SEQ ID NO: 1724 - protein, 4 aa, synthetic construct
  REGION 1..4: note = Synthetic Construct
LKSS

SEQ ID NO: 1725 - protein, 4 aa, synthetic construct
  REGION 1..4: note = Synthetic Construct
LKST

SEQ ID NO: 1726 - protein, 4 aa, synthetic construct
  REGION 1..4: note = Synthetic Construct
LKSY

SEQ ID NO: 1727 - protein, 4 aa, synthetic construct
  REGION 1..4: note = Synthetic Construct
LKTA

SEQ ID NO: 1728 - protein, 4 aa, synthetic construct
  REGION 1..4: note = Synthetic Construct
LKTD

SEQ ID NO: 1729 - protein, 4 aa, synthetic construct
  REGION 1..4: note = Synthetic Construct
LKTE

SEQ ID NO: 1730 - protein, 4 aa, synthetic construct
  REGION 1..4: note = Synthetic Construct
LKTF

SEQ ID NO: 1731 - protein, 4 aa, synthetic construct
  REGION 1..4: note = Synthetic Construct
LKTG

SEQ ID NO: 1732 - protein, 4 aa, synthetic construct
  REGION 1..4: note = Synthetic Construct
LKTH

SEQ ID NO: 1733 - protein, 4 aa, synthetic construct
  REGION 1..4: note = Synthetic Construct
LKTI

SEQ ID NO: 1734 - protein, 4 aa, synthetic construct
  REGION 1..4: note = Synthetic Construct
LKTL

SEQ ID NO: 1735 - protein, 4 aa, synthetic construct
  REGION 1..4: note = Synthetic Construct
LKTN

SEQ ID NO: 1736 - protein, 4 aa, synthetic construct
  REGION 1..4: note = Synthetic Construct
LKTQ

SEQ ID NO: 1737 - protein, 4 aa, synthetic construct
  REGION 1..4: note = Synthetic Construct
LKTR

SEQ ID NO: 1738 - protein, 4 aa, synthetic construct
  REGION 1..4: note = Synthetic Construct
LKTS

SEQ ID NO: 1739 - protein, 4 aa, synthetic construct
  REGION 1..4: note = Synthetic Construct
LKTT

SEQ ID NO: 1740 - protein, 4 aa, synthetic construct
  REGION 1..4: note = Synthetic Construct
LKTY

SEQ ID NO: 1741 - protein, 4 aa, synthetic construct
  REGION 1..4: note = Synthetic Construct
LKYA

SEQ ID NO: 1742 - protein, 4 aa, synthetic construct
  REGION 1..4: note = Synthetic Construct
LKYD

SEQ ID NO: 1743 - protein, 4 aa, synthetic construct
  REGION 1..4: note = Synthetic Construct
LKYE

SEQ ID NO: 1744 - protein, 4 aa, synthetic construct
  REGION 1..4: note = Synthetic Construct
LKYF

SEQ ID NO: 1745 - protein, 4 aa, synthetic construct
  REGION 1..4: note = Synthetic Construct
LKYG

SEQ ID NO: 1746 - protein, 4 aa, synthetic construct
  REGION 1..4: note = Synthetic Construct
LKYH

SEQ ID NO: 1747 - protein, 4 aa, synthetic construct
  REGION 1..4: note = Synthetic Construct
LKYI

SEQ ID NO: 1748 - protein, 4 aa, synthetic construct
  REGION 1..4: note = Synthetic Construct
LKYL

SEQ ID NO: 1749 - protein, 4 aa, synthetic construct
  REGION 1..4: note = Synthetic Construct
LKYN

SEQ ID NO: 1750 - protein, 4 aa, synthetic construct
  REGION 1..4: note = Synthetic Construct
LKYQ

SEQ ID NO: 1751 - protein, 4 aa, synthetic construct
  REGION 1..4: note = Synthetic Construct
LKYR

SEQ ID NO: 1752 - protein, 4 aa, synthetic construct
  REGION 1..4: note = Synthetic Construct
LKYS

SEQ ID NO: 1753 - protein, 4 aa, synthetic construct
  REGION 1..4: note = Synthetic Construct
LKYT

SEQ ID NO: 1754 - protein, 4 aa, synthetic construct
  REGION 1..4: note = Synthetic Construct
LKYY

SEQ ID NO: 1755 - protein, 4 aa, synthetic construct
  REGION 1..4: note = Synthetic Construct
NKAA

SEQ ID NO: 1756 - protein, 4 aa, synthetic construct
  REGION 1..4: note = Synthetic Construct
NKAD

SEQ ID NO: 1757 - protein, 4 aa, synthetic construct
  REGION 1..4: note = Synthetic Construct
NKAE

SEQ ID NO: 1758 - protein, 4 aa, synthetic construct
  REGION 1..4: note = Synthetic Construct
NKAF

SEQ ID NO: 1759 - protein, 4 aa, synthetic construct
  REGION 1..4: note = Synthetic Construct
NKAG

SEQ ID NO: 1760 - protein, 4 aa, synthetic construct
  REGION 1..4: note = Synthetic Construct
NKAH

SEQ ID NO: 1761 - protein, 4 aa, synthetic construct
  REGION 1..4: note = Synthetic Construct
NKAI

SEQ ID NO: 1762 - protein, 4 aa, synthetic construct
  REGION 1..4: note = Synthetic Construct
NKAL

SEQ ID NO: 1763 - protein, 4 aa, synthetic construct
  REGION 1..4: note = Synthetic Construct
NKAN

SEQ ID NO: 1764 - protein, 4 aa, synthetic construct
  REGION 1..4: note = Synthetic Construct
NKAQ

SEQ ID NO: 1765 - protein, 4 aa, synthetic construct
  REGION 1..4: note = Synthetic Construct
NKAR

SEQ ID NO: 1766 - protein, 4 aa, synthetic construct
  REGION 1..4: note = Synthetic Construct
NKAS

SEQ ID NO: 1767 - protein, 4 aa, synthetic construct
  REGION 1..4: note = Synthetic Construct
NKAT

SEQ ID NO: 1768 - protein, 4 aa, synthetic construct
  REGION 1..4: note = Synthetic Construct
NKAY

SEQ ID NO: 1769 - protein, 4 aa, synthetic construct
  REGION 1..4: note = Synthetic Construct
NKDA

SEQ ID NO: 1770 - protein, 4 aa, synthetic construct
  REGION 1..4: note = Synthetic Construct
NKDD

SEQ ID NO: 1771 - protein, 4 aa, synthetic construct
  REGION 1..4: note = Synthetic Construct
NKDE

SEQ ID NO: 1772 - protein, 4 aa, synthetic construct
  REGION 1..4: note = Synthetic Construct
NKDF

SEQ ID NO: 1773 - protein, 4 aa, synthetic construct
  REGION 1..4: note = Synthetic Construct
NKDG

SEQ ID NO: 1774 - protein, 4 aa, synthetic construct
  REGION 1..4: note = Synthetic Construct
NKDH

SEQ ID NO: 1775 - protein, 4 aa, synthetic construct
  REGION 1..4: note = Synthetic Construct
NKDI

SEQ ID NO: 1776 - protein, 4 aa, synthetic construct
  REGION 1..4: note = Synthetic Construct
NKDL

SEQ ID NO: 1777 - protein, 4 aa, synthetic construct
  REGION 1..4: note = Synthetic Construct
NKDN

SEQ ID NO: 1778 - protein, 4 aa, synthetic construct
  REGION 1..4: note = Synthetic Construct
NKDQ

SEQ ID NO: 1779 - protein, 4 aa, synthetic construct
  REGION 1..4: note = Synthetic Construct
NKDR

SEQ ID NO: 1780 - protein, 4 aa, synthetic construct
  REGION 1..4: note = Synthetic Construct
NKDS

SEQ ID NO: 1781 - protein, 4 aa, synthetic construct
  REGION 1..4: note = Synthetic Construct
NKDT

SEQ ID NO: 1782 - protein, 4 aa, synthetic construct
  REGION 1..4: note = Synthetic Construct
NKDY

SEQ ID NO: 1783 - protein, 4 aa, synthetic construct
  REGION 1..4: note = Synthetic Construct
NKEA

SEQ ID NO: 1784 - protein, 4 aa, synthetic construct
  REGION 1..4: note = Synthetic Construct
NKED

SEQ ID NO: 1785 - protein, 4 aa, synthetic construct
  REGION 1..4: note = Synthetic Construct
NKEE

SEQ ID NO: 1786 - protein, 4 aa, synthetic construct
  REGION 1..4: note = Synthetic Construct
NKEF

SEQ ID NO: 1787 - protein, 4 aa, synthetic construct
  REGION 1..4: note = Synthetic Construct
NKEG

SEQ ID NO: 1788 - protein, 4 aa, synthetic construct
  REGION 1..4: note = Synthetic Construct
NKEH

SEQ ID NO: 1789 - protein, 4 aa, synthetic construct
  REGION 1..4: note = Synthetic Construct
NKEI

SEQ ID NO: 1790 - protein, 4 aa, synthetic construct
  REGION 1..4: note = Synthetic Construct
NKEL

SEQ ID NO: 1791 - protein, 4 aa, synthetic construct
  REGION 1..4: note = Synthetic Construct
NKEN

SEQ ID NO: 1792 - protein, 4 aa, synthetic construct
  REGION 1..4: note = Synthetic Construct
NKEQ

SEQ ID NO: 1793 - protein, 4 aa, synthetic construct
  REGION 1..4: note = Synthetic Construct
NKER

SEQ ID NO: 1794 - protein, 4 aa, synthetic construct
  REGION 1..4: note = Synthetic Construct
NKES

SEQ ID NO: 1795 - protein, 4 aa, synthetic construct
  REGION 1..4: note = Synthetic Construct
NKET

SEQ ID NO: 1796 - protein, 4 aa, synthetic construct
  REGION 1..4: note = Synthetic Construct
NKEY

SEQ ID NO: 1797 - protein, 4 aa, synthetic construct
  REGION 1..4: note = Synthetic Construct
NKFA

SEQ ID NO: 1798 - protein, 4 aa, synthetic construct
  REGION 1..4: note = Synthetic Construct
NKFD

SEQ ID NO: 1799 - protein, 4 aa, synthetic construct
  REGION 1..4: note = Synthetic Construct
NKFE

SEQ ID NO: 1800 - protein, 4 aa, synthetic construct
  REGION 1..4: note = Synthetic Construct
NKFF

SEQ ID NO: 1801 - protein, 4 aa, synthetic construct
  REGION 1..4: note = Synthetic Construct
NKFG

SEQ ID NO: 1802 - protein, 4 aa, synthetic construct
  REGION 1..4: note = Synthetic Construct
NKFH

SEQ ID NO: 1803 - protein, 4 aa, synthetic construct
  REGION 1..4: note = Synthetic Construct
NKFI

SEQ ID NO: 1804 - protein, 4 aa, synthetic construct
  REGION 1..4: note = Synthetic Construct
NKFL

SEQ ID NO: 1805 - protein, 4 aa, synthetic construct
  REGION 1..4: note = Synthetic Construct
NKFN

SEQ ID NO: 1806 - protein, 4 aa, synthetic construct
  REGION 1..4: note = Synthetic Construct
NKFQ

SEQ ID NO: 1807 - protein, 4 aa, synthetic construct
  REGION 1..4: note = Synthetic Construct
NKFR

SEQ ID NO: 1808 - protein, 4 aa, synthetic construct
  REGION 1..4: note = Synthetic Construct
NKFS

SEQ ID NO: 1809 - protein, 4 aa, synthetic construct
  REGION 1..4: note = Synthetic Construct
NKFT

SEQ ID NO: 1810 - protein, 4 aa, synthetic construct
  REGION 1..4: note = Synthetic Construct
NKFY

SEQ ID NO: 1811 - protein, 4 aa, synthetic construct
  REGION 1..4: note = Synthetic Construct
NKGA

SEQ ID NO: 1812 - protein, 4 aa, synthetic construct
  REGION 1..4: note = Synthetic Construct
NKGD

SEQ ID NO: 1813 - protein, 4 aa, synthetic construct
  REGION 1..4: note = Synthetic Construct
NKGE

SEQ ID NO: 1814 - protein, 4 aa, synthetic construct
  REGION 1..4: note = Synthetic Construct
NKGF

SEQ ID NO: 1815 - protein, 4 aa, synthetic construct
  REGION 1..4: note = Synthetic Construct
NKGG

SEQ ID NO: 1816 - protein, 4 aa, synthetic construct
  REGION 1..4: note = Synthetic Construct
NKGH

SEQ ID NO: 1817 - protein, 4 aa, synthetic construct
  REGION 1..4: note = Synthetic Construct
NKGI

SEQ ID NO: 1818 - protein, 4 aa, synthetic construct
  REGION 1..4: note = Synthetic Construct
NKGL

SEQ ID NO: 1819 - protein, 4 aa, synthetic construct
  REGION 1..4: note = Synthetic Construct
NKGN

SEQ ID NO: 1820 - protein, 4 aa, synthetic construct
  REGION 1..4: note = Synthetic Construct
NKGQ

SEQ ID NO: 1821 - protein, 4 aa, synthetic construct
  REGION 1..4: note = Synthetic Construct
NKGR

SEQ ID NO: 1822 - protein, 4 aa, synthetic construct
  REGION 1..4: note = Synthetic Construct
NKGS

SEQ ID NO: 1823 - protein, 4 aa, synthetic construct
  REGION 1..4: note = Synthetic Construct
NKGT

SEQ ID NO: 1824 - protein, 4 aa, synthetic construct
  REGION 1..4: note = Synthetic Construct
NKGY

SEQ ID NO: 1825 - protein, 4 aa, synthetic construct
  REGION 1..4: note = Synthetic Construct
NKHA

SEQ ID NO: 1826 - protein, 4 aa, synthetic construct
  REGION 1..4: note = Synthetic Construct
NKHD

SEQ ID NO: 1827 - protein, 4 aa, synthetic construct
  REGION 1..4: note = Synthetic Construct
NKHE

SEQ ID NO: 1828 - protein, 4 aa, synthetic construct
  REGION 1..4: note = Synthetic Construct
NKHF

SEQ ID NO: 1829 - protein, 4 aa, synthetic construct
  REGION 1..4: note = Synthetic Construct
NKHG

SEQ ID NO: 1830 - protein, 4 aa, synthetic construct
  REGION 1..4: note = Synthetic Construct
NKHH

SEQ ID NO: 1831 - protein, 4 aa, synthetic construct
  REGION 1..4: note = Synthetic Construct
NKHI

SEQ ID NO: 1832 - protein, 4 aa, synthetic construct
  REGION 1..4: note = Synthetic Construct
NKHL

SEQ ID NO: 1833 - protein, 4 aa, synthetic construct
  REGION 1..4: note = Synthetic Construct
NKHN

SEQ ID NO: 1834 - protein, 4 aa, synthetic construct
  REGION 1..4: note = Synthetic Construct
NKHQ

SEQ ID NO: 1835 - protein, 4 aa, synthetic construct
  REGION 1..4: note = Synthetic Construct
NKHR

SEQ ID NO: 1836 - protein, 4 aa, synthetic construct
  REGION 1..4: note = Synthetic Construct
NKHS

SEQ ID NO: 1837 - protein, 4 aa, synthetic construct
  REGION 1..4: note = Synthetic Construct
NKHT

SEQ ID NO: 1838 - protein, 4 aa, synthetic construct
  REGION 1..4: note = Synthetic Construct
NKHY

SEQ ID NO: 1839 - protein, 4 aa, synthetic construct
  REGION 1..4: note = Synthetic Construct
NKIA

SEQ ID NO: 1840 - protein, 4 aa, synthetic construct
  REGION 1..4: note = Synthetic Construct
NKID

SEQ ID NO: 1841 - protein, 4 aa, synthetic construct
  REGION 1..4: note = Synthetic Construct
NKIE

SEQ ID NO: 1842 - protein, 4 aa, synthetic construct
  REGION 1..4: note = Synthetic Construct
NKIF

SEQ ID NO: 1843 - protein, 4 aa, synthetic construct
  REGION 1..4: note = Synthetic Construct
NKIG

SEQ ID NO: 1844 - protein, 4 aa, synthetic construct
  REGION 1..4: note = Synthetic Construct
NKIH

SEQ ID NO: 1845 - protein, 4 aa, synthetic construct
  REGION 1..4: note = Synthetic Construct
NKII

SEQ ID NO: 1846 - protein, 4 aa, synthetic construct
  REGION 1..4: note = Synthetic Construct
NKIL

SEQ ID NO: 1847 - protein, 4 aa, synthetic construct
  REGION 1..4: note = Synthetic Construct
NKIN

SEQ ID NO: 1848 - protein, 4 aa, synthetic construct
  REGION 1..4: note = Synthetic Construct
NKIQ

SEQ ID NO: 1849 - protein, 4 aa, synthetic construct
  REGION 1..4: note = Synthetic Construct
NKIR

SEQ ID NO: 1850 - protein, 4 aa, synthetic construct
  REGION 1..4: note = Synthetic Construct
NKIS

SEQ ID NO: 1851 - protein, 4 aa, synthetic construct
  REGION 1..4: note = Synthetic Construct
NKIT

SEQ ID NO: 1852 - protein, 4 aa, synthetic construct
  REGION 1..4: note = Synthetic Construct
NKIY

SEQ ID NO: 1853 - protein, 4 aa, synthetic construct
  REGION 1..4: note = Synthetic Construct
NKLA

SEQ ID NO: 1854 - protein, 4 aa, synthetic construct
  REGION 1..4: note = Synthetic Construct
NKLD

SEQ ID NO: 1855 - protein, 4 aa, synthetic construct
  REGION 1..4: note = Synthetic Construct
NKLE

SEQ ID NO: 1856 - protein, 4 aa, synthetic construct
  REGION 1..4: note = Synthetic Construct
NKLF

SEQ ID NO: 1857 - protein, 4 aa, synthetic construct
  REGION 1..4: note = Synthetic Construct
NKLG

SEQ ID NO: 1858 - protein, 4 aa, synthetic construct
  REGION 1..4: note = Synthetic Construct
NKLH

SEQ ID NO: 1859 - protein, 4 aa, synthetic construct
  REGION 1..4: note = Synthetic Construct
NKLI

SEQ ID NO: 1860 - protein, 4 aa, synthetic construct
  REGION 1..4: note = Synthetic Construct
NKLL

SEQ ID NO: 1861 - protein, 4 aa, synthetic construct
  REGION 1..4: note = Synthetic Construct
NKLN

SEQ ID NO: 1862 - protein, 4 aa, synthetic construct
  REGION 1..4: note = Synthetic Construct
NKLQ

SEQ ID NO: 1863 - protein, 4 aa, synthetic construct
  REGION 1..4: note = Synthetic Construct
NKLR

SEQ ID NO: 1864 - protein, 4 aa, synthetic construct
  REGION 1..4: note = Synthetic Construct
NKLS

SEQ ID NO: 1865 - protein, 4 aa, synthetic construct
  REGION 1..4: note = Synthetic Construct
NKLT

SEQ ID NO: 1866 - protein, 4 aa, synthetic construct
  REGION 1..4: note = Synthetic Construct
NKLY

SEQ ID NO: 1867 - protein, 4 aa, synthetic construct
  REGION 1..4: note = Synthetic Construct
NKNA

SEQ ID NO: 1868 - protein, 4 aa, synthetic construct
  REGION 1..4: note = Synthetic Construct
NKND

SEQ ID NO: 1869 - protein, 4 aa, synthetic construct
  REGION 1..4: note = Synthetic Construct
NKNE

SEQ ID NO: 1870 - protein, 4 aa, synthetic construct
  REGION 1..4: note = Synthetic Construct
NKNF

SEQ ID NO: 1871 - protein, 4 aa, synthetic construct
  REGION 1..4: note = Synthetic Construct
NKNG

SEQ ID NO: 1872 - protein, 4 aa, synthetic construct
  REGION 1..4: note = Synthetic Construct
NKNH

SEQ ID NO: 1873 - protein, 4 aa, synthetic construct
  REGION 1..4: note = Synthetic Construct
NKNI

SEQ ID NO: 1874 - protein, 4 aa, synthetic construct
  REGION 1..4: note = Synthetic Construct
NKNL

SEQ ID NO: 1875 - protein, 4 aa, synthetic construct
  REGION 1..4: note = Synthetic Construct
NKNN

SEQ ID NO: 1876 - protein, 4 aa, synthetic construct
  REGION 1..4: note = Synthetic Construct
NKNQ

SEQ ID NO: 1877 - protein, 4 aa, synthetic construct
  REGION 1..4: note = Synthetic Construct
NKNR

SEQ ID NO: 1878 - protein, 4 aa, synthetic construct
  REGION 1..4: note = Synthetic Construct
NKNS

SEQ ID NO: 1879 - protein, 4 aa, synthetic construct
  REGION 1..4: note = Synthetic Construct
NKNT

SEQ ID NO: 1880 - protein, 4 aa, synthetic construct
  REGION 1..4: note = Synthetic Construct
NKNY

SEQ ID NO: 1881 - protein, 4 aa, synthetic construct
  REGION 1..4: note = Synthetic Construct
NKPA

SEQ ID NO: 1882 - protein, 4 aa, synthetic construct
  REGION 1..4: note = Synthetic Construct
NKPD

SEQ ID NO: 1883 - protein, 4 aa, synthetic construct
  REGION 1..4: note = Synthetic Construct
NKPE

SEQ ID NO: 1884 - protein, 4 aa, synthetic construct
  REGION 1..4: note = Synthetic Construct
NKPF

SEQ ID NO: 1885 - protein, 4 aa, synthetic construct
  REGION 1..4: note = Synthetic Construct
NKPG

SEQ ID NO: 1886 - protein, 4 aa, synthetic construct
  REGION 1..4: note = Synthetic Construct
NKPH

SEQ ID NO: 1887 - protein, 4 aa, synthetic construct
  REGION 1..4: note = Synthetic Construct
NKPI

SEQ ID NO: 1888 - protein, 4 aa, synthetic construct
  REGION 1..4: note = Synthetic Construct
NKPL

SEQ ID NO: 1889 - protein, 4 aa, synthetic construct
  REGION 1..4: note = Synthetic Construct
NKPN

SEQ ID NO: 1890 - protein, 4 aa, synthetic construct
  REGION 1..4: note = Synthetic Construct
NKPQ

SEQ ID NO: 1891 - protein, 4 aa, synthetic construct
  REGION 1..4: note = Synthetic Construct
NKPR

SEQ ID NO: 1892 - protein, 4 aa, synthetic construct
  REGION 1..4: note = Synthetic Construct
NKPS

SEQ ID NO: 1893 - protein, 4 aa, synthetic construct
  REGION 1..4: note = Synthetic Construct
NKPT

SEQ ID NO: 1894 - protein, 4 aa, synthetic construct
  REGION 1..4: note = Synthetic Construct
NKPY

SEQ ID NO: 1895 - protein, 4 aa, synthetic construct
  REGION 1..4: note = Synthetic Construct
NKQA

SEQ ID NO: 1896 - protein, 4 aa, synthetic construct
  REGION 1..4: note = Synthetic Construct
NKQD

SEQ ID NO: 1897 - protein, 4 aa, synthetic construct
  REGION 1..4: note = Synthetic Construct
NKQE

SEQ ID NO: 1898 - protein, 4 aa, synthetic construct
  REGION 1..4: note = Synthetic Construct
NKQF

SEQ ID NO: 1899 - protein, 4 aa, synthetic construct
  REGION 1..4: note = Synthetic Construct
NKQG

SEQ ID NO: 1900 - protein, 4 aa, synthetic construct
  REGION 1..4: note = Synthetic Construct
NKQH

SEQ ID NO: 1901 - protein, 4 aa, synthetic construct
  REGION 1..4: note = Synthetic Construct
NKQI

SEQ ID NO: 1902 - protein, 4 aa, synthetic construct
  REGION 1..4: note = Synthetic Construct
NKQL

SEQ ID NO: 1903 - protein, 4 aa, synthetic construct
  REGION 1..4: note = Synthetic Construct
NKQN

SEQ ID NO: 1904 - protein, 4 aa, synthetic construct
  REGION 1..4: note = Synthetic Construct
NKQQ

SEQ ID NO: 1905 - protein, 4 aa, synthetic construct
  REGION 1..4: note = Synthetic Construct
NKQR

SEQ ID NO: 1906 - protein, 4 aa, synthetic construct
  REGION 1..4: note = Synthetic Construct
NKQS

SEQ ID NO: 1907 - protein, 4 aa, synthetic construct
  REGION 1..4: note = Synthetic Construct
NKQT

SEQ ID NO: 1908 - protein, 4 aa, synthetic construct
  REGION 1..4: note = Synthetic Construct
NKQY

SEQ ID NO: 1909 - protein, 4 aa, synthetic construct
  REGION 1..4: note = Synthetic Construct
NKRA

SEQ ID NO: 1910 - protein, 4 aa, synthetic construct
  REGION 1..4: note = Synthetic Construct
NKRD

SEQ ID NO: 1911 - protein, 4 aa, synthetic construct
  REGION 1..4: note = Synthetic Construct
NKRE

SEQ ID NO: 1912 - protein, 4 aa, synthetic construct
  REGION 1..4: note = Synthetic Construct
NKRF

SEQ ID NO: 1913 - protein, 4 aa, synthetic construct
  REGION 1..4: note = Synthetic Construct
NKRG

SEQ ID NO: 1914 - protein, 4 aa, synthetic construct
  REGION 1..4: note = Synthetic Construct
NKRH

SEQ ID NO: 1915 - protein, 4 aa, synthetic construct
  REGION 1..4: note = Synthetic Construct
NKRI

SEQ ID NO: 1916 - protein, 4 aa, synthetic construct
  REGION 1..4: note = Synthetic Construct
NKRL

SEQ ID NO: 1917 - protein, 4 aa, synthetic construct
  REGION 1..4: note = Synthetic Construct
NKRN

SEQ ID NO: 1918 - protein, 4 aa, synthetic construct
  REGION 1..4: note = Synthetic Construct
NKRQ

SEQ ID NO: 1919 - protein, 4 aa, synthetic construct
  REGION 1..4: note = Synthetic Construct
NKRR

SEQ ID NO: 1920 - protein, 4 aa, synthetic construct
  REGION 1..4: note = Synthetic Construct
NKRS

SEQ ID NO: 1921 - protein, 4 aa, synthetic construct
  REGION 1..4: note = Synthetic Construct
NKRT

SEQ ID NO: 1922 - protein, 4 aa, synthetic construct
  REGION 1..4: note = Synthetic Construct
NKRY

SEQ ID NO: 1923 - protein, 4 aa, synthetic construct
  REGION 1..4: note = Synthetic Construct
NKSA

SEQ ID NO: 1924 - protein, 4 aa, synthetic construct
  REGION 1..4: note = Synthetic Construct
NKSD

SEQ ID NO: 1925 - protein, 4 aa, synthetic construct
  REGION 1..4: note = Synthetic Construct
NKSE

SEQ ID NO: 1926 - protein, 4 aa, synthetic construct
  REGION 1..4: note = Synthetic Construct
NKSF

SEQ ID NO: 1927 - protein, 4 aa, synthetic construct
  REGION 1..4: note = Synthetic Construct
NKSG

SEQ ID NO: 1928 - protein, 4 aa, synthetic construct
  REGION 1..4: note = Synthetic Construct
NKSH

SEQ ID NO: 1929 - protein, 4 aa, synthetic construct
  REGION 1..4: note = Synthetic Construct
NKSI

SEQ ID NO: 1930 - protein, 4 aa, synthetic construct
  REGION 1..4: note = Synthetic Construct
NKSL

SEQ ID NO: 1931 - protein, 4 aa, synthetic construct
  REGION 1..4: note = Synthetic Construct
NKSN

SEQ ID NO: 1932 - protein, 4 aa, synthetic construct
  REGION 1..4: note = Synthetic Construct
NKSQ

SEQ ID NO: 1933 - protein, 4 aa, synthetic construct
  REGION 1..4: note = Synthetic Construct
NKSR

SEQ ID NO: 1934 - protein, 4 aa, synthetic construct
  REGION 1..4: note = Synthetic Construct
NKSS

SEQ ID NO: 1935 - protein, 4 aa, synthetic construct
  REGION 1..4: note = Synthetic Construct
NKST

SEQ ID NO: 1936 - protein, 4 aa, synthetic construct
  REGION 1..4: note = Synthetic Construct
NKSY

SEQ ID NO: 1937 - protein, 4 aa, synthetic construct
  REGION 1..4: note = Synthetic Construct
NKTA

SEQ ID NO: 1938 - protein, 4 aa, synthetic construct
  REGION 1..4: note = Synthetic Construct
NKTD

SEQ ID NO: 1939 - protein, 4 aa, synthetic construct
  REGION 1..4: note = Synthetic Construct
NKTE

SEQ ID NO: 1940 - protein, 4 aa, synthetic construct
  REGION 1..4: note = Synthetic Construct
NKTF

SEQ ID NO: 1941 - protein, 4 aa, synthetic construct
  REGION 1..4: note = Synthetic Construct
NKTG

SEQ ID NO: 1942 - protein, 4 aa, synthetic construct
  REGION 1..4: note = Synthetic Construct
NKTH

SEQ ID NO: 1943 - protein, 4 aa, synthetic construct
  REGION 1..4: note = Synthetic Construct
NKTI

SEQ ID NO: 1944 - protein, 4 aa, synthetic construct
  REGION 1..4: note = Synthetic Construct
NKTL

SEQ ID NO: 1945 - protein, 4 aa, synthetic construct
  REGION 1..4: note = Synthetic Construct
NKTN

SEQ ID NO: 1946 - protein, 4 aa, synthetic construct
  REGION 1..4: note = Synthetic Construct
NKTQ

SEQ ID NO: 1947 - protein, 4 aa, synthetic construct
  REGION 1..4: note = Synthetic Construct
NKTR

SEQ ID NO: 1948 - protein, 4 aa, synthetic construct
  REGION 1..4: note = Synthetic Construct
NKTS

SEQ ID NO: 1949 - protein, 4 aa, synthetic construct
  REGION 1..4: note = Synthetic Construct
NKTT

SEQ ID NO: 1950 - protein, 4 aa, synthetic construct
  REGION 1..4: note = Synthetic Construct
NKTY

SEQ ID NO: 1951 - protein, 4 aa, synthetic construct
  REGION 1..4: note = Synthetic Construct
NKYA

SEQ ID NO: 1952 - protein, 4 aa, synthetic construct
  REGION 1..4: note = Synthetic Construct
NKYD

SEQ ID NO: 1953 - protein, 4 aa, synthetic construct
  REGION 1..4: note = Synthetic Construct
NKYE

SEQ ID NO: 1954 - protein, 4 aa, synthetic construct
  REGION 1..4: note = Synthetic Construct
NKYF

SEQ ID NO: 1955 - protein, 4 aa, synthetic construct
  REGION 1..4: note = Synthetic Construct
NKYG

SEQ ID NO: 1956 - protein, 4 aa, synthetic construct
  REGION 1..4: note = Synthetic Construct
NKYH

SEQ ID NO: 1957 - protein, 4 aa, synthetic construct
  REGION 1..4: note = Synthetic Construct
NKYI

SEQ ID NO: 1958 - protein, 4 aa, synthetic construct
  REGION 1..4: note = Synthetic Construct
NKYL

SEQ ID NO: 1959 - protein, 4 aa, synthetic construct
  REGION 1..4: note = Synthetic Construct
NKYN

SEQ ID NO: 1960 - protein, 4 aa, synthetic construct
  REGION 1..4: note = Synthetic Construct
NKYQ

SEQ ID NO: 1961 - protein, 4 aa, synthetic construct
  REGION 1..4: note = Synthetic Construct
NKYR

SEQ ID NO: 1962 - protein, 4 aa, synthetic construct
  REGION 1..4: note = Synthetic Construct
NKYS

SEQ ID NO: 1963 - protein, 4 aa, synthetic construct
  REGION 1..4: note = Synthetic Construct
NKYT

SEQ ID NO: 1964 - protein, 4 aa, synthetic construct
  REGION 1..4: note = Synthetic Construct
NKYY

SEQ ID NO: 1965 - protein, 4 aa, synthetic construct
  REGION 1..4: note = Synthetic Construct
PKAA

SEQ ID NO: 1966 - protein, 4 aa, synthetic construct
  REGION 1..4: note = Synthetic Construct
PKAD

SEQ ID NO: 1967 - protein, 4 aa, synthetic construct
  REGION 1..4: note = Synthetic Construct
PKAE

SEQ ID NO: 1968 - protein, 4 aa, synthetic construct
  REGION 1..4: note = Synthetic Construct
PKAF

SEQ ID NO: 1969 - protein, 4 aa, synthetic construct
  REGION 1..4: note = Synthetic Construct
PKAG

SEQ ID NO: 1970 - protein, 4 aa, synthetic construct
  REGION 1..4: note = Synthetic Construct
PKAH

SEQ ID NO: 1971 - protein, 4 aa, synthetic construct
  REGION 1..4: note = Synthetic Construct
PKAI

SEQ ID NO: 1972 - protein, 4 aa, synthetic construct
  REGION 1..4: note = Synthetic Construct
PKAL

SEQ ID NO: 1973 - protein, 4 aa, synthetic construct
  REGION 1..4: note = Synthetic Construct
PKAN

SEQ ID NO: 1974 - protein, 4 aa, synthetic construct
  REGION 1..4: note = Synthetic Construct
PKAQ

SEQ ID NO: 1975 - protein, 4 aa, synthetic construct
  REGION 1..4: note = Synthetic Construct
PKAR

SEQ ID NO: 1976 - protein, 4 aa, synthetic construct
  REGION 1..4: note = Synthetic Construct
PKAS

SEQ ID NO: 1977 - protein, 4 aa, synthetic construct
  REGION 1..4: note = Synthetic Construct
PKAT

SEQ ID NO: 1978 - protein, 4 aa, synthetic construct
  REGION 1..4: note = Synthetic Construct
PKAY

SEQ ID NO: 1979 - protein, 4 aa, synthetic construct
  REGION 1..4: note = Synthetic Construct
PKDA

SEQ ID NO: 1980 - protein, 4 aa, synthetic construct
  REGION 1..4: note = Synthetic Construct
PKDD

SEQ ID NO: 1981 - protein, 4 aa, synthetic construct
  REGION 1..4: note = Synthetic Construct
PKDE

SEQ ID NO: 1982 - protein, 4 aa, synthetic construct
  REGION 1..4: note = Synthetic Construct
PKDF

SEQ ID NO: 1983 - protein, 4 aa, synthetic construct
  REGION 1..4: note = Synthetic Construct
PKDG

SEQ ID NO: 1984 - protein, 4 aa, synthetic construct
  REGION 1..4: note = Synthetic Construct
PKDH

SEQ ID NO: 1985 - protein, 4 aa, synthetic construct
  REGION 1..4: note = Synthetic Construct
PKDI

SEQ ID NO: 1986 - protein, 4 aa, synthetic construct
  REGION 1..4: note = Synthetic Construct
PKDL

SEQ ID NO: 1987 - protein, 4 aa, synthetic construct
  REGION 1..4: note = Synthetic Construct
PKDN

SEQ ID NO: 1988 - protein, 4 aa, synthetic construct
  REGION 1..4: note = Synthetic Construct
PKDQ

SEQ ID NO: 1989 - protein, 4 aa, synthetic construct
  REGION 1..4: note = Synthetic Construct
PKDR

SEQ ID NO: 1990 - protein, 4 aa, synthetic construct
  REGION 1..4: note = Synthetic Construct
PKDS

SEQ ID NO: 1991 - protein, 4 aa, synthetic construct
  REGION 1..4: note = Synthetic Construct
PKDT

SEQ ID NO: 1992 - protein, 4 aa, synthetic construct
  REGION 1..4: note = Synthetic Construct
PKDY

SEQ ID NO: 1993 - protein, 4 aa, synthetic construct
  REGION 1..4: note = Synthetic Construct
PKEA

SEQ ID NO: 1994 - protein, 4 aa, synthetic construct
  REGION 1..4: note = Synthetic Construct
PKED

SEQ ID NO: 1995 - protein, 4 aa, synthetic construct
  REGION 1..4: note = Synthetic Construct
PKEE

SEQ ID NO: 1996 - protein, 4 aa, synthetic construct
  REGION 1..4: note = Synthetic Construct
PKEF

SEQ ID NO: 1997 - protein, 4 aa, synthetic construct
  REGION 1..4: note = Synthetic Construct
PKEG

SEQ ID NO: 1998 - protein, 4 aa, synthetic construct
  REGION 1..4: note = Synthetic Construct
PKEH

SEQ ID NO: 1999 - protein, 4 aa, synthetic construct
  REGION 1..4: note = Synthetic Construct
PKEI

SEQ ID NO: 2000 - protein, 4 aa, synthetic construct
  REGION 1..4: note = Synthetic Construct
PKEL

SEQ ID NO: 2001 - protein, 4 aa, synthetic construct
  REGION 1..4: note = Synthetic Construct
PKEN

SEQ ID NO: 2002 - protein, 4 aa, synthetic construct
  REGION 1..4: note = Synthetic Construct
PKEQ

SEQ ID NO: 2003 - protein, 4 aa, synthetic construct
  REGION 1..4: note = Synthetic Construct
PKER

SEQ ID NO: 2004 - protein, 4 aa, synthetic construct
  REGION 1..4: note = Synthetic Construct
PKES

SEQ ID NO: 2005 - protein, 4 aa, synthetic construct
  REGION 1..4: note = Synthetic Construct
PKET

SEQ ID NO: 2006 - protein, 4 aa, synthetic construct
  REGION 1..4: note = Synthetic Construct
PKEY

SEQ ID NO: 2007 - protein, 4 aa, synthetic construct
  REGION 1..4: note = Synthetic Construct
PKFA

SEQ ID NO: 2008 - protein, 4 aa, synthetic construct
  REGION 1..4: note = Synthetic Construct
PKFD

SEQ ID NO: 2009 - protein, 4 aa, synthetic construct
  REGION 1..4: note = Synthetic Construct
PKFE

SEQ ID NO: 2010 - protein, 4 aa, synthetic construct
  REGION 1..4: note = Synthetic Construct
PKFF

SEQ ID NO: 2011 - protein, 4 aa, synthetic construct
  REGION 1..4: note = Synthetic Construct
PKFG

SEQ ID NO: 2012 - protein, 4 aa, synthetic construct
  REGION 1..4: note = Synthetic Construct
PKFH

SEQ ID NO: 2013 - protein, 4 aa, synthetic construct
  REGION 1..4: note = Synthetic Construct
PKFI

SEQ ID NO: 2014 - protein, 4 aa, synthetic construct
  REGION 1..4: note = Synthetic Construct
PKFL

SEQ ID NO: 2015 - protein, 4 aa, synthetic construct
  REGION 1..4: note = Synthetic Construct
PKFN

SEQ ID NO: 2016 - protein, 4 aa, synthetic construct
  REGION 1..4: note = Synthetic Construct
PKFQ

SEQ ID NO: 2017 - protein, 4 aa, synthetic construct
  REGION 1..4: note = Synthetic Construct
PKFR

SEQ ID NO: 2018 - protein, 4 aa, synthetic construct
  REGION 1..4: note = Synthetic Construct
PKFS

SEQ ID NO: 2019 - protein, 4 aa, synthetic construct
  REGION 1..4: note = Synthetic Construct
PKFT

SEQ ID NO: 2020 - protein, 4 aa, synthetic construct
  REGION 1..4: note = Synthetic Construct
PKFY

SEQ ID NO: 2021 - protein, 4 aa, synthetic construct
  REGION 1..4: note = Synthetic Construct
PKGA

SEQ ID NO: 2022 - protein, 4 aa, synthetic construct
  REGION 1..4: note = Synthetic Construct
PKGD

SEQ ID NO: 2023 - protein, 4 aa, synthetic construct
  REGION 1..4: note = Synthetic Construct
PKGE

SEQ ID NO: 2024 - protein, 4 aa, synthetic construct
  REGION 1..4: note = Synthetic Construct
PKGF

SEQ ID NO: 2025 - protein, 4 aa, synthetic construct
  REGION 1..4: note = Synthetic Construct
PKGG

SEQ ID NO: 2026 - protein, 4 aa, synthetic construct
  REGION 1..4: note = Synthetic Construct
PKGH

SEQ ID NO: 2027 - protein, 4 aa, synthetic construct
  REGION 1..4: note = Synthetic Construct
PKGI

SEQ ID NO: 2028 - protein, 4 aa, synthetic construct
  REGION 1..4: note = Synthetic Construct
PKGL

SEQ ID NO: 2029 - protein, 4 aa, synthetic construct
  REGION 1..4: note = Synthetic Construct
PKGN

SEQ ID NO: 2030 - protein, 4 aa, synthetic construct
  REGION 1..4: note = Synthetic Construct
PKGQ

SEQ ID NO: 2031 - protein, 4 aa, synthetic construct
  REGION 1..4: note = Synthetic Construct
PKGR

SEQ ID NO: 2032 - protein, 4 aa, synthetic construct
  REGION 1..4: note = Synthetic Construct
PKGS

SEQ ID NO: 2033 - protein, 4 aa, synthetic construct
  REGION 1..4: note = Synthetic Construct
PKGT

SEQ ID NO: 2034 - protein, 4 aa, synthetic construct
  REGION 1..4: note = Synthetic Construct
PKGY

SEQ ID NO: 2035 - protein, 4 aa, synthetic construct
  REGION 1..4: note = Synthetic Construct
PKHA

SEQ ID NO: 2036 - protein, 4 aa, synthetic construct
  REGION 1..4: note = Synthetic Construct
PKHD

SEQ ID NO: 2037 - protein, 4 aa, synthetic construct
  REGION 1..4: note = Synthetic Construct
PKHE

SEQ ID NO: 2038 - protein, 4 aa, synthetic construct
  REGION 1..4: note = Synthetic Construct
PKHF

SEQ ID NO: 2039 - protein, 4 aa, synthetic construct
  REGION 1..4: note = Synthetic Construct
PKHG

SEQ ID NO: 2040 - protein, 4 aa, synthetic construct
  REGION 1..4: note = Synthetic Construct
PKHH

SEQ ID NO: 2041 - protein, 4 aa, synthetic construct
  REGION 1..4: note = Synthetic Construct
PKHI

SEQ ID NO: 2042 - protein, 4 aa, synthetic construct
  REGION 1..4: note = Synthetic Construct
PKHL

SEQ ID NO: 2043 - protein, 4 aa, synthetic construct
  REGION 1..4: note = Synthetic Construct
PKHN

SEQ ID NO: 2044 - protein, 4 aa, synthetic construct
  REGION 1..4: note = Synthetic Construct
PKHQ

SEQ ID NO: 2045 - protein, 4 aa, synthetic construct
  REGION 1..4: note = Synthetic Construct
PKHR

SEQ ID NO: 2046 - protein, 4 aa, synthetic construct
  REGION 1..4: note = Synthetic Construct
PKHS

SEQ ID NO: 2047 - protein, 4 aa, synthetic construct
  REGION 1..4: note = Synthetic Construct
PKHT

SEQ ID NO: 2048 - protein, 4 aa, synthetic construct
  REGION 1..4: note = Synthetic Construct
PKHY

SEQ ID NO: 2049 - protein, 4 aa, synthetic construct
  REGION 1..4: note = Synthetic Construct
PKIA

SEQ ID NO: 2050 - protein, 4 aa, synthetic construct
  REGION 1..4: note = Synthetic Construct
PKID

SEQ ID NO: 2051 - protein, 4 aa, synthetic construct
  REGION 1..4: note = Synthetic Construct
PKIE

SEQ ID NO: 2052 - protein, 4 aa, synthetic construct
  REGION 1..4: note = Synthetic Construct
PKIF

SEQ ID NO: 2053 - protein, 4 aa, synthetic construct
  REGION 1..4: note = Synthetic Construct
PKIG

SEQ ID NO: 2054 - protein, 4 aa, synthetic construct
  REGION 1..4: note = Synthetic Construct
PKIH

SEQ ID NO: 2055 - protein, 4 aa, synthetic construct
  REGION 1..4: note = Synthetic Construct
PKII

SEQ ID NO: 2056 - protein, 4 aa, synthetic construct
  REGION 1..4: note = Synthetic Construct
PKIL

SEQ ID NO: 2057 - protein, 4 aa, synthetic construct
  REGION 1..4: note = Synthetic Construct
PKIN

SEQ ID NO: 2058 - protein, 4 aa, synthetic construct
  REGION 1..4: note = Synthetic Construct
PKIQ

SEQ ID NO: 2059 - protein, 4 aa, synthetic construct
  REGION 1..4: note = Synthetic Construct
PKIR

SEQ ID NO: 2060 - protein, 4 aa, synthetic construct
  REGION 1..4: note = Synthetic Construct
PKIS

SEQ ID NO: 2061 - protein, 4 aa, synthetic construct
  REGION 1..4: note = Synthetic Construct
PKIT

SEQ ID NO: 2062 - protein, 4 aa, synthetic construct
  REGION 1..4: note = Synthetic Construct
PKIY

SEQ ID NO: 2063 - protein, 4 aa, synthetic construct
  REGION 1..4: note = Synthetic Construct
PKLA

SEQ ID NO: 2064 - protein, 4 aa, synthetic construct
  REGION 1..4: note = Synthetic Construct
PKLD

SEQ ID NO: 2065 - protein, 4 aa, synthetic construct
  REGION 1..4: note = Synthetic Construct
PKLE

SEQ ID NO: 2066 - protein, 4 aa, synthetic construct
  REGION 1..4: note = Synthetic Construct
PKLF

SEQ ID NO: 2067 - protein, 4 aa, synthetic construct
  REGION 1..4: note = Synthetic Construct
PKLG

SEQ ID NO: 2068 - protein, 4 aa, synthetic construct
  REGION 1..4: note = Synthetic Construct
PKLH

SEQ ID NO: 2069 - protein, 4 aa, synthetic construct
  REGION 1..4: note = Synthetic Construct
PKLI

SEQ ID NO: 2070 - protein, 4 aa, synthetic construct
  REGION 1..4: note = Synthetic Construct
PKLL

SEQ ID NO: 2071 - protein, 4 aa, synthetic construct
  REGION 1..4: note = Synthetic Construct
PKLN

SEQ ID NO: 2072 - protein, 4 aa, synthetic construct
  REGION 1..4: note = Synthetic Construct
PKLQ

SEQ ID NO: 2073 - protein, 4 aa, synthetic construct
  REGION 1..4: note = Synthetic Construct
PKLR

SEQ ID NO: 2074 - protein, 4 aa, synthetic construct
  REGION 1..4: note = Synthetic Construct
PKLS

SEQ ID NO: 2075 - protein, 4 aa, synthetic construct
  REGION 1..4: note = Synthetic Construct
PKLT

SEQ ID NO: 2076 - protein, 4 aa, synthetic construct
  REGION 1..4: note = Synthetic Construct
PKLY

SEQ ID NO: 2077 - protein, 4 aa, synthetic construct
  REGION 1..4: note = Synthetic Construct
PKNA

SEQ ID NO: 2078 - protein, 4 aa, synthetic construct
  REGION 1..4: note = Synthetic Construct
PKND

SEQ ID NO: 2079 - protein, 4 aa, synthetic construct
  REGION 1..4: note = Synthetic Construct
PKNE

SEQ ID NO: 2080 - protein, 4 aa, synthetic construct
  REGION 1..4: note = Synthetic Construct
PKNF

SEQ ID NO: 2081 - protein, 4 aa, synthetic construct
  REGION 1..4: note = Synthetic Construct
PKNG

SEQ ID NO: 2082 - protein, 4 aa, synthetic construct
  REGION 1..4: note = Synthetic Construct
PKNH

SEQ ID NO: 2083 - protein, 4 aa, synthetic construct
  REGION 1..4: note = Synthetic Construct
PKNI

SEQ ID NO: 2084 - protein, 4 aa, synthetic construct
  REGION 1..4: note = Synthetic Construct
PKNL

SEQ ID NO: 2085 - protein, 4 aa, synthetic construct
  REGION 1..4: note = Synthetic Construct
PKNN

SEQ ID NO: 2086 - protein, 4 aa, synthetic construct
  REGION 1..4: note = Synthetic Construct
PKNQ

SEQ ID NO: 2087 - protein, 4 aa, synthetic construct
  REGION 1..4: note = Synthetic Construct
PKNR

SEQ ID NO: 2088 - protein, 4 aa, synthetic construct
  REGION 1..4: note = Synthetic Construct
PKNS

SEQ ID NO: 2089 - protein, 4 aa, synthetic construct
  REGION 1..4: note = Synthetic Construct
PKNT

SEQ ID NO: 2090 - protein, 4 aa, synthetic construct
  REGION 1..4: note = Synthetic Construct
PKNY

SEQ ID NO: 2091 - protein, 4 aa, synthetic construct
  REGION 1..4: note = Synthetic Construct
PKPA

SEQ ID NO: 2092 - protein, 4 aa, synthetic construct
  REGION 1..4: note = Synthetic Construct
PKPD

SEQ ID NO: 2093 - protein, 4 aa, synthetic construct
  REGION 1..4: note = Synthetic Construct
PKPE

SEQ ID NO: 2094 - protein, 4 aa, synthetic construct
  REGION 1..4: note = Synthetic Construct
PKPF

SEQ ID NO: 2095 - protein, 4 aa, synthetic construct
  REGION 1..4: note = Synthetic Construct
PKPG

SEQ ID NO: 2096 - protein, 4 aa, synthetic construct
  REGION 1..4: note = Synthetic Construct
PKPH

SEQ ID NO: 2097 - protein, 4 aa, synthetic construct
  REGION 1..4: note = Synthetic Construct
PKPI

SEQ ID NO: 2098 - protein, 4 aa, synthetic construct
  REGION 1..4: note = Synthetic Construct
PKPL

SEQ ID NO: 2099 - protein, 4 aa, synthetic construct
  REGION 1..4: note = Synthetic Construct
PKPN

SEQ ID NO: 2100 - protein, 4 aa, synthetic construct
  REGION 1..4: note = Synthetic Construct
PKPQ

SEQ ID NO: 2101 - protein, 4 aa, synthetic construct
  REGION 1..4: note = Synthetic Construct
PKPR

SEQ ID NO: 2102 - protein, 4 aa, synthetic construct
  REGION 1..4: note = Synthetic Construct
PKPS

SEQ ID NO: 2103 - protein, 4 aa, synthetic construct
  REGION 1..4: note = Synthetic Construct
PKPT

SEQ ID NO: 2104 - protein, 4 aa, synthetic construct
  REGION 1..4: note = Synthetic Construct
PKPY

SEQ ID NO: 2105 - protein, 4 aa, synthetic construct
  REGION 1..4: note = Synthetic Construct
PKQA

SEQ ID NO: 2106 - protein, 4 aa, synthetic construct
  REGION 1..4: note = Synthetic Construct
PKQD

SEQ ID NO: 2107 - protein, 4 aa, synthetic construct
  REGION 1..4: note = Synthetic Construct
PKQE

SEQ ID NO: 2108 - protein, 4 aa, synthetic construct
  REGION 1..4: note = Synthetic Construct
PKQF

SEQ ID NO: 2109 - protein, 4 aa, synthetic construct
  REGION 1..4: note = Synthetic Construct
PKQG

SEQ ID NO: 2110 - protein, 4 aa, synthetic construct
  REGION 1..4: note = Synthetic Construct
PKQH

SEQ ID NO: 2111 - protein, 4 aa, synthetic construct
  REGION 1..4: note = Synthetic Construct
PKQI

SEQ ID NO: 2112 - protein, 4 aa, synthetic construct
  REGION 1..4: note = Synthetic Construct
PKQL

SEQ ID NO: 2113 - protein, 4 aa, synthetic construct
  REGION 1..4: note = Synthetic Construct
PKQN

SEQ ID NO: 2114 - protein, 4 aa, synthetic construct
  REGION 1..4: note = Synthetic Construct
PKQQ

SEQ ID NO: 2115 - protein, 4 aa, synthetic construct
  REGION 1..4: note = Synthetic Construct
PKQR

SEQ ID NO: 2116 - protein, 4 aa, synthetic construct
  REGION 1..4: note = Synthetic Construct
PKQS

SEQ ID NO: 2117 - protein, 4 aa, synthetic construct
  REGION 1..4: note = Synthetic Construct
PKQT

SEQ ID NO: 2118 - protein, 4 aa, synthetic construct
  REGION 1..4: note = Synthetic Construct
PKQY

SEQ ID NO: 2119 - protein, 4 aa, synthetic construct
  REGION 1..4: note = Synthetic Construct
PKRA

SEQ ID NO: 2120 - protein, 4 aa, synthetic construct
  REGION 1..4: note = Synthetic Construct
PKRD

SEQ ID NO: 2121 - protein, 4 aa, synthetic construct
  REGION 1..4: note = Synthetic Construct
PKRE

SEQ ID NO: 2122 - protein, 4 aa, synthetic construct
  REGION 1..4: note = Synthetic Construct
PKRF

SEQ ID NO: 2123 - protein, 4 aa, synthetic construct
  REGION 1..4: note = Synthetic Construct
PKRG

SEQ ID NO: 2124 - protein, 4 aa, synthetic construct
  REGION 1..4: note = Synthetic Construct
PKRH

SEQ ID NO: 2125 - protein, 4 aa, synthetic construct
  REGION 1..4: note = Synthetic Construct
PKRI

SEQ ID NO: 2126 - protein, 4 aa, synthetic construct
  REGION 1..4: note = Synthetic Construct
PKRL

SEQ ID NO: 2127 - protein, 4 aa, synthetic construct
  REGION 1..4: note = Synthetic Construct
PKRN

SEQ ID NO: 2128 - protein, 4 aa, synthetic construct
  REGION 1..4: note = Synthetic Construct
PKRQ

SEQ ID NO: 2129 - protein, 4 aa, synthetic construct
  REGION 1..4: note = Synthetic Construct
PKRR

SEQ ID NO: 2130 - protein, 4 aa, synthetic construct
  REGION 1..4: note = Synthetic Construct
PKRS

SEQ ID NO: 2131 - protein, 4 aa, synthetic construct
  REGION 1..4: note = Synthetic Construct
PKRT

SEQ ID NO: 2132 - protein, 4 aa, synthetic construct
  REGION 1..4: note = Synthetic Construct
PKRY

SEQ ID NO: 2133 - protein, 4 aa, synthetic construct
  REGION 1..4: note = Synthetic Construct
PKSA

SEQ ID NO: 2134 - protein, 4 aa, synthetic construct
  REGION 1..4: note = Synthetic Construct
PKSD

SEQ ID NO: 2135 - protein, 4 aa, synthetic construct
  REGION 1..4: note = Synthetic Construct
PKSE

SEQ ID NO: 2136 - protein, 4 aa, synthetic construct
  REGION 1..4: note = Synthetic Construct
PKSF

SEQ ID NO: 2137 - protein, 4 aa, synthetic construct
  REGION 1..4: note = Synthetic Construct
PKSG

SEQ ID NO: 2138 - protein, 4 aa, synthetic construct
  REGION 1..4: note = Synthetic Construct
PKSH

SEQ ID NO: 2139 - protein, 4 aa, synthetic construct
  REGION 1..4: note = Synthetic Construct
PKSI

SEQ ID NO: 2140 - protein, 4 aa, synthetic construct
  REGION 1..4: note = Synthetic Construct
PKSL

SEQ ID NO: 2141 - protein, 4 aa, synthetic construct
  REGION 1..4: note = Synthetic Construct
PKSN

SEQ ID NO: 2142 - protein, 4 aa, synthetic construct
  REGION 1..4: note = Synthetic Construct
PKSQ

SEQ ID NO: 2143 - protein, 4 aa, synthetic construct
  REGION 1..4: note = Synthetic Construct
PKSR

SEQ ID NO: 2144 - protein, 4 aa, synthetic construct
  REGION 1..4: note = Synthetic Construct
PKSS

SEQ ID NO: 2145 - protein, 4 aa, synthetic construct
  REGION 1..4: note = Synthetic Construct
PKST

SEQ ID NO: 2146 - protein, 4 aa, synthetic construct
  REGION 1..4: note = Synthetic Construct
PKSY

SEQ ID NO: 2147 - protein, 4 aa, synthetic construct
  REGION 1..4: note = Synthetic Construct
PKTA

SEQ ID NO: 2148 - protein, 4 aa, synthetic construct
  REGION 1..4: note = Synthetic Construct
PKTD

SEQ ID NO: 2149 - protein, 4 aa, synthetic construct
  REGION 1..4: note = Synthetic Construct
PKTE

SEQ ID NO: 2150 - protein, 4 aa, synthetic construct
  REGION 1..4: note = Synthetic Construct
PKTF

SEQ ID NO: 2151 - protein, 4 aa, synthetic construct
  REGION 1..4: note = Synthetic Construct
PKTG

SEQ ID NO: 2152 - protein, 4 aa, synthetic construct
  REGION 1..4: note = Synthetic Construct
PKTH

SEQ ID NO: 2153 - protein, 4 aa, synthetic construct
  REGION 1..4: note = Synthetic Construct
PKTI

SEQ ID NO: 2154 - protein, 4 aa, synthetic construct
  REGION 1..4: note = Synthetic Construct
PKTL

SEQ ID NO: 2155 - protein, 4 aa, synthetic construct
  REGION 1..4: note = Synthetic Construct
PKTN

SEQ ID NO: 2156 - protein, 4 aa, synthetic construct
  REGION 1..4: note = Synthetic Construct
PKTQ

SEQ ID NO: 2157 - protein, 4 aa, synthetic construct
  REGION 1..4: note = Synthetic Construct
PKTR

SEQ ID NO: 2158 - protein, 4 aa, synthetic construct
  REGION 1..4: note = Synthetic Construct
PKTS

SEQ ID NO: 2159 - protein, 4 aa, synthetic construct
  REGION 1..4: note = Synthetic Construct
PKTT

SEQ ID NO: 2160 - protein, 4 aa, synthetic construct
  REGION 1..4: note = Synthetic Construct
PKTY

SEQ ID NO: 2161 - protein, 4 aa, synthetic construct
  REGION 1..4: note = Synthetic Construct
PKYA

SEQ ID NO: 2162 - protein, 4 aa, synthetic construct
  REGION 1..4: note = Synthetic Construct
PKYD

SEQ ID NO: 2163 - protein, 4 aa, synthetic construct
  REGION 1..4: note = Synthetic Construct
PKYE

SEQ ID NO: 2164 - protein, 4 aa, synthetic construct
  REGION 1..4: note = Synthetic Construct
PKYF

SEQ ID NO: 2165 - protein, 4 aa, synthetic construct
  REGION 1..4: note = Synthetic Construct
PKYG

SEQ ID NO: 2166 - protein, 4 aa, synthetic construct
  REGION 1..4: note = Synthetic Construct
PKYH

SEQ ID NO: 2167 - protein, 4 aa, synthetic construct
  REGION 1..4: note = Synthetic Construct
PKYI

SEQ ID NO: 2168 - protein, 4 aa, synthetic construct
  REGION 1..4: note = Synthetic Construct
PKYL

SEQ ID NO: 2169 - protein, 4 aa, synthetic construct
  REGION 1..4: note = Synthetic Construct
PKYN

SEQ ID NO: 2170 - protein, 4 aa, synthetic construct
  REGION 1..4: note = Synthetic Construct
PKYQ

SEQ ID NO: 2171 - protein, 4 aa, synthetic construct
  REGION 1..4: note = Synthetic Construct
PKYR

SEQ ID NO: 2172 - protein, 4 aa, synthetic construct
  REGION 1..4: note = Synthetic Construct
PKYS

SEQ ID NO: 2173 - protein, 4 aa, synthetic construct
  REGION 1..4: note = Synthetic Construct
PKYT

SEQ ID NO: 2174 - protein, 4 aa, synthetic construct
  REGION 1..4: note = Synthetic Construct
PKYY

SEQ ID NO: 2175 - protein, 4 aa, synthetic construct
  REGION 1..4: note = Synthetic Construct
QKAA

SEQ ID NO: 2176 - protein, 4 aa, synthetic construct
  REGION 1..4: note = Synthetic Construct
QKAD

SEQ ID NO: 2177 - protein, 4 aa, synthetic construct
  REGION 1..4: note = Synthetic Construct
QKAE

SEQ ID NO: 2178 - protein, 4 aa, synthetic construct
  REGION 1..4: note = Synthetic Construct
QKAF

SEQ ID NO: 2179 - protein, 4 aa, synthetic construct
  REGION 1..4: note = Synthetic Construct
QKAG

SEQ ID NO: 2180 - protein, 4 aa, synthetic construct
  REGION 1..4: note = Synthetic Construct
QKAH

SEQ ID NO: 2181 - protein, 4 aa, synthetic construct
  REGION 1..4: note = Synthetic Construct
QKAI

SEQ ID NO: 2182 - protein, 4 aa, synthetic construct
  REGION 1..4: note = Synthetic Construct
QKAL

SEQ ID NO: 2183 - protein, 4 aa, synthetic construct
  REGION 1..4: note = Synthetic Construct
QKAN

SEQ ID NO: 2184 - protein, 4 aa, synthetic construct
  REGION 1..4: note = Synthetic Construct
QKAQ

SEQ ID NO: 2185 - protein, 4 aa, synthetic construct
  REGION 1..4: note = Synthetic Construct
QKAR

SEQ ID NO: 2186 - protein, 4 aa, synthetic construct
  REGION 1..4: note = Synthetic Construct
QKAS

SEQ ID NO: 2187 - protein, 4 aa, synthetic construct
  REGION 1..4: note = Synthetic Construct
QKAT

SEQ ID NO: 2188 - protein, 4 aa, synthetic construct
  REGION 1..4: note = Synthetic Construct
QKAY

SEQ ID NO: 2189 - protein, 4 aa, synthetic construct
  REGION 1..4: note = Synthetic Construct
QKDA

SEQ ID NO: 2190 - protein, 4 aa, synthetic construct
  REGION 1..4: note = Synthetic Construct
QKDD

SEQ ID NO: 2191 - protein, 4 aa, synthetic construct
  REGION 1..4: note = Synthetic Construct
QKDE

SEQ ID NO: 2192 - protein, 4 aa, synthetic construct
  REGION 1..4: note = Synthetic Construct
QKDF

SEQ ID NO: 2193 - protein, 4 aa, synthetic construct
  REGION 1..4: note = Synthetic Construct
QKDG

SEQ ID NO: 2194 - protein, 4 aa, synthetic construct
  REGION 1..4: note = Synthetic Construct
QKDH

SEQ ID NO: 2195 - protein, 4 aa, synthetic construct
  REGION 1..4: note = Synthetic Construct
QKDI

SEQ ID NO: 2196 - protein, 4 aa, synthetic construct
  REGION 1..4: note = Synthetic Construct
QKDL

SEQ ID NO: 2197 - protein, 4 aa, synthetic construct
  REGION 1..4: note = Synthetic Construct
QKDN

SEQ ID NO: 2198 - protein, 4 aa, synthetic construct
  REGION 1..4: note = Synthetic Construct
QKDQ

SEQ ID NO: 2199 - protein, 4 aa, synthetic construct
  REGION 1..4: note = Synthetic Construct
QKDR

SEQ ID NO: 2200 - protein, 4 aa, synthetic construct
  REGION 1..4: note = Synthetic Construct
QKDS

SEQ ID NO: 2201 - protein, 4 aa, synthetic construct
  REGION 1..4: note = Synthetic Construct
QKDT

SEQ ID NO: 2202 - protein, 4 aa, synthetic construct
  REGION 1..4: note = Synthetic Construct
QKDY

SEQ ID NO: 2203 - protein, 4 aa, synthetic construct
  REGION 1..4: note = Synthetic Construct
QKEA

SEQ ID NO: 2204 - protein, 4 aa, synthetic construct
  REGION 1..4: note = Synthetic Construct
QKED

SEQ ID NO: 2205 - protein, 4 aa, synthetic construct
  REGION 1..4: note = Synthetic Construct
QKEE

SEQ ID NO: 2206 - protein, 4 aa, synthetic construct
  REGION 1..4: note = Synthetic Construct
QKEF

SEQ ID NO: 2207 - protein, 4 aa, synthetic construct
  REGION 1..4: note = Synthetic Construct
QKEG

SEQ ID NO: 2208 - protein, 4 aa, synthetic construct
  REGION 1..4: note = Synthetic Construct
QKEH

SEQ ID NO: 2209 - protein, 4 aa, synthetic construct
  REGION 1..4: note = Synthetic Construct
QKEI

SEQ ID NO: 2210 - protein, 4 aa, synthetic construct
  REGION 1..4: note = Synthetic Construct
QKEL

SEQ ID NO: 2211 - protein, 4 aa, synthetic construct
  REGION 1..4: note = Synthetic Construct
QKEN

SEQ ID NO: 2212 - protein, 4 aa, synthetic construct
  REGION 1..4: note = Synthetic Construct
QKEQ

SEQ ID NO: 2213 - protein, 4 aa, synthetic construct
  REGION 1..4: note = Synthetic Construct
QKER

SEQ ID NO: 2214 - protein, 4 aa, synthetic construct
  REGION 1..4: note = Synthetic Construct
QKES

SEQ ID NO: 2215 - protein, 4 aa, synthetic construct
  REGION 1..4: note = Synthetic Construct
QKET

SEQ ID NO: 2216 - protein, 4 aa, synthetic construct
  REGION 1..4: note = Synthetic Construct
QKEY

SEQ ID NO: 2217 - protein, 4 aa, synthetic construct
  REGION 1..4: note = Synthetic Construct
QKFA

SEQ ID NO: 2218 - protein, 4 aa, synthetic construct
  REGION 1..4: note = Synthetic Construct
QKFD

SEQ ID NO: 2219 - protein, 4 aa, synthetic construct
  REGION 1..4: note = Synthetic Construct
QKFE

SEQ ID NO: 2220 - protein, 4 aa, synthetic construct
  REGION 1..4: note = Synthetic Construct
QKFF

SEQ ID NO: 2221 - protein, 4 aa, synthetic construct
  REGION 1..4: note = Synthetic Construct
QKFG

SEQ ID NO: 2222 - protein, 4 aa, synthetic construct
  REGION 1..4: note = Synthetic Construct
QKFH

SEQ ID NO: 2223 - protein, 4 aa, synthetic construct
  REGION 1..4: note = Synthetic Construct
QKFI

SEQ ID NO: 2224 - protein, 4 aa, synthetic construct
  REGION 1..4: note = Synthetic Construct
QKFL

SEQ ID NO: 2225 - protein, 4 aa, synthetic construct
  REGION 1..4: note = Synthetic Construct
QKFN

SEQ ID NO: 2226 - protein, 4 aa, synthetic construct
  REGION 1..4: note = Synthetic Construct
QKFQ

SEQ ID NO: 2227 - protein, 4 aa, synthetic construct
  REGION 1..4: note = Synthetic Construct
QKFR

SEQ ID NO: 2228 - protein, 4 aa, synthetic construct
  REGION 1..4: note = Synthetic Construct
QKFS

SEQ ID NO: 2229 - protein, 4 aa, synthetic construct
  REGION 1..4: note = Synthetic Construct
QKFT

SEQ ID NO: 2230 - protein, 4 aa, synthetic construct
  REGION 1..4: note = Synthetic Construct
QKFY

SEQ ID NO: 2231 - protein, 4 aa, synthetic construct
  REGION 1..4: note = Synthetic Construct
QKGA

SEQ ID NO: 2232 - protein, 4 aa, synthetic construct
  REGION 1..4: note = Synthetic Construct
QKGD

SEQ ID NO: 2233 - protein, 4 aa, synthetic construct
  REGION 1..4: note = Synthetic Construct
QKGE

SEQ ID NO: 2234 - protein, 4 aa, synthetic construct
  REGION 1..4: note = Synthetic Construct
QKGF

SEQ ID NO: 2235 - protein, 4 aa, synthetic construct
  REGION 1..4: note = Synthetic Construct
QKGG

SEQ ID NO: 2236 - protein, 4 aa, synthetic construct
  REGION 1..4: note = Synthetic Construct
QKGH

SEQ ID NO: 2237 - protein, 4 aa, synthetic construct
  REGION 1..4: note = Synthetic Construct
QKGI

SEQ ID NO: 2238 - protein, 4 aa, synthetic construct
  REGION 1..4: note = Synthetic Construct
QKGL

SEQ ID NO: 2239 - protein, 4 aa, synthetic construct
  REGION 1..4: note = Synthetic Construct
QKGN

SEQ ID NO: 2240 - protein, 4 aa, synthetic construct
  REGION 1..4: note = Synthetic Construct
QKGQ

SEQ ID NO: 2241 - protein, 4 aa, synthetic construct
  REGION 1..4: note = Synthetic Construct
QKGR

SEQ ID NO: 2242 - protein, 4 aa, synthetic construct
  REGION 1..4: note = Synthetic Construct
QKGS

SEQ ID NO: 2243 - protein, 4 aa, synthetic construct
  REGION 1..4: note = Synthetic Construct
QKGT

SEQ ID NO: 2244 - protein, 4 aa, synthetic construct
  REGION 1..4: note = Synthetic Construct
QKGY

SEQ ID NO: 2245 - protein, 4 aa, synthetic construct
  REGION 1..4: note = Synthetic Construct
QKHA

SEQ ID NO: 2246 - protein, 4 aa, synthetic construct
  REGION 1..4: note = Synthetic Construct
QKHD

SEQ ID NO: 2247 - protein, 4 aa, synthetic construct
  REGION 1..4: note = Synthetic Construct
QKHE

SEQ ID NO: 2248 - protein, 4 aa, synthetic construct
  REGION 1..4: note = Synthetic Construct
QKHF

SEQ ID NO: 2249 - protein, 4 aa, synthetic construct
  REGION 1..4: note = Synthetic Construct
QKHG

SEQ ID NO: 2250 - protein, 4 aa, synthetic construct
  REGION 1..4: note = Synthetic Construct
QKHH

SEQ ID NO: 2251 - protein, 4 aa, synthetic construct
  REGION 1..4: note = Synthetic Construct
QKHI

SEQ ID NO: 2252 - protein, 4 aa, synthetic construct
  REGION 1..4: note = Synthetic Construct
QKHL

SEQ ID NO: 2253 - protein, 4 aa, synthetic construct
  REGION 1..4: note = Synthetic Construct
QKHN

SEQ ID NO: 2254 - protein, 4 aa, synthetic construct
  REGION 1..4: note = Synthetic Construct
QKHQ

SEQ ID NO: 2255 - protein, 4 aa, synthetic construct
  REGION 1..4: note = Synthetic Construct
QKHR

SEQ ID NO: 2256 - protein, 4 aa, synthetic construct
  REGION 1..4: note = Synthetic Construct
QKHS

SEQ ID NO: 2257 - protein, 4 aa, synthetic construct
  REGION 1..4: note = Synthetic Construct
QKHT

SEQ ID NO: 2258 - protein, 4 aa, synthetic construct
  REGION 1..4: note = Synthetic Construct
QKHY

SEQ ID NO: 2259 - protein, 4 aa, synthetic construct
  REGION 1..4: note = Synthetic Construct
QKIA

SEQ ID NO: 2260 - protein, 4 aa, synthetic construct
  REGION 1..4: note = Synthetic Construct
QKID

SEQ ID NO: 2261 - protein, 4 aa, synthetic construct
  REGION 1..4: note = Synthetic Construct
QKIE

SEQ ID NO: 2262 - protein, 4 aa, synthetic construct
  REGION 1..4: note = Synthetic Construct
QKIF

SEQ ID NO: 2263 - protein, 4 aa, synthetic construct
  REGION 1..4: note = Synthetic Construct
QKIG

SEQ ID NO: 2264 - protein, 4 aa, synthetic construct
  REGION 1..4: note = Synthetic Construct
QKIH

SEQ ID NO: 2265 - protein, 4 aa, synthetic construct
  REGION 1..4: note = Synthetic Construct
QKII

SEQ ID NO: 2266 - protein, 4 aa, synthetic construct
  REGION 1..4: note = Synthetic Construct
QKIL

SEQ ID NO: 2267 - protein, 4 aa, synthetic construct
  REGION 1..4: note = Synthetic Construct
QKIN

SEQ ID NO: 2268 - protein, 4 aa, synthetic construct
  REGION 1..4: note = Synthetic Construct
QKIQ

SEQ ID NO: 2269 - protein, 4 aa, synthetic construct
  REGION 1..4: note = Synthetic Construct
QKIR

SEQ ID NO: 2270 - protein, 4 aa, synthetic construct
  REGION 1..4: note = Synthetic Construct
QKIS

SEQ ID NO: 2271 - protein, 4 aa, synthetic construct
  REGION 1..4: note = Synthetic Construct
QKIT

SEQ ID NO: 2272 - protein, 4 aa, synthetic construct
  REGION 1..4: note = Synthetic Construct
QKIY

SEQ ID NO: 2273 - protein, 4 aa, synthetic construct
  REGION 1..4: note = Synthetic Construct
QKLA

SEQ ID NO: 2274 - protein, 4 aa, synthetic construct
  REGION 1..4: note = Synthetic Construct
QKLD

SEQ ID NO: 2275 - protein, 4 aa, synthetic construct
  REGION 1..4: note = Synthetic Construct
QKLE

SEQ ID NO: 2276 - protein, 4 aa, synthetic construct
  REGION 1..4: note = Synthetic Construct
QKLF

SEQ ID NO: 2277 - protein, 4 aa, synthetic construct
  REGION 1..4: note = Synthetic Construct
QKLG

SEQ ID NO: 2278 - protein, 4 aa, synthetic construct
  REGION 1..4: note = Synthetic Construct
QKLH

SEQ ID NO: 2279 - protein, 4 aa, synthetic construct
  REGION 1..4: note = Synthetic Construct
QKLI

SEQ ID NO: 2280 - protein, 4 aa, synthetic construct
  REGION 1..4: note = Synthetic Construct
QKLL

SEQ ID NO: 2281 - protein, 4 aa, synthetic construct
  REGION 1..4: note = Synthetic Construct
QKLN

SEQ ID NO: 2282 - protein, 4 aa, synthetic construct
  REGION 1..4: note = Synthetic Construct
QKLQ

SEQ ID NO: 2283 - protein, 4 aa, synthetic construct
  REGION 1..4: note = Synthetic Construct
QKLR

SEQ ID NO: 2284 - protein, 4 aa, synthetic construct
  REGION 1..4: note = Synthetic Construct
QKLS

SEQ ID NO: 2285 - protein, 4 aa, synthetic construct
  REGION 1..4: note = Synthetic Construct
QKLT

SEQ ID NO: 2286 - protein, 4 aa, synthetic construct
  REGION 1..4: note = Synthetic Construct
QKLY

SEQ ID NO: 2287 - protein, 4 aa, synthetic construct
  REGION 1..4: note = Synthetic Construct
QKNA

SEQ ID NO: 2288 - protein, 4 aa, synthetic construct
  REGION 1..4: note = Synthetic Construct
QKND

SEQ ID NO: 2289 - protein, 4 aa, synthetic construct
  REGION 1..4: note = Synthetic Construct
QKNE

SEQ ID NO: 2290 - protein, 4 aa, synthetic construct
  REGION 1..4: note = Synthetic Construct
QKNF

SEQ ID NO: 2291 - protein, 4 aa, synthetic construct
  REGION 1..4: note = Synthetic Construct
QKNG

SEQ ID NO: 2292 - protein, 4 aa, synthetic construct
  REGION 1..4: note = Synthetic Construct
QKNH

SEQ ID NO: 2293 - protein, 4 aa, synthetic construct
  REGION 1..4: note = Synthetic Construct
QKNI

SEQ ID NO: 2294 - protein, 4 aa, synthetic construct
  REGION 1..4: note = Synthetic Construct
QKNL

SEQ ID NO: 2295 - protein, 4 aa, synthetic construct
  REGION 1..4: note = Synthetic Construct
QKNN

SEQ ID NO: 2296 - protein, 4 aa, synthetic construct
  REGION 1..4: note = Synthetic Construct
QKNQ

SEQ ID NO: 2297 - protein, 4 aa, synthetic construct
  REGION 1..4: note = Synthetic Construct
QKNR

SEQ ID NO: 2298 - protein, 4 aa, synthetic construct
  REGION 1..4: note = Synthetic Construct
QKNS

SEQ ID NO: 2299 - protein, 4 aa, synthetic construct
  REGION 1..4: note = Synthetic Construct
QKNT

SEQ ID NO: 2300 - protein, 4 aa, synthetic construct
  REGION 1..4: note = Synthetic Construct
QKNY

SEQ ID NO: 2301 - protein, 4 aa, synthetic construct
  REGION 1..4: note = Synthetic Construct
QKPA

SEQ ID NO: 2302 - protein, 4 aa, synthetic construct
  REGION 1..4: note = Synthetic Construct
QKPD

SEQ ID NO: 2303 - protein, 4 aa, synthetic construct
  REGION 1..4: note = Synthetic Construct
QKPE

SEQ ID NO: 2304 - protein, 4 aa, synthetic construct
  REGION 1..4: note = Synthetic Construct
QKPF

SEQ ID NO: 2305 - protein, 4 aa, synthetic construct
  REGION 1..4: note = Synthetic Construct
QKPG

SEQ ID NO: 2306 - protein, 4 aa, synthetic construct
  REGION 1..4: note = Synthetic Construct
QKPH

SEQ ID NO: 2307 - protein, 4 aa, synthetic construct
  REGION 1..4: note = Synthetic Construct
QKPI

SEQ ID NO: 2308 - protein, 4 aa, synthetic construct
  REGION 1..4: note = Synthetic Construct
QKPL

SEQ ID NO: 2309 - protein, 4 aa, synthetic construct
  REGION 1..4: note = Synthetic Construct
QKPN

SEQ ID NO: 2310 - protein, 4 aa, synthetic construct
  REGION 1..4: note = Synthetic Construct
QKPQ

SEQ ID NO: 2311 - protein, 4 aa, synthetic construct
  REGION 1..4: note = Synthetic Construct
QKPR

SEQ ID NO: 2312 - protein, 4 aa, synthetic construct
  REGION 1..4: note = Synthetic Construct
QKPS

SEQ ID NO: 2313 - protein, 4 aa, synthetic construct
  REGION 1..4: note = Synthetic Construct
QKPT

SEQ ID NO: 2314 - protein, 4 aa, synthetic construct
  REGION 1..4: note = Synthetic Construct
QKPY

SEQ ID NO: 2315 - protein, 4 aa, synthetic construct
  REGION 1..4: note = Synthetic Construct
QKQA

SEQ ID NO: 2316 - protein, 4 aa, synthetic construct
  REGION 1..4: note = Synthetic Construct
QKQD

SEQ ID NO: 2317 - protein, 4 aa, synthetic construct
  REGION 1..4: note = Synthetic Construct
QKQE

SEQ ID NO: 2318 - protein, 4 aa, synthetic construct
  REGION 1..4: note = Synthetic Construct
QKQF

SEQ ID NO: 2319 - protein, 4 aa, synthetic construct
  REGION 1..4: note = Synthetic Construct
QKQG

SEQ ID NO: 2320 - protein, 4 aa, synthetic construct
  REGION 1..4: note = Synthetic Construct
QKQH

SEQ ID NO: 2321 - protein, 4 aa, synthetic construct
  REGION 1..4: note = Synthetic Construct
QKQI

SEQ ID NO: 2322 - protein, 4 aa, synthetic construct
  REGION 1..4: note = Synthetic Construct
QKQL

SEQ ID NO: 2323 - protein, 4 aa, synthetic construct
  REGION 1..4: note = Synthetic Construct
QKQN

SEQ ID NO: 2324 - protein, 4 aa, synthetic construct
  REGION 1..4: note = Synthetic Construct
QKQQ

SEQ ID NO: 2325 - protein, 4 aa, synthetic construct
  REGION 1..4: note = Synthetic Construct
QKQR

SEQ ID NO: 2326 - protein, 4 aa, synthetic construct
  REGION 1..4: note = Synthetic Construct
QKQS

SEQ ID NO: 2327 - protein, 4 aa, synthetic construct
  REGION 1..4: note = Synthetic Construct
QKQT

SEQ ID NO: 2328 - protein, 4 aa, synthetic construct
  REGION 1..4: note = Synthetic Construct
QKQY

SEQ ID NO: 2329 - protein, 4 aa, synthetic construct
  REGION 1..4: note = Synthetic Construct
QKRA

SEQ ID NO: 2330 - protein, 4 aa, synthetic construct
  REGION 1..4: note = Synthetic Construct
QKRD

SEQ ID NO: 2331 - protein, 4 aa, synthetic construct
  REGION 1..4: note = Synthetic Construct
QKRE

SEQ ID NO: 2332 - protein, 4 aa, synthetic construct
  REGION 1..4: note = Synthetic Construct
QKRF

SEQ ID NO: 2333 - protein, 4 aa, synthetic construct
  REGION 1..4: note = Synthetic Construct
QKRG

SEQ ID NO: 2334 - protein, 4 aa, synthetic construct
  REGION 1..4: note = Synthetic Construct
QKRH

SEQ ID NO: 2335 - protein, 4 aa, synthetic construct
  REGION 1..4: note = Synthetic Construct
QKRI

SEQ ID NO: 2336 - protein, 4 aa, synthetic construct
  REGION 1..4: note = Synthetic Construct
QKRL

SEQ ID NO: 2337 - protein, 4 aa, synthetic construct
  REGION 1..4: note = Synthetic Construct
QKRN

SEQ ID NO: 2338 - protein, 4 aa, synthetic construct
  REGION 1..4: note = Synthetic Construct
QKRQ

SEQ ID NO: 2339 - protein, 4 aa, synthetic construct
  REGION 1..4: note = Synthetic Construct
QKRR

SEQ ID NO: 2340 - protein, 4 aa, synthetic construct
  REGION 1..4: note = Synthetic Construct
QKRS

SEQ ID NO: 2341 - protein, 4 aa, synthetic construct
  REGION 1..4: note = Synthetic Construct
QKRT

SEQ ID NO: 2342 - protein, 4 aa, synthetic construct
  REGION 1..4: note = Synthetic Construct
QKRY

SEQ ID NO: 2343 - protein, 4 aa, synthetic construct
  REGION 1..4: note = Synthetic Construct
QKSA

SEQ ID NO: 2344 - protein, 4 aa, synthetic construct
  REGION 1..4: note = Synthetic Construct
QKSD

SEQ ID NO: 2345 - protein, 4 aa, synthetic construct
  REGION 1..4: note = Synthetic Construct
QKSE

SEQ ID NO: 2346 - protein, 4 aa, synthetic construct
  REGION 1..4: note = Synthetic Construct
QKSF

SEQ ID NO: 2347 - protein, 4 aa, synthetic construct
  REGION 1..4: note = Synthetic Construct
QKSG

SEQ ID NO: 2348 - protein, 4 aa, synthetic construct
  REGION 1..4: note = Synthetic Construct
QKSH

SEQ ID NO: 2349 - protein, 4 aa, synthetic construct
  REGION 1..4: note = Synthetic Construct
QKSI

SEQ ID NO: 2350 - protein, 4 aa, synthetic construct
  REGION 1..4: note = Synthetic Construct
QKSL

SEQ ID NO: 2351 - protein, 4 aa, synthetic construct
  REGION 1..4: note = Synthetic Construct
QKSN

SEQ ID NO: 2352 - protein, 4 aa, synthetic construct
  REGION 1..4: note = Synthetic Construct
QKSQ

SEQ ID NO: 2353 - protein, 4 aa, synthetic construct
  REGION 1..4: note = Synthetic Construct
QKSR

SEQ ID NO: 2354 - protein, 4 aa, synthetic construct
  REGION 1..4: note = Synthetic Construct
QKSS

SEQ ID NO: 2355 - protein, 4 aa, synthetic construct
  REGION 1..4: note = Synthetic Construct
QKST

SEQ ID NO: 2356 - protein, 4 aa, synthetic construct
  REGION 1..4: note = Synthetic Construct
QKSY

SEQ ID NO: 2357 - protein, 4 aa, synthetic construct
  REGION 1..4: note = Synthetic Construct
QKTA

SEQ ID NO: 2358 - protein, 4 aa, synthetic construct
  REGION 1..4: note = Synthetic Construct
QKTD

SEQ ID NO: 2359 - protein, 4 aa, synthetic construct
  REGION 1..4: note = Synthetic Construct
QKTE

SEQ ID NO: 2360 - protein, 4 aa, synthetic construct
  REGION 1..4: note = Synthetic Construct
QKTF

SEQ ID NO: 2361 - protein, 4 aa, synthetic construct
  REGION 1..4: note = Synthetic Construct
QKTG

SEQ ID NO: 2362 - protein, 4 aa, synthetic construct
  REGION 1..4: note = Synthetic Construct
QKTH

SEQ ID NO: 2363 - protein, 4 aa, synthetic construct
  REGION 1..4: note = Synthetic Construct
QKTI

SEQ ID NO: 2364 - protein, 4 aa, synthetic construct
  REGION 1..4: note = Synthetic Construct
QKTL

SEQ ID NO: 2365 - protein, 4 aa, synthetic construct
  REGION 1..4: note = Synthetic Construct
QKTN

SEQ ID NO: 2366 - protein, 4 aa, synthetic construct
  REGION 1..4: note = Synthetic Construct
QKTQ

SEQ ID NO: 2367 - protein, 4 aa, synthetic construct
  REGION 1..4: note = Synthetic Construct
QKTR

SEQ ID NO: 2368 - protein, 4 aa, synthetic construct
  REGION 1..4: note = Synthetic Construct
QKTS

SEQ ID NO: 2369 - protein, 4 aa, synthetic construct
  REGION 1..4: note = Synthetic Construct
QKTT

SEQ ID NO: 2370 - protein, 4 aa, synthetic construct
  REGION 1..4: note = Synthetic Construct
QKTY

SEQ ID NO: 2371 - protein, 4 aa, synthetic construct
  REGION 1..4: note = Synthetic Construct
QKYA

SEQ ID NO: 2372 - protein, 4 aa, synthetic construct
  REGION 1..4: note = Synthetic Construct
QKYD

SEQ ID NO: 2373 - protein, 4 aa, synthetic construct
  REGION 1..4: note = Synthetic Construct
QKYE

SEQ ID NO: 2374 - protein, 4 aa, synthetic construct
  REGION 1..4: note = Synthetic Construct
QKYF

SEQ ID NO: 2375 - protein, 4 aa, synthetic construct
  REGION 1..4: note = Synthetic Construct
QKYG

SEQ ID NO: 2376 - protein, 4 aa, synthetic construct
  REGION 1..4: note = Synthetic Construct
QKYH

SEQ ID NO: 2377 - protein, 4 aa, synthetic construct
  REGION 1..4: note = Synthetic Construct
QKYI

SEQ ID NO: 2378 - protein, 4 aa, synthetic construct
  REGION 1..4: note = Synthetic Construct
QKYL

SEQ ID NO: 2379 - protein, 4 aa, synthetic construct
  REGION 1..4: note = Synthetic Construct
QKYN

SEQ ID NO: 2380 - protein, 4 aa, synthetic construct
  REGION 1..4: note = Synthetic Construct
QKYQ

SEQ ID NO: 2381 - protein, 4 aa, synthetic construct
  REGION 1..4: note = Synthetic Construct
QKYR

SEQ ID NO: 2382 - protein, 4 aa, synthetic construct
  REGION 1..4: note = Synthetic Construct
QKYS

SEQ ID NO: 2383 - protein, 4 aa, synthetic construct
  REGION 1..4: note = Synthetic Construct
QKYT

SEQ ID NO: 2384 - protein, 4 aa, synthetic construct
  REGION 1..4: note = Synthetic Construct
QKYY

SEQ ID NO: 2385 - protein, 4 aa, synthetic construct
  REGION 1..4: note = Synthetic Construct
RKAA

SEQ ID NO: 2386 - protein, 4 aa, synthetic construct
  REGION 1..4: note = Synthetic Construct
RKAD

SEQ ID NO: 2387 - protein, 4 aa, synthetic construct
  REGION 1..4: note = Synthetic Construct
RKAE

SEQ ID NO: 2388 - protein, 4 aa, synthetic construct
  REGION 1..4: note = Synthetic Construct
RKAF

SEQ ID NO: 2389 - protein, 4 aa, synthetic construct
  REGION 1..4: note = Synthetic Construct
RKAG

SEQ ID NO: 2390 - protein, 4 aa, synthetic construct
  REGION 1..4: note = Synthetic Construct
RKAH

SEQ ID NO: 2391 - protein, 4 aa, synthetic construct
  REGION 1..4: note = Synthetic Construct
RKAI

SEQ ID NO: 2392 - protein, 4 aa, synthetic construct
  REGION 1..4: note = Synthetic Construct
RKAL

SEQ ID NO: 2393 - protein, 4 aa, synthetic construct
  REGION 1..4: note = Synthetic Construct
RKAN

SEQ ID NO: 2394 - protein, 4 aa, synthetic construct
  REGION 1..4: note = Synthetic Construct
RKAQ

SEQ ID NO: 2395 - protein, 4 aa, synthetic construct
  REGION 1..4: note = Synthetic Construct
RKAR

SEQ ID NO: 2396 - protein, 4 aa, synthetic construct
  REGION 1..4: note = Synthetic Construct
RKAS

SEQ ID NO: 2397 - protein, 4 aa, synthetic construct
  REGION 1..4: note = Synthetic Construct
RKAT

SEQ ID NO: 2398 - protein, 4 aa, synthetic construct
  REGION 1..4: note = Synthetic Construct
RKAY

SEQ ID NO: 2399 - protein, 4 aa, synthetic construct
  REGION 1..4: note = Synthetic Construct
RKDA

SEQ ID NO: 2400 - protein, 4 aa, synthetic construct
  REGION 1..4: note = Synthetic Construct
RKDD

SEQ ID NO: 2401 - protein, 4 aa, synthetic construct
  REGION 1..4: note = Synthetic Construct
RKDE

SEQ ID NO: 2402 - protein, 4 aa, synthetic construct
  REGION 1..4: note = Synthetic Construct
RKDF

SEQ ID NO: 2403 - protein, 4 aa, synthetic construct
  REGION 1..4: note = Synthetic Construct
RKDG

SEQ ID NO: 2404 - protein, 4 aa, synthetic construct
  REGION 1..4: note = Synthetic Construct
RKDH

SEQ ID NO: 2405 - protein, 4 aa, synthetic construct
  REGION 1..4: note = Synthetic Construct
RKDI

SEQ ID NO: 2406 - protein, 4 aa, synthetic construct
  REGION 1..4: note = Synthetic Construct
RKDL

SEQ ID NO: 2407 - protein, 4 aa, synthetic construct
  REGION 1..4: note = Synthetic Construct
RKDN

SEQ ID NO: 2408 - protein, 4 aa, synthetic construct
  REGION 1..4: note = Synthetic Construct
RKDQ

SEQ ID NO: 2409 - protein, 4 aa, synthetic construct
  REGION 1..4: note = Synthetic Construct
RKDR

SEQ ID NO: 2410 - protein, 4 aa, synthetic construct
  REGION 1..4: note = Synthetic Construct
RKDS

SEQ ID NO: 2411 - protein, 4 aa, synthetic construct
  REGION 1..4: note = Synthetic Construct
RKDT

SEQ ID NO: 2412 - protein, 4 aa, synthetic construct
  REGION 1..4: note = Synthetic Construct
RKDY

SEQ ID NO: 2413 - protein, 4 aa, synthetic construct
  REGION 1..4: note = Synthetic Construct
RKEA

SEQ ID NO: 2414 - protein, 4 aa, synthetic construct
  REGION 1..4: note = Synthetic Construct
RKED

SEQ ID NO: 2415 - protein, 4 aa, synthetic construct
  REGION 1..4: note = Synthetic Construct
RKEE

SEQ ID NO: 2416 - protein, 4 aa, synthetic construct
  REGION 1..4: note = Synthetic Construct
RKEF

SEQ ID NO: 2417 - protein, 4 aa, synthetic construct
  REGION 1..4: note = Synthetic Construct
RKEG

SEQ ID NO: 2418 - protein, 4 aa, synthetic construct
  REGION 1..4: note = Synthetic Construct
RKEH

SEQ ID NO: 2419 - protein, 4 aa, synthetic construct
  REGION 1..4: note = Synthetic Construct
RKEI

SEQ ID NO: 2420 - protein, 4 aa, synthetic construct
  REGION 1..4: note = Synthetic Construct
RKEL

SEQ ID NO: 2421 - protein, 4 aa, synthetic construct
  REGION 1..4: note = Synthetic Construct
RKEN

SEQ ID NO: 2422 - protein, 4 aa, synthetic construct
  REGION 1..4: note = Synthetic Construct
RKEQ

SEQ ID NO: 2423 - protein, 4 aa, synthetic construct
  REGION 1..4: note = Synthetic Construct
RKER

SEQ ID NO: 2424 - protein, 4 aa, synthetic construct
  REGION 1..4: note = Synthetic Construct
RKES

SEQ ID NO: 2425 - protein, 4 aa, synthetic construct
  REGION 1..4: note = Synthetic Construct
RKET

SEQ ID NO: 2426 - protein, 4 aa, synthetic construct
  REGION 1..4: note = Synthetic Construct
RKEY

SEQ ID NO: 2427 - protein, 4 aa, synthetic construct
  REGION 1..4: note = Synthetic Construct
RKFA

SEQ ID NO: 2428 - protein, 4 aa, synthetic construct
  REGION 1..4: note = Synthetic Construct
RKFD

SEQ ID NO: 2429 - protein, 4 aa, synthetic construct
  REGION 1..4: note = Synthetic Construct
RKFE

SEQ ID NO: 2430 - protein, 4 aa, synthetic construct
  REGION 1..4: note = Synthetic Construct
RKFF

SEQ ID NO: 2431 - protein, 4 aa, synthetic construct
  REGION 1..4: note = Synthetic Construct
RKFG

SEQ ID NO: 2432 - protein, 4 aa, synthetic construct
  REGION 1..4: note = Synthetic Construct
RKFH

SEQ ID NO: 2433 - protein, 4 aa, synthetic construct
  REGION 1..4: note = Synthetic Construct
RKFI

SEQ ID NO: 2434 - protein, 4 aa, synthetic construct
  REGION 1..4: note = Synthetic Construct
RKFL

SEQ ID NO: 2435 - protein, 4 aa, synthetic construct
  REGION 1..4: note = Synthetic Construct
RKFN

SEQ ID NO: 2436 - protein, 4 aa, synthetic construct
  REGION 1..4: note = Synthetic Construct
RKFQ

SEQ ID NO: 2437 - protein, 4 aa, synthetic construct
  REGION 1..4: note = Synthetic Construct
RKFR

SEQ ID NO: 2438 - protein, 4 aa, synthetic construct
  REGION 1..4: note = Synthetic Construct
RKFS

SEQ ID NO: 2439 - protein, 4 aa, synthetic construct
  REGION 1..4: note = Synthetic Construct
RKFT

SEQ ID NO: 2440 - protein, 4 aa, synthetic construct
  REGION 1..4: note = Synthetic Construct
RKFY

SEQ ID NO: 2441 - protein, 4 aa, synthetic construct
  REGION 1..4: note = Synthetic Construct
RKGA

SEQ ID NO: 2442 - protein, 4 aa, synthetic construct
  REGION 1..4: note = Synthetic Construct
RKGD

SEQ ID NO: 2443 - protein, 4 aa, synthetic construct
  REGION 1..4: note = Synthetic Construct
RKGE

SEQ ID NO: 2444 - protein, 4 aa, synthetic construct
  REGION 1..4: note = Synthetic Construct
RKGF

SEQ ID NO: 2445 - protein, 4 aa, synthetic construct
  REGION 1..4: note = Synthetic Construct
RKGG

SEQ ID NO: 2446 - protein, 4 aa, synthetic construct
  REGION 1..4: note = Synthetic Construct
RKGH

SEQ ID NO: 2447 - protein, 4 aa, synthetic construct
  REGION 1..4: note = Synthetic Construct
RKGI

SEQ ID NO: 2448 - protein, 4 aa, synthetic construct
  REGION 1..4: note = Synthetic Construct
RKGL

SEQ ID NO: 2449 - protein, 4 aa, synthetic construct
  REGION 1..4: note = Synthetic Construct
RKGN

SEQ ID NO: 2450 - protein, 4 aa, synthetic construct
  REGION 1..4: note = Synthetic Construct
RKGQ

SEQ ID NO: 2451 - protein, 4 aa, synthetic construct
  REGION 1..4: note = Synthetic Construct
RKGR

SEQ ID NO: 2452 - protein, 4 aa, synthetic construct
  REGION 1..4: note = Synthetic Construct
RKGS

SEQ ID NO: 2453 - protein, 4 aa, synthetic construct
  REGION 1..4: note = Synthetic Construct
RKGT

SEQ ID NO: 2454 - protein, 4 aa, synthetic construct
  REGION 1..4: note = Synthetic Construct
RKGY

SEQ ID NO: 2455 - protein, 4 aa, synthetic construct
  REGION 1..4: note = Synthetic Construct
RKHA

SEQ ID NO: 2456 - protein, 4 aa, synthetic construct
  REGION 1..4: note = Synthetic Construct
RKHD

SEQ ID NO: 2457 - protein, 4 aa, synthetic construct
  REGION 1..4: note = Synthetic Construct
RKHE

SEQ ID NO: 2458 - protein, 4 aa, synthetic construct
  REGION 1..4: note = Synthetic Construct
RKHF

SEQ ID NO: 2459 - protein, 4 aa, synthetic construct
  REGION 1..4: note = Synthetic Construct
RKHG

SEQ ID NO: 2460 - protein, 4 aa, synthetic construct
  REGION 1..4: note = Synthetic Construct
RKHH

SEQ ID NO: 2461 - protein, 4 aa, synthetic construct
  REGION 1..4: note = Synthetic Construct
RKHI

SEQ ID NO: 2462 - protein, 4 aa, synthetic construct
  REGION 1..4: note = Synthetic Construct
RKHL

SEQ ID NO: 2463 - protein, 4 aa, synthetic construct
  REGION 1..4: note = Synthetic Construct
RKHN

SEQ ID NO: 2464 - protein, 4 aa, synthetic construct
  REGION 1..4: note = Synthetic Construct
RKHQ

SEQ ID NO: 2465 - protein, 4 aa, synthetic construct
  REGION 1..4: note = Synthetic Construct
RKHR

SEQ ID NO: 2466 - protein, 4 aa, synthetic construct
  REGION 1..4: note = Synthetic Construct
RKHS

SEQ ID NO: 2467 - protein, 4 aa, synthetic construct
  REGION 1..4: note = Synthetic Construct
RKHT

SEQ ID NO: 2468 - protein, 4 aa, synthetic construct
  REGION 1..4: note = Synthetic Construct
RKHY

SEQ ID NO: 2469 - protein, 4 aa, synthetic construct
  REGION 1..4: note = Synthetic Construct
RKIA

SEQ ID NO: 2470 - protein, 4 aa, synthetic construct
  REGION 1..4: note = Synthetic Construct
RKID

SEQ ID NO: 2471 - protein, 4 aa, synthetic construct
  REGION 1..4: note = Synthetic Construct
RKIE

SEQ ID NO: 2472 - protein, 4 aa, synthetic construct
  REGION 1..4: note = Synthetic Construct
RKIF

SEQ ID NO: 2473 - protein, 4 aa, synthetic construct
  REGION 1..4: note = Synthetic Construct
RKIG

SEQ ID NO: 2474 - protein, 4 aa, synthetic construct
  REGION 1..4: note = Synthetic Construct
RKIH

SEQ ID NO: 2475 - protein, 4 aa, synthetic construct
  REGION 1..4: note = Synthetic Construct
RKII

SEQ ID NO: 2476 - protein, 4 aa, synthetic construct
  REGION 1..4: note = Synthetic Construct
RKIL

SEQ ID NO: 2477 - protein, 4 aa, synthetic construct
  REGION 1..4: note = Synthetic Construct
RKIN

SEQ ID NO: 2478 - protein, 4 aa, synthetic construct
  REGION 1..4: note = Synthetic Construct
RKIQ

SEQ ID NO: 2479 - protein, 4 aa, synthetic construct
  REGION 1..4: note = Synthetic Construct
RKIR

SEQ ID NO: 2480 - protein, 4 aa, synthetic construct
  REGION 1..4: note = Synthetic Construct
RKIS

SEQ ID NO: 2481 - protein, 4 aa, synthetic construct
  REGION 1..4: note = Synthetic Construct
RKIT

SEQ ID NO: 2482 - protein, 4 aa, synthetic construct
  REGION 1..4: note = Synthetic Construct
RKIY

SEQ ID NO: 2483 - protein, 4 aa, synthetic construct
  REGION 1..4: note = Synthetic Construct
RKLA

SEQ ID NO: 2484 - protein, 4 aa, synthetic construct
  REGION 1..4: note = Synthetic Construct
RKLD

SEQ ID NO: 2485 - protein, 4 aa, synthetic construct
  REGION 1..4: note = Synthetic Construct
RKLE

SEQ ID NO: 2486 - protein, 4 aa, synthetic construct
  REGION 1..4: note = Synthetic Construct
RKLF

SEQ ID NO: 2487 - protein, 4 aa, synthetic construct
  REGION 1..4: note = Synthetic Construct
RKLG

SEQ ID NO: 2488 - protein, 4 aa, synthetic construct
  REGION 1..4: note = Synthetic Construct
RKLH

SEQ ID NO: 2489 - protein, 4 aa, synthetic construct
  REGION 1..4: note = Synthetic Construct
RKLI

SEQ ID NO: 2490 - protein, 4 aa, synthetic construct
  REGION 1..4: note = Synthetic Construct
RKLL

SEQ ID NO: 2491 - protein, 4 aa, synthetic construct
  REGION 1..4: note = Synthetic Construct
RKLN

SEQ ID NO: 2492 - protein, 4 aa, synthetic construct
  REGION 1..4: note = Synthetic Construct
RKLQ

SEQ ID NO: 2493 - protein, 4 aa, synthetic construct
  REGION 1..4: note = Synthetic Construct
RKLR

SEQ ID NO: 2494 - protein, 4 aa, synthetic construct
  REGION 1..4: note = Synthetic Construct
RKLS

SEQ ID NO: 2495 - protein, 4 aa, synthetic construct
  REGION 1..4: note = Synthetic Construct
RKLT

SEQ ID NO: 2496 - protein, 4 aa, synthetic construct
  REGION 1..4: note = Synthetic Construct
RKLY

SEQ ID NO: 2497 - protein, 4 aa, synthetic construct
  REGION 1..4: note = Synthetic Construct
RKNA

SEQ ID NO: 2498 - protein, 4 aa, synthetic construct
  REGION 1..4: note = Synthetic Construct
RKND

SEQ ID NO: 2499 - protein, 4 aa, synthetic construct
  REGION 1..4: note = Synthetic Construct
RKNE

SEQ ID NO: 2500 - protein, 4 aa, synthetic construct
  REGION 1..4: note = Synthetic Construct
RKNF

SEQ ID NO: 2501 - protein, 4 aa, synthetic construct
  REGION 1..4: note = Synthetic Construct
RKNG

SEQ ID NO: 2502 - protein, 4 aa, synthetic construct
  REGION 1..4: note = Synthetic Construct
RKNH

SEQ ID NO: 2503 - protein, 4 aa, synthetic construct
  REGION 1..4: note = Synthetic Construct
RKNI

SEQ ID NO: 2504 - protein, 4 aa, synthetic construct
  REGION 1..4: note = Synthetic Construct
RKNL

SEQ ID NO: 2505 - protein, 4 aa, synthetic construct
  REGION 1..4: note = Synthetic Construct
RKNN

SEQ ID NO: 2506 - protein, 4 aa, synthetic construct
  REGION 1..4: note = Synthetic Construct
RKNQ

SEQ ID NO: 2507 - protein, 4 aa, synthetic construct
  REGION 1..4: note = Synthetic Construct
RKNR

SEQ ID NO: 2508 - protein, 4 aa, synthetic construct
  REGION 1..4: note = Synthetic Construct
RKNS

SEQ ID NO: 2509 - protein, 4 aa, synthetic construct
  REGION 1..4: note = Synthetic Construct
RKNT

SEQ ID NO: 2510 - protein, 4 aa, synthetic construct
  REGION 1..4: note = Synthetic Construct
RKNY

SEQ ID NO: 2511 - protein, 4 aa, synthetic construct
  REGION 1..4: note = Synthetic Construct
RKPA

SEQ ID NO: 2512 - protein, 4 aa, synthetic construct
  REGION 1..4: note = Synthetic Construct
RKPD

SEQ ID NO: 2513 - protein, 4 aa, synthetic construct
  REGION 1..4: note = Synthetic Construct
RKPE

SEQ ID NO: 2514 - protein, 4 aa, synthetic construct
  REGION 1..4: note = Synthetic Construct
RKPF

SEQ ID NO: 2515 - protein, 4 aa, synthetic construct
  REGION 1..4: note = Synthetic Construct
RKPG

SEQ ID NO: 2516 - protein, 4 aa, synthetic construct
  REGION 1..4: note = Synthetic Construct
RKPH

SEQ ID NO: 2517 - protein, 4 aa, synthetic construct
  REGION 1..4: note = Synthetic Construct
RKPI

SEQ ID NO: 2518 - protein, 4 aa, synthetic construct
  REGION 1..4: note = Synthetic Construct
RKPL

SEQ ID NO: 2519 - protein, 4 aa, synthetic construct
  REGION 1..4: note = Synthetic Construct
RKPN

SEQ ID NO: 2520 - protein, 4 aa, synthetic construct
  REGION 1..4: note = Synthetic Construct
RKPQ

SEQ ID NO: 2521 - protein, 4 aa, synthetic construct
  REGION 1..4: note = Synthetic Construct
RKPR

SEQ ID NO: 2522 - protein, 4 aa, synthetic construct
  REGION 1..4: note = Synthetic Construct
RKPS

SEQ ID NO: 2523 - protein, 4 aa, synthetic construct
  REGION 1..4: note = Synthetic Construct
RKPT

SEQ ID NO: 2524 - protein, 4 aa, synthetic construct
  REGION 1..4: note = Synthetic Construct
RKPY

SEQ ID NO: 2525 - protein, 4 aa, synthetic construct
  REGION 1..4: note = Synthetic Construct
RKQA

SEQ ID NO: 2526 - protein, 4 aa, synthetic construct
  REGION 1..4: note = Synthetic Construct
RKQD

SEQ ID NO: 2527 - protein, 4 aa, synthetic construct
  REGION 1..4: note = Synthetic Construct
RKQE

SEQ ID NO: 2528 - protein, 4 aa, synthetic construct
  REGION 1..4: note = Synthetic Construct
RKQF

SEQ ID NO: 2529 - protein, 4 aa, synthetic construct
  REGION 1..4: note = Synthetic Construct
RKQG

SEQ ID NO: 2530 - protein, 4 aa, synthetic construct
  REGION 1..4: note = Synthetic Construct
RKQH

SEQ ID NO: 2531 - protein, 4 aa, synthetic construct
  REGION 1..4: note = Synthetic Construct
RKQI

SEQ ID NO: 2532 - protein, 4 aa, synthetic construct
  REGION 1..4: note = Synthetic Construct
RKQL

SEQ ID NO: 2533 - protein, 4 aa, synthetic construct
  REGION 1..4: note = Synthetic Construct
RKQN

SEQ ID NO: 2534 - protein, 4 aa, synthetic construct
  REGION 1..4: note = Synthetic Construct
RKQQ

SEQ ID NO: 2535 - protein, 4 aa, synthetic construct
  REGION 1..4: note = Synthetic Construct
RKQR

SEQ ID NO: 2536 - protein, 4 aa, synthetic construct
  REGION 1..4: note = Synthetic Construct
RKQS

SEQ ID NO: 2537 - protein, 4 aa, synthetic construct
  REGION 1..4: note = Synthetic Construct
RKQT

SEQ ID NO: 2538 - protein, 4 aa, synthetic construct
  REGION 1..4: note = Synthetic Construct
RKQY

SEQ ID NO: 2539 - protein, 4 aa, synthetic construct
  REGION 1..4: note = Synthetic Construct
RKRA

SEQ ID NO: 2540 - protein, 4 aa, synthetic construct
  REGION 1..4: note = Synthetic Construct
RKRD

SEQ ID NO: 2541 - protein, 4 aa, synthetic construct
  REGION 1..4: note = Synthetic Construct
RKRE

SEQ ID NO: 2542 - protein, 4 aa, synthetic construct
  REGION 1..4: note = Synthetic Construct
RKRF

SEQ ID NO: 2543 - protein, 4 aa, synthetic construct
  REGION 1..4: note = Synthetic Construct
RKRG

SEQ ID NO: 2544 - protein, 4 aa, synthetic construct
  REGION 1..4: note = Synthetic Construct
RKRH

SEQ ID NO: 2545 - protein, 4 aa, synthetic construct
  REGION 1..4: note = Synthetic Construct
RKRI

SEQ ID NO: 2546 - protein, 4 aa, synthetic construct
  REGION 1..4: note = Synthetic Construct
RKRL

SEQ ID NO: 2547 - protein, 4 aa, synthetic construct
  REGION 1..4: note = Synthetic Construct
RKRN

SEQ ID NO: 2548 - protein, 4 aa, synthetic construct
  REGION 1..4: note = Synthetic Construct
RKRQ

SEQ ID NO: 2549 - protein, 4 aa, synthetic construct
  REGION 1..4: note = Synthetic Construct
RKRR

SEQ ID NO: 2550 - protein, 4 aa, synthetic construct
  REGION 1..4: note = Synthetic Construct
RKRS

SEQ ID NO: 2551 - protein, 4 aa, synthetic construct
  REGION 1..4: note = Synthetic Construct
RKRT

SEQ ID NO: 2552 - protein, 4 aa, synthetic construct
  REGION 1..4: note = Synthetic Construct
RKRY

SEQ ID NO: 2553 - protein, 4 aa, synthetic construct
  REGION 1..4: note = Synthetic Construct
RKSA

SEQ ID NO: 2554 - protein, 4 aa, synthetic construct
  REGION 1..4: note = Synthetic Construct
RKSD

SEQ ID NO: 2555 - protein, 4 aa, synthetic construct
  REGION 1..4: note = Synthetic Construct
RKSE

SEQ ID NO: 2556 - protein, 4 aa, synthetic construct
  REGION 1..4: note = Synthetic Construct
RKSF

SEQ ID NO: 2557 - protein, 4 aa, synthetic construct
  REGION 1..4: note = Synthetic Construct
RKSG

SEQ ID NO: 2558 - protein, 4 aa, synthetic construct
  REGION 1..4: note = Synthetic Construct
RKSH

SEQ ID NO: 2559 - protein, 4 aa, synthetic construct
  REGION 1..4: note = Synthetic Construct
RKSI

SEQ ID NO: 2560 - protein, 4 aa, synthetic construct
  REGION 1..4: note = Synthetic Construct
RKSL

SEQ ID NO: 2561 - protein, 4 aa, synthetic construct
  REGION 1..4: note = Synthetic Construct
RKSN

SEQ ID NO: 2562 - protein, 4 aa, synthetic construct
  REGION 1..4: note = Synthetic Construct
RKSQ

SEQ ID NO: 2563 - protein, 4 aa, synthetic construct
  REGION 1..4: note = Synthetic Construct
RKSR

SEQ ID NO: 2564 - protein, 4 aa, synthetic construct
  REGION 1..4: note = Synthetic Construct
RKSS

SEQ ID NO: 2565 - protein, 4 aa, synthetic construct
  REGION 1..4: note = Synthetic Construct
RKST

SEQ ID NO: 2566 - protein, 4 aa, synthetic construct
  REGION 1..4: note = Synthetic Construct
RKSY

SEQ ID NO: 2567 - protein, 4 aa, synthetic construct
  REGION 1..4: note = Synthetic Construct
RKTA

SEQ ID NO: 2568 - protein, 4 aa, synthetic construct
  REGION 1..4: note = Synthetic Construct
RKTD

SEQ ID NO: 2569 - protein, 4 aa, synthetic construct
  REGION 1..4: note = Synthetic Construct
RKTE

SEQ ID NO: 2570 - protein, 4 aa, synthetic construct
  REGION 1..4: note = Synthetic Construct
RKTF

SEQ ID NO: 2571 - protein, 4 aa, synthetic construct
  REGION 1..4: note = Synthetic Construct
RKTG

SEQ ID NO: 2572 - protein, 4 aa, synthetic construct
  REGION 1..4: note = Synthetic Construct
RKTH

SEQ ID NO: 2573 - protein, 4 aa, synthetic construct
  REGION 1..4: note = Synthetic Construct
RKTI

SEQ ID NO: 2574 - protein, 4 aa, synthetic construct
  REGION 1..4: note = Synthetic Construct
RKTL

SEQ ID NO: 2575 - protein, 4 aa, synthetic construct
  REGION 1..4: note = Synthetic Construct
RKTN

SEQ ID NO: 2576 - protein, 4 aa, synthetic construct
  REGION 1..4: note = Synthetic Construct
RKTQ

SEQ ID NO: 2577 - protein, 4 aa, synthetic construct
  REGION 1..4: note = Synthetic Construct
RKTR

SEQ ID NO: 2578 - protein, 4 aa, synthetic construct
  REGION 1..4: note = Synthetic Construct
RKTS

SEQ ID NO: 2579 - protein, 4 aa, synthetic construct
  REGION 1..4: note = Synthetic Construct
RKTT

SEQ ID NO: 2580 - protein, 4 aa, synthetic construct
  REGION 1..4: note = Synthetic Construct
RKTY

SEQ ID NO: 2581 - protein, 4 aa, synthetic construct
  REGION 1..4: note = Synthetic Construct
RKYA

SEQ ID NO: 2582 - protein, 4 aa, synthetic construct
  REGION 1..4: note = Synthetic Construct
RKYD

SEQ ID NO: 2583 - protein, 4 aa, synthetic construct
  REGION 1..4: note = Synthetic Construct
RKYE

SEQ ID NO: 2584 - protein, 4 aa, synthetic construct
  REGION 1..4: note = Synthetic Construct
RKYF

SEQ ID NO: 2585 - protein, 4 aa, synthetic construct
  REGION 1..4: note = Synthetic Construct
RKYG

SEQ ID NO: 2586 - protein, 4 aa, synthetic construct
  REGION 1..4: note = Synthetic Construct
RKYH

SEQ ID NO: 2587 - protein, 4 aa, synthetic construct
  REGION 1..4: note = Synthetic Construct
RKYI

SEQ ID NO: 2588 - protein, 4 aa, synthetic construct
  REGION 1..4: note = Synthetic Construct
RKYL

SEQ ID NO: 2589 - protein, 4 aa, synthetic construct
  REGION 1..4: note = Synthetic Construct
RKYN

SEQ ID NO: 2590 - protein, 4 aa, synthetic construct
  REGION 1..4: note = Synthetic Construct
RKYQ

SEQ ID NO: 2591 - protein, 4 aa, synthetic construct
  REGION 1..4: note = Synthetic Construct
RKYR

SEQ ID NO: 2592 - protein, 4 aa, synthetic construct
  REGION 1..4: note = Synthetic Construct
RKYS

SEQ ID NO: 2593 - protein, 4 aa, synthetic construct
  REGION 1..4: note = Synthetic Construct
RKYT

SEQ ID NO: 2594 - protein, 4 aa, synthetic construct
  REGION 1..4: note = Synthetic Construct
RKYY

SEQ ID NO: 2595 - protein, 4 aa, synthetic construct
  REGION 1..4: note = Synthetic Construct
SKAA

SEQ ID NO: 2596 - protein, 4 aa, synthetic construct
  REGION 1..4: note = Synthetic Construct
SKAD

SEQ ID NO: 2597 - protein, 4 aa, synthetic construct
  REGION 1..4: note = Synthetic Construct
SKAE

SEQ ID NO: 2598 - protein, 4 aa, synthetic construct
  REGION 1..4: note = Synthetic Construct
SKAF

SEQ ID NO: 2599 - protein, 4 aa, synthetic construct
  REGION 1..4: note = Synthetic Construct
SKAG

SEQ ID NO: 2600 - protein, 4 aa, synthetic construct
  REGION 1..4: note = Synthetic Construct
SKAH

SEQ ID NO: 2601 - protein, 4 aa, synthetic construct
  REGION 1..4: note = Synthetic Construct
SKAI

SEQ ID NO: 2602 - protein, 4 aa, synthetic construct
  REGION 1..4: note = Synthetic Construct
SKAL

SEQ ID NO: 2603 - protein, 4 aa, synthetic construct
  REGION 1..4: note = Synthetic Construct
SKAN

SEQ ID NO: 2604 - protein, 4 aa, synthetic construct
  REGION 1..4: note = Synthetic Construct
SKAQ

SEQ ID NO: 2605 - protein, 4 aa, synthetic construct
  REGION 1..4: note = Synthetic Construct
SKAR

SEQ ID NO: 2606 - protein, 4 aa, synthetic construct
  REGION 1..4: note = Synthetic Construct
SKAS

SEQ ID NO: 2607 - protein, 4 aa, synthetic construct
  REGION 1..4: note = Synthetic Construct
SKAT

SEQ ID NO: 2608 - protein, 4 aa, synthetic construct
  REGION 1..4: note = Synthetic Construct
SKAY

SEQ ID NO: 2609 - protein, 4 aa, synthetic construct
  REGION 1..4: note = Synthetic Construct
SKDA

SEQ ID NO: 2610 - protein, 4 aa, synthetic construct
  REGION 1..4: note = Synthetic Construct
SKDD

SEQ ID NO: 2611 - protein, 4 aa, synthetic construct
  REGION 1..4: note = Synthetic Construct
SKDE

SEQ ID NO: 2612 - protein, 4 aa, synthetic construct
  REGION 1..4: note = Synthetic Construct
SKDF

SEQ ID NO: 2613 - protein, 4 aa, synthetic construct
  REGION 1..4: note = Synthetic Construct
SKDG

SEQ ID NO: 2614 - protein, 4 aa, synthetic construct
  REGION 1..4: note = Synthetic Construct
SKDH

SEQ ID NO: 2615 - protein, 4 aa, synthetic construct
  REGION 1..4: note = Synthetic Construct
SKDI

SEQ ID NO: 2616 - protein, 4 aa, synthetic construct
  REGION 1..4: note = Synthetic Construct
SKDL

SEQ ID NO: 2617 - protein, 4 aa, synthetic construct
  REGION 1..4: note = Synthetic Construct
SKDN

SEQ ID NO: 2618 - protein, 4 aa, synthetic construct
  REGION 1..4: note = Synthetic Construct
SKDQ

SEQ ID NO: 2619 - protein, 4 aa, synthetic construct
  REGION 1..4: note = Synthetic Construct
SKDR

SEQ ID NO: 2620 - protein, 4 aa, synthetic construct
  REGION 1..4: note = Synthetic Construct
SKDS

SEQ ID NO: 2621 - protein, 4 aa, synthetic construct
  REGION 1..4: note = Synthetic Construct
SKDT

SEQ ID NO: 2622 - protein, 4 aa, synthetic construct
  REGION 1..4: note = Synthetic Construct
SKDY

SEQ ID NO: 2623 - protein, 4 aa, synthetic construct
  REGION 1..4: note = Synthetic Construct
SKEA

SEQ ID NO: 2624 - protein, 4 aa, synthetic construct
  REGION 1..4: note = Synthetic Construct
SKED

SEQ ID NO: 2625 - protein, 4 aa, synthetic construct
  REGION 1..4: note = Synthetic Construct
SKEE

SEQ ID NO: 2626 - protein, 4 aa, synthetic construct
  REGION 1..4: note = Synthetic Construct
SKEF

SEQ ID NO: 2627 - protein, 4 aa, synthetic construct
  REGION 1..4: note = Synthetic Construct
SKEG

SEQ ID NO: 2628 - protein, 4 aa, synthetic construct
  REGION 1..4: note = Synthetic Construct
SKEH

SEQ ID NO: 2629 - protein, 4 aa, synthetic construct
  REGION 1..4: note = Synthetic Construct
SKEI

SEQ ID NO: 2630 - protein, 4 aa, synthetic construct
  REGION 1..4: note = Synthetic Construct
SKEL

SEQ ID NO: 2631 - protein, 4 aa, synthetic construct
  REGION 1..4: note = Synthetic Construct
SKEN

SEQ ID NO: 2632 - protein, 4 aa, synthetic construct
  REGION 1..4: note = Synthetic Construct
SKEQ

SEQ ID NO: 2633 - protein, 4 aa, synthetic construct
  REGION 1..4: note = Synthetic Construct
SKER

SEQ ID NO: 2634 - protein, 4 aa, synthetic construct
  REGION 1..4: note = Synthetic Construct
SKES

SEQ ID NO: 2635 - protein, 4 aa, synthetic construct
  REGION 1..4: note = Synthetic Construct
SKET

SEQ ID NO: 2636 - protein, 4 aa, synthetic construct
  REGION 1..4: note = Synthetic Construct
SKEY

SEQ ID NO: 2637 - protein, 4 aa, synthetic construct
  REGION 1..4: note = Synthetic Construct
SKFA

SEQ ID NO: 2638 - protein, 4 aa, synthetic construct
  REGION 1..4: note = Synthetic Construct
SKFD

SEQ ID NO: 2639 - protein, 4 aa, synthetic construct
  REGION 1..4: note = Synthetic Construct
SKFE

SEQ ID NO: 2640 - protein, 4 aa, synthetic construct
  REGION 1..4: note = Synthetic Construct
SKFF

SEQ ID NO: 2641 - protein, 4 aa, synthetic construct
  REGION 1..4: note = Synthetic Construct
SKFG

SEQ ID NO: 2642 - protein, 4 aa, synthetic construct
  REGION 1..4: note = Synthetic Construct
SKFH

SEQ ID NO: 2643 - protein, 4 aa, synthetic construct
  REGION 1..4: note = Synthetic Construct
SKFI

SEQ ID NO: 2644 - protein, 4 aa, synthetic construct
  REGION 1..4: note = Synthetic Construct
SKFL

SEQ ID NO: 2645 - protein, 4 aa, synthetic construct
  REGION 1..4: note = Synthetic Construct
SKFN

SEQ ID NO: 2646 - protein, 4 aa, synthetic construct
  REGION 1..4: note = Synthetic Construct
SKFQ

SEQ ID NO: 2647 - protein, 4 aa, synthetic construct
  REGION 1..4: note = Synthetic Construct
SKFR

SEQ ID NO: 2648 - protein, 4 aa, synthetic construct
  REGION 1..4: note = Synthetic Construct
SKFS

SEQ ID NO: 2649 - protein, 4 aa, synthetic construct
  REGION 1..4: note = Synthetic Construct
SKFT

SEQ ID NO: 2650 - protein, 4 aa, synthetic construct
  REGION 1..4: note = Synthetic Construct
SKFY

SEQ ID NO: 2651 - protein, 4 aa, synthetic construct
  REGION 1..4: note = Synthetic Construct
SKGA

SEQ ID NO: 2652 - protein, 4 aa, synthetic construct
  REGION 1..4: note = Synthetic Construct
SKGD

SEQ ID NO: 2653 - protein, 4 aa, synthetic construct
  REGION 1..4: note = Synthetic Construct
SKGE

SEQ ID NO: 2654 - protein, 4 aa, synthetic construct
  REGION 1..4: note = Synthetic Construct
SKGF

SEQ ID NO: 2655 - protein, 4 aa, synthetic construct
  REGION 1..4: note = Synthetic Construct
SKGG

SEQ ID NO: 2656 - protein, 4 aa, synthetic construct
  REGION 1..4: note = Synthetic Construct
SKGH

SEQ ID NO: 2657 - protein, 4 aa, synthetic construct
  REGION 1..4: note = Synthetic Construct
SKGI

SEQ ID NO: 2658 - protein, 4 aa, synthetic construct
  REGION 1..4: note = Synthetic Construct
SKGL

SEQ ID NO: 2659 - protein, 4 aa, synthetic construct
  REGION 1..4: note = Synthetic Construct
SKGN

SEQ ID NO: 2660 - protein, 4 aa, synthetic construct
  REGION 1..4: note = Synthetic Construct
SKGQ

SEQ ID NO: 2661 - protein, 4 aa, synthetic construct
  REGION 1..4: note = Synthetic Construct
SKGR

SEQ ID NO: 2662 - protein, 4 aa, synthetic construct
  REGION 1..4: note = Synthetic Construct
SKGS

SEQ ID NO: 2663 - protein, 4 aa, synthetic construct
  REGION 1..4: note = Synthetic Construct
SKGT

SEQ ID NO: 2664 - protein, 4 aa, synthetic construct
  REGION 1..4: note = Synthetic Construct
SKGY

SEQ ID NO: 2665 - protein, 4 aa, synthetic construct
  REGION 1..4: note = Synthetic Construct
SKHA

SEQ ID NO: 2666 - protein, 4 aa, synthetic construct
  REGION 1..4: note = Synthetic Construct
SKHD

SEQ ID NO: 2667 - protein, 4 aa, synthetic construct
  REGION 1..4: note = Synthetic Construct
SKHE

SEQ ID NO: 2668 - protein, 4 aa, synthetic construct
  REGION 1..4: note = Synthetic Construct
SKHF

SEQ ID NO: 2669 - protein, 4 aa, synthetic construct
  REGION 1..4: note = Synthetic Construct
SKHG

SEQ ID NO: 2670 - protein, 4 aa, synthetic construct
  REGION 1..4: note = Synthetic Construct
SKHH

SEQ ID NO: 2671 - protein, 4 aa, synthetic construct
  REGION 1..4: note = Synthetic Construct
SKHI

SEQ ID NO: 2672 - protein, 4 aa, synthetic construct
  REGION 1..4: note = Synthetic Construct
SKHL

SEQ ID NO: 2673 - protein, 4 aa, synthetic construct
  REGION 1..4: note = Synthetic Construct
SKHN

SEQ ID NO: 2674 - protein, 4 aa, synthetic construct
  REGION 1..4: note = Synthetic Construct
SKHQ

SEQ ID NO: 2675 - protein, 4 aa, synthetic construct
  REGION 1..4: note = Synthetic Construct
SKHR

SEQ ID NO: 2676 - protein, 4 aa, synthetic construct
  REGION 1..4: note = Synthetic Construct
SKHS

SEQ ID NO: 2677 - protein, 4 aa, synthetic construct
  REGION 1..4: note = Synthetic Construct
SKHT

SEQ ID NO: 2678 - protein, 4 aa, synthetic construct
  REGION 1..4: note = Synthetic Construct
SKHY

SEQ ID NO: 2679 - protein, 4 aa, synthetic construct
  REGION 1..4: note = Synthetic Construct
SKIA

SEQ ID NO: 2680 - protein, 4 aa, synthetic construct
  REGION 1..4: note = Synthetic Construct
SKID

SEQ ID NO: 2681 - protein, 4 aa, synthetic construct
  REGION 1..4: note = Synthetic Construct
SKIE

SEQ ID NO: 2682 - protein, 4 aa, synthetic construct
  REGION 1..4: note = Synthetic Construct
SKIF

SEQ ID NO: 2683 - protein, 4 aa, synthetic construct
  REGION 1..4: note = Synthetic Construct
SKIG

SEQ ID NO: 2684 - protein, 4 aa, synthetic construct
  REGION 1..4: note = Synthetic Construct
SKIH

SEQ ID NO: 2685 - protein, 4 aa, synthetic construct
  REGION 1..4: note = Synthetic Construct
SKII

SEQ ID NO: 2686 - protein, 4 aa, synthetic construct
  REGION 1..4: note = Synthetic Construct
SKIL

SEQ ID NO: 2687 - protein, 4 aa, synthetic construct
  REGION 1..4: note = Synthetic Construct
SKIN

SEQ ID NO: 2688 - protein, 4 aa, synthetic construct
  REGION 1..4: note = Synthetic Construct
SKIQ

SEQ ID NO: 2689 - protein, 4 aa, synthetic construct
  REGION 1..4: note = Synthetic Construct
SKIR

SEQ ID NO: 2690 - protein, 4 aa, synthetic construct
  REGION 1..4: note = Synthetic Construct
SKIS

SEQ ID NO: 2691 - protein, 4 aa, synthetic construct
  REGION 1..4: note = Synthetic Construct
SKIT

SEQ ID NO: 2692 - protein, 4 aa, synthetic construct
  REGION 1..4: note = Synthetic Construct
SKIY

SEQ ID NO: 2693 - protein, 4 aa, synthetic construct
  REGION 1..4: note = Synthetic Construct
SKLA

SEQ ID NO: 2694 - protein, 4 aa, synthetic construct
  REGION 1..4: note = Synthetic Construct
SKLD

SEQ ID NO: 2695 - protein, 4 aa, synthetic construct
  REGION 1..4: note = Synthetic Construct
SKLE

SEQ ID NO: 2696 - protein, 4 aa, synthetic construct
  REGION 1..4: note = Synthetic Construct
SKLF

SEQ ID NO: 2697 - protein, 4 aa, synthetic construct
  REGION 1..4: note = Synthetic Construct
SKLG

SEQ ID NO: 2698 - protein, 4 aa, synthetic construct
  REGION 1..4: note = Synthetic Construct
SKLH

SEQ ID NO: 2699 - protein, 4 aa, synthetic construct
  REGION 1..4: note = Synthetic Construct
SKLI

SEQ ID NO: 2700 - protein, 4 aa, synthetic construct
  REGION 1..4: note = Synthetic Construct
SKLL

SEQ ID NO: 2701 - protein, 4 aa, synthetic construct
  REGION 1..4: note = Synthetic Construct
SKLN

SEQ ID NO: 2702 - protein, 4 aa, synthetic construct
  REGION 1..4: note = Synthetic Construct
SKLQ

SEQ ID NO: 2703 - protein, 4 aa, synthetic construct
  REGION 1..4: note = Synthetic Construct
SKLR

SEQ ID NO: 2704 - protein, 4 aa, synthetic construct
  REGION 1..4: note = Synthetic Construct
SKLS

SEQ ID NO: 2705 - protein, 4 aa, synthetic construct
  REGION 1..4: note = Synthetic Construct
SKLT

SEQ ID NO: 2706 - protein, 4 aa, synthetic construct
  REGION 1..4: note = Synthetic Construct
SKLY

SEQ ID NO: 2707 - protein, 4 aa, synthetic construct
  REGION 1..4: note = Synthetic Construct
SKNA

SEQ ID NO: 2708 - protein, 4 aa, synthetic construct
  REGION 1..4: note = Synthetic Construct
SKND

SEQ ID NO: 2709 - protein, 4 aa, synthetic construct
  REGION 1..4: note = Synthetic Construct
SKNE

SEQ ID NO: 2710 - protein, 4 aa, synthetic construct
  REGION 1..4: note = Synthetic Construct
SKNF

SEQ ID NO: 2711 - protein, 4 aa, synthetic construct
  REGION 1..4: note = Synthetic Construct
SKNG

SEQ ID NO: 2712 - protein, 4 aa, synthetic construct
  REGION 1..4: note = Synthetic Construct
SKNH

SEQ ID NO: 2713 - protein, 4 aa, synthetic construct
  REGION 1..4: note = Synthetic Construct
SKNI

SEQ ID NO: 2714 - protein, 4 aa, synthetic construct
  REGION 1..4: note = Synthetic Construct
SKNL

SEQ ID NO: 2715 - protein, 4 aa, synthetic construct
  REGION 1..4: note = Synthetic Construct
SKNN

SEQ ID NO: 2716 - protein, 4 aa, synthetic construct
  REGION 1..4: note = Synthetic Construct
SKNQ

SEQ ID NO: 2717 - protein, 4 aa, synthetic construct
  REGION 1..4: note = Synthetic Construct
SKNR

SEQ ID NO: 2718 - protein, 4 aa, synthetic construct
  REGION 1..4: note = Synthetic Construct
SKNS

SEQ ID NO: 2719 - protein, 4 aa, synthetic construct
  REGION 1..4: note = Synthetic Construct
SKNT

SEQ ID NO: 2720 - protein, 4 aa, synthetic construct
  REGION 1..4: note = Synthetic Construct
SKNY

SEQ ID NO: 2721 - protein, 4 aa, synthetic construct
  REGION 1..4: note = Synthetic Construct
SKPA

SEQ ID NO: 2722 - protein, 4 aa, synthetic construct
  REGION 1..4: note = Synthetic Construct
SKPD

SEQ ID NO: 2723 - protein, 4 aa, synthetic construct
  REGION 1..4: note = Synthetic Construct
SKPE

SEQ ID NO: 2724 - protein, 4 aa, synthetic construct
  REGION 1..4: note = Synthetic Construct
SKPF

SEQ ID NO: 2725 - protein, 4 aa, synthetic construct
  REGION 1..4: note = Synthetic Construct
SKPG

SEQ ID NO: 2726 - protein, 4 aa, synthetic construct
  REGION 1..4: note = Synthetic Construct
SKPH

SEQ ID NO: 2727 - protein, 4 aa, synthetic construct
  REGION 1..4: note = Synthetic Construct
SKPI

SEQ ID NO: 2728 - protein, 4 aa, synthetic construct
  REGION 1..4: note = Synthetic Construct
SKPL

SEQ ID NO: 2729 - protein, 4 aa, synthetic construct
  REGION 1..4: note = Synthetic Construct
SKPN

SEQ ID NO: 2730 - protein, 4 aa, synthetic construct
  REGION 1..4: note = Synthetic Construct
SKPQ

SEQ ID NO: 2731 - protein, 4 aa, synthetic construct
  REGION 1..4: note = Synthetic Construct
SKPR

SEQ ID NO: 2732 - protein, 4 aa, synthetic construct
  REGION 1..4: note = Synthetic Construct
SKPS

SEQ ID NO: 2733 - protein, 4 aa, synthetic construct
  REGION 1..4: note = Synthetic Construct
SKPT

SEQ ID NO: 2734 - protein, 4 aa, synthetic construct
  REGION 1..4: note = Synthetic Construct
SKPY

SEQ ID NO: 2735 - protein, 4 aa, synthetic construct
  REGION 1..4: note = Synthetic Construct
SKQA

SEQ ID NO: 2736 - protein, 4 aa, synthetic construct
  REGION 1..4: note = Synthetic Construct
SKQD

SEQ ID NO: 2737 - protein, 4 aa, synthetic construct
  REGION 1..4: note = Synthetic Construct
SKQE

SEQ ID NO: 2738 - protein, 4 aa, synthetic construct
  REGION 1..4: note = Synthetic Construct
SKQF

SEQ ID NO: 2739 - protein, 4 aa, synthetic construct
  REGION 1..4: note = Synthetic Construct
SKQG

SEQ ID NO: 2740 - protein, 4 aa, synthetic construct
  REGION 1..4: note = Synthetic Construct
SKQH

SEQ ID NO: 2741 - protein, 4 aa, synthetic construct
  REGION 1..4: note = Synthetic Construct
SKQI

SEQ ID NO: 2742 - protein, 4 aa, synthetic construct
  REGION 1..4: note = Synthetic Construct
SKQL

SEQ ID NO: 2743 - protein, 4 aa, synthetic construct
  REGION 1..4: note = Synthetic Construct
SKQN

SEQ ID NO: 2744 - protein, 4 aa, synthetic construct
  REGION 1..4: note = Synthetic Construct
SKQQ

SEQ ID NO: 2745 - protein, 4 aa, synthetic construct
  REGION 1..4: note = Synthetic Construct
SKQR

SEQ ID NO: 2746 - protein, 4 aa, synthetic construct
  REGION 1..4: note = Synthetic Construct
SKQS

SEQ ID NO: 2747 - protein, 4 aa, synthetic construct
  REGION 1..4: note = Synthetic Construct
SKQT

SEQ ID NO: 2748 - protein, 4 aa, synthetic construct
  REGION 1..4: note = Synthetic Construct
SKQY

SEQ ID NO: 2749 - protein, 4 aa, synthetic construct
  REGION 1..4: note = Synthetic Construct
SKRA

SEQ ID NO: 2750 - protein, 4 aa, synthetic construct
  REGION 1..4: note = Synthetic Construct
SKRD

SEQ ID NO: 2751 - protein, 4 aa, synthetic construct
  REGION 1..4: note = Synthetic Construct
SKRE

SEQ ID NO: 2752 - protein, 4 aa, synthetic construct
  REGION 1..4: note = Synthetic Construct
SKRF

SEQ ID NO: 2753 - protein, 4 aa, synthetic construct
  REGION 1..4: note = Synthetic Construct
SKRG

SEQ ID NO: 2754 - protein, 4 aa, synthetic construct
  REGION 1..4: note = Synthetic Construct
SKRH

SEQ ID NO: 2755 - protein, 4 aa, synthetic construct
  REGION 1..4: note = Synthetic Construct
SKRI

SEQ ID NO: 2756 - protein, 4 aa, synthetic construct
  REGION 1..4: note = Synthetic Construct
SKRL

SEQ ID NO: 2757 - protein, 4 aa, synthetic construct
  REGION 1..4: note = Synthetic Construct
SKRN

SEQ ID NO: 2758 - protein, 4 aa, synthetic construct
  REGION 1..4: note = Synthetic Construct
SKRQ

SEQ ID NO: 2759 - protein, 4 aa, synthetic construct
  REGION 1..4: note = Synthetic Construct
SKRR

SEQ ID NO: 2760 - protein, 4 aa, synthetic construct
  REGION 1..4: note = Synthetic Construct
SKRS

SEQ ID NO: 2761 - protein, 4 aa, synthetic construct
  REGION 1..4: note = Synthetic Construct
SKRT

SEQ ID NO: 2762 - protein, 4 aa, synthetic construct
  REGION 1..4: note = Synthetic Construct
SKRY

SEQ ID NO: 2763 - protein, 4 aa, synthetic construct
  REGION 1..4: note = Synthetic Construct
SKSA

SEQ ID NO: 2764 - protein, 4 aa, synthetic construct
  REGION 1..4: note = Synthetic Construct
SKSD

SEQ ID NO: 2765 - protein, 4 aa, synthetic construct
  REGION 1..4: note = Synthetic Construct
SKSE

SEQ ID NO: 2766 - protein, 4 aa, synthetic construct
  REGION 1..4: note = Synthetic Construct
SKSF

SEQ ID NO: 2767 - protein, 4 aa, synthetic construct
  REGION 1..4: note = Synthetic Construct
SKSG

SEQ ID NO: 2768 - protein, 4 aa, synthetic construct
  REGION 1..4: note = Synthetic Construct
SKSH

SEQ ID NO: 2769 - protein, 4 aa, synthetic construct
  REGION 1..4: note = Synthetic Construct
SKSI

SEQ ID NO: 2770 - protein, 4 aa, synthetic construct
  REGION 1..4: note = Synthetic Construct
SKSL

SEQ ID NO: 2771 - protein, 4 aa, synthetic construct
  REGION 1..4: note = Synthetic Construct
SKSN

SEQ ID NO: 2772 - protein, 4 aa, synthetic construct
  REGION 1..4: note = Synthetic Construct
SKSQ

SEQ ID NO: 2773 - protein, 4 aa, synthetic construct
  REGION 1..4: note = Synthetic Construct
SKSR

SEQ ID NO: 2774 - protein, 4 aa, synthetic construct
  REGION 1..4: note = Synthetic Construct
SKSS

SEQ ID NO: 2775 - protein, 4 aa, synthetic construct
  REGION 1..4: note = Synthetic Construct
SKST

SEQ ID NO: 2776 - protein, 4 aa, synthetic construct
  REGION 1..4: note = Synthetic Construct
SKSY

SEQ ID NO: 2777 - protein, 4 aa, synthetic construct
  REGION 1..4: note = Synthetic Construct
SKTA

SEQ ID NO: 2778 - protein, 4 aa, synthetic construct
  REGION 1..4: note = Synthetic Construct
SKTD

SEQ ID NO: 2779 - protein, 4 aa, synthetic construct
  REGION 1..4: note = Synthetic Construct
SKTE

SEQ ID NO: 2780 - protein, 4 aa, synthetic construct
  REGION 1..4: note = Synthetic Construct
SKTF

SEQ ID NO: 2781 - protein, 4 aa, synthetic construct
  REGION 1..4: note = Synthetic Construct
SKTG

SEQ ID NO: 2782 - protein, 4 aa, synthetic construct
  REGION 1..4: note = Synthetic Construct
SKTH

SEQ ID NO: 2783 - protein, 4 aa, synthetic construct
  REGION 1..4: note = Synthetic Construct
SKTI

SEQ ID NO: 2784 - protein, 4 aa, synthetic construct
  REGION 1..4: note = Synthetic Construct
SKTL

SEQ ID NO: 2785 - protein, 4 aa, synthetic construct
  REGION 1..4: note = Synthetic Construct
SKTN

SEQ ID NO: 2786 - protein, 4 aa, synthetic construct
  REGION 1..4: note = Synthetic Construct
SKTQ

SEQ ID NO: 2787 - protein, 4 aa, synthetic construct
  REGION 1..4: note = Synthetic Construct
SKTR

SEQ ID NO: 2788 - protein, 4 aa, synthetic construct
  REGION 1..4: note = Synthetic Construct
SKTS

SEQ ID NO: 2789 - protein, 4 aa, synthetic construct
  REGION 1..4: note = Synthetic Construct
SKTT

SEQ ID NO: 2790 - protein, 4 aa, synthetic construct
  REGION 1..4: note = Synthetic Construct
SKTY

SEQ ID NO: 2791 - protein, 4 aa, synthetic construct
  REGION 1..4: note = Synthetic Construct
SKYA

SEQ ID NO: 2792 - protein, 4 aa, synthetic construct
  REGION 1..4: note = Synthetic Construct
SKYD

SEQ ID NO: 2793 - protein, 4 aa, synthetic construct
  REGION 1..4: note = Synthetic Construct
SKYE

SEQ ID NO: 2794 - protein, 4 aa, synthetic construct
  REGION 1..4: note = Synthetic Construct
SKYF

SEQ ID NO: 2795 - protein, 4 aa, synthetic construct
  REGION 1..4: note = Synthetic Construct
SKYG

SEQ ID NO: 2796 - protein, 4 aa, synthetic construct
  REGION 1..4: note = Synthetic Construct
SKYH

SEQ ID NO: 2797 - protein, 4 aa, synthetic construct
  REGION 1..4: note = Synthetic Construct
SKYI

SEQ ID NO: 2798 - protein, 4 aa, synthetic construct
  REGION 1..4: note = Synthetic Construct
SKYL

SEQ ID NO: 2799 - protein, 4 aa, synthetic construct
  REGION 1..4: note = Synthetic Construct
SKYN

SEQ ID NO: 2800 - protein, 4 aa, synthetic construct
  REGION 1..4: note = Synthetic Construct
SKYQ

SEQ ID NO: 2801 - protein, 4 aa, synthetic construct
  REGION 1..4: note = Synthetic Construct
SKYR

SEQ ID NO: 2802 - protein, 4 aa, synthetic construct
  REGION 1..4: note = Synthetic Construct
SKYS

SEQ ID NO: 2803 - protein, 4 aa, synthetic construct
  REGION 1..4: note = Synthetic Construct
SKYT

SEQ ID NO: 2804 - protein, 4 aa, synthetic construct
  REGION 1..4: note = Synthetic Construct
SKYY

SEQ ID NO: 2805 - protein, 4 aa, synthetic construct
  REGION 1..4: note = Synthetic Construct
TKAA

SEQ ID NO: 2806 - protein, 4 aa, synthetic construct
  REGION 1..4: note = Synthetic Construct
TKAD

SEQ ID NO: 2807 - protein, 4 aa, synthetic construct
  REGION 1..4: note = Synthetic Construct
TKAE

SEQ ID NO: 2808 - protein, 4 aa, synthetic construct
  REGION 1..4: note = Synthetic Construct
TKAF

SEQ ID NO: 2809 - protein, 4 aa, synthetic construct
  REGION 1..4: note = Synthetic Construct
TKAG

SEQ ID NO: 2810 - protein, 4 aa, synthetic construct
  REGION 1..4: note = Synthetic Construct
TKAH

SEQ ID NO: 2811 - protein, 4 aa, synthetic construct
  REGION 1..4: note = Synthetic Construct
TKAI

SEQ ID NO: 2812 - protein, 4 aa, synthetic construct
  REGION 1..4: note = Synthetic Construct
TKAL

SEQ ID NO: 2813 - protein, 4 aa, synthetic construct
  REGION 1..4: note = Synthetic Construct
TKAN

SEQ ID NO: 2814 - protein, 4 aa, synthetic construct
  REGION 1..4: note = Synthetic Construct
TKAQ

SEQ ID NO: 2815 - protein, 4 aa, synthetic construct
  REGION 1..4: note = Synthetic Construct
TKAR

SEQ ID NO: 2816 - protein, 4 aa, synthetic construct
  REGION 1..4: note = Synthetic Construct
TKAS

SEQ ID NO: 2817 - protein, 4 aa, synthetic construct
  REGION 1..4: note = Synthetic Construct
TKAT

SEQ ID NO: 2818 - protein, 4 aa, synthetic construct
  REGION 1..4: note = Synthetic Construct
TKAY

SEQ ID NO: 2819 - protein, 4 aa, synthetic construct
  REGION 1..4: note = Synthetic Construct
TKDA

SEQ ID NO: 2820 - protein, 4 aa, synthetic construct
  REGION 1..4: note = Synthetic Construct
TKDD

SEQ ID NO: 2821 - protein, 4 aa, synthetic construct
  REGION 1..4: note = Synthetic Construct
TKDE

SEQ ID NO: 2822 - protein, 4 aa, synthetic construct
  REGION 1..4: note = Synthetic Construct
TKDF

SEQ ID NO: 2823 - protein, 4 aa, synthetic construct
  REGION 1..4: note = Synthetic Construct
TKDG

SEQ ID NO: 2824 - protein, 4 aa, synthetic construct
  REGION 1..4: note = Synthetic Construct
TKDH

SEQ ID NO: 2825 - protein, 4 aa, synthetic construct
  REGION 1..4: note = Synthetic Construct
TKDI

SEQ ID NO: 2826 - protein, 4 aa, synthetic construct
  REGION 1..4: note = Synthetic Construct
TKDL

SEQ ID NO: 2827 - protein, 4 aa, synthetic construct
  REGION 1..4: note = Synthetic Construct
TKDN

SEQ ID NO: 2828 - protein, 4 aa, synthetic construct
  REGION 1..4: note = Synthetic Construct
TKDQ

SEQ ID NO: 2829 - protein, 4 aa, synthetic construct
  REGION 1..4: note = Synthetic Construct
TKDR

SEQ ID NO: 2830 - protein, 4 aa, synthetic construct
  REGION 1..4: note = Synthetic Construct
TKDS

SEQ ID NO: 2831 - protein, 4 aa, synthetic construct
  REGION 1..4: note = Synthetic Construct
TKDT

SEQ ID NO: 2832 - protein, 4 aa, synthetic construct
  REGION 1..4: note = Synthetic Construct
TKDY

SEQ ID NO: 2833 - protein, 4 aa, synthetic construct
  REGION 1..4: note = Synthetic Construct
TKEA

SEQ ID NO: 2834 - protein, 4 aa, synthetic construct
  REGION 1..4: note = Synthetic Construct
TKED

SEQ ID NO: 2835 - protein, 4 aa, synthetic construct
  REGION 1..4: note = Synthetic Construct
TKEE

SEQ ID NO: 2836 - protein, 4 aa, synthetic construct
  REGION 1..4: note = Synthetic Construct
TKEF

SEQ ID NO: 2837 - protein, 4 aa, synthetic construct
  REGION 1..4: note = Synthetic Construct
TKEG

SEQ ID NO: 2838 - protein, 4 aa, synthetic construct
  REGION 1..4: note = Synthetic Construct
TKEH

SEQ ID NO: 2839 - protein, 4 aa, synthetic construct
  REGION 1..4: note = Synthetic Construct
TKEI

SEQ ID NO: 2840 - protein, 4 aa, synthetic construct
  REGION 1..4: note = Synthetic Construct
TKEL

SEQ ID NO: 2841 - protein, 4 aa, synthetic construct
  REGION 1..4: note = Synthetic Construct
TKEN

SEQ ID NO: 2842 - protein, 4 aa, synthetic construct
  REGION 1..4: note = Synthetic Construct
TKEQ

SEQ ID NO: 2843 - protein, 4 aa, synthetic construct
  REGION 1..4: note = Synthetic Construct
TKER

SEQ ID NO: 2844 - protein, 4 aa, synthetic construct
  REGION 1..4: note = Synthetic Construct
TKES

SEQ ID NO: 2845 - protein, 4 aa, synthetic construct
  REGION 1..4: note = Synthetic Construct
TKET

SEQ ID NO: 2846 - protein, 4 aa, synthetic construct
  REGION 1..4: note = Synthetic Construct
TKEY

SEQ ID NO: 2847 - protein, 4 aa, synthetic construct
  REGION 1..4: note = Synthetic Construct
TKFA

SEQ ID NO: 2848 - protein, 4 aa, synthetic construct
  REGION 1..4: note = Synthetic Construct
TKFD

SEQ ID NO: 2849 - protein, 4 aa, synthetic construct
  REGION 1..4: note = Synthetic Construct
TKFE

SEQ ID NO: 2850 - protein, 4 aa, synthetic construct
  REGION 1..4: note = Synthetic Construct
TKFF

SEQ ID NO: 2851 - protein, 4 aa, synthetic construct
  REGION 1..4: note = Synthetic Construct
TKFG

SEQ ID NO: 2852 - protein, 4 aa, synthetic construct
  REGION 1..4: note = Synthetic Construct
TKFH

SEQ ID NO: 2853 - protein, 4 aa, synthetic construct
  REGION 1..4: note = Synthetic Construct
TKFI

SEQ ID NO: 2854 - protein, 4 aa, synthetic construct
  REGION 1..4: note = Synthetic Construct
TKFL

SEQ ID NO: 2855 - protein, 4 aa, synthetic construct
  REGION 1..4: note = Synthetic Construct
TKFN

SEQ ID NO: 2856 - protein, 4 aa, synthetic construct
  REGION 1..4: note = Synthetic Construct
TKFQ

SEQ ID NO: 2857 - protein, 4 aa, synthetic construct
  REGION 1..4: note = Synthetic Construct
TKFR

SEQ ID NO: 2858 - protein, 4 aa, synthetic construct
  REGION 1..4: note = Synthetic Construct
TKFS

SEQ ID NO: 2859 - protein, 4 aa, synthetic construct
  REGION 1..4: note = Synthetic Construct
TKFT

SEQ ID NO: 2860 - protein, 4 aa, synthetic construct
  REGION 1..4: note = Synthetic Construct
TKFY

SEQ ID NO: 2861 - protein, 4 aa, synthetic construct
  REGION 1..4: note = Synthetic Construct
TKGA

SEQ ID NO: 2862 - protein, 4 aa, synthetic construct
  REGION 1..4: note = Synthetic Construct
TKGD

SEQ ID NO: 2863 - protein, 4 aa, synthetic construct
  REGION 1..4: note = Synthetic Construct
TKGE

SEQ ID NO: 2864 - protein, 4 aa, synthetic construct
  REGION 1..4: note = Synthetic Construct
TKGF

SEQ ID NO: 2865 - protein, 4 aa, synthetic construct
  REGION 1..4: note = Synthetic Construct
TKGG

SEQ ID NO: 2866 - protein, 4 aa, synthetic construct
  REGION 1..4: note = Synthetic Construct
TKGH

SEQ ID NO: 2867 - protein, 4 aa, synthetic construct
  REGION 1..4: note = Synthetic Construct
TKGI

SEQ ID NO: 2868 - protein, 4 aa, synthetic construct
  REGION 1..4: note = Synthetic Construct
TKGL

SEQ ID NO: 2869 - protein, 4 aa, synthetic construct
  REGION 1..4: note = Synthetic Construct
TKGN

SEQ ID NO: 2870 - protein, 4 aa, synthetic construct
  REGION 1..4: note = Synthetic Construct
TKGQ

SEQ ID NO: 2871 - protein, 4 aa, synthetic construct
  REGION 1..4: note = Synthetic Construct
TKGR

SEQ ID NO: 2872 - protein, 4 aa, synthetic construct
  REGION 1..4: note = Synthetic Construct
TKGS

SEQ ID NO: 2873 - protein, 4 aa, synthetic construct
  REGION 1..4: note = Synthetic Construct
TKGT

SEQ ID NO: 2874 - protein, 4 aa, synthetic construct
  REGION 1..4: note = Synthetic Construct
TKGY

SEQ ID NO: 2875 - protein, 4 aa, synthetic construct
  REGION 1..4: note = Synthetic Construct
TKHA

SEQ ID NO: 2876 - protein, 4 aa, synthetic construct
  REGION 1..4: note = Synthetic Construct
TKHD

SEQ ID NO: 2877 - protein, 4 aa, synthetic construct
  REGION 1..4: note = Synthetic Construct
TKHE

SEQ ID NO: 2878 - protein, 4 aa, synthetic construct
  REGION 1..4: note = Synthetic Construct
TKHF

SEQ ID NO: 2879 - protein, 4 aa, synthetic construct
  REGION 1..4: note = Synthetic Construct
TKHG

SEQ ID NO: 2880 - protein, 4 aa, synthetic construct
  REGION 1..4: note = Synthetic Construct
TKHH

SEQ ID NO: 2881 - protein, 4 aa, synthetic construct
  REGION 1..4: note = Synthetic Construct
TKHI

SEQ ID NO: 2882 - protein, 4 aa, synthetic construct
  REGION 1..4: note = Synthetic Construct
TKHL

SEQ ID NO: 2883 - protein, 4 aa, synthetic construct
  REGION 1..4: note = Synthetic Construct
TKHN

SEQ ID NO: 2884 - protein, 4 aa, synthetic construct
  REGION 1..4: note = Synthetic Construct
TKHQ

SEQ ID NO: 2885 - protein, 4 aa, synthetic construct
  REGION 1..4: note = Synthetic Construct
TKHR

SEQ ID NO: 2886 - protein, 4 aa, synthetic construct
  REGION 1..4: note = Synthetic Construct
TKHS

SEQ ID NO: 2887 - protein, 4 aa, synthetic construct
  REGION 1..4: note = Synthetic Construct
TKHT

SEQ ID NO: 2888 - protein, 4 aa, synthetic construct
  REGION 1..4: note = Synthetic Construct
TKHY

SEQ ID NO: 2889 - protein, 4 aa, synthetic construct
  REGION 1..4: note = Synthetic Construct
TKIA

SEQ ID NO: 2890 - protein, 4 aa, synthetic construct
  REGION 1..4: note = Synthetic Construct
TKID

SEQ ID NO: 2891 - protein, 4 aa, synthetic construct
  REGION 1..4: note = Synthetic Construct
TKIE

SEQ ID NO: 2892 - protein, 4 aa, synthetic construct
  REGION 1..4: note = Synthetic Construct
TKIF

SEQ ID NO: 2893 - protein, 4 aa, synthetic construct
  REGION 1..4: note = Synthetic Construct
TKIG

SEQ ID NO: 2894 - protein, 4 aa, synthetic construct
  REGION 1..4: note = Synthetic Construct
TKIH

SEQ ID NO: 2895 - protein, 4 aa, synthetic construct
  REGION 1..4: note = Synthetic Construct
TKII

SEQ ID NO: 2896 - protein, 4 aa, synthetic construct
  REGION 1..4: note = Synthetic Construct
TKIL

SEQ ID NO: 2897 - protein, 4 aa, synthetic construct
  REGION 1..4: note = Synthetic Construct
TKIN

SEQ ID NO: 2898 - protein, 4 aa, synthetic construct
  REGION 1..4: note = Synthetic Construct
TKIQ

SEQ ID NO: 2899 - protein, 4 aa, synthetic construct
  REGION 1..4: note = Synthetic Construct
TKIR

SEQ ID NO: 2900 - protein, 4 aa, synthetic construct
  REGION 1..4: note = Synthetic Construct
TKIS

SEQ ID NO: 2901 - protein, 4 aa, synthetic construct
  REGION 1..4: note = Synthetic Construct
TKIT

SEQ ID NO: 2902 - protein, 4 aa, synthetic construct
  REGION 1..4: note = Synthetic Construct
TKIY

SEQ ID NO: 2903 - protein, 4 aa, synthetic construct
  REGION 1..4: note = Synthetic Construct
TKLA

SEQ ID NO: 2904 - protein, 4 aa, synthetic construct
  REGION 1..4: note = Synthetic Construct
TKLD

SEQ ID NO: 2905 - protein, 4 aa, synthetic construct
  REGION 1..4: note = Synthetic Construct
TKLE

SEQ ID NO: 2906 - protein, 4 aa, synthetic construct
  REGION 1..4: note = Synthetic Construct
TKLF

SEQ ID NO: 2907 - protein, 4 aa, synthetic construct
  REGION 1..4: note = Synthetic Construct
TKLG

SEQ ID NO: 2908 - protein, 4 aa, synthetic construct
  REGION 1..4: note = Synthetic Construct
TKLH

SEQ ID NO: 2909 - protein, 4 aa, synthetic construct
  REGION 1..4: note = Synthetic Construct
TKLI

SEQ ID NO: 2910 - protein, 4 aa, synthetic construct
  REGION 1..4: note = Synthetic Construct
TKLL

SEQ ID NO: 2911 - protein, 4 aa, synthetic construct
  REGION 1..4: note = Synthetic Construct
TKLN

SEQ ID NO: 2912 - protein, 4 aa, synthetic construct
  REGION 1..4: note = Synthetic Construct
TKLQ

SEQ ID NO: 2913 - protein, 4 aa, synthetic construct
  REGION 1..4: note = Synthetic Construct
TKLR

SEQ ID NO: 2914 - protein, 4 aa, synthetic construct
  REGION 1..4: note = Synthetic Construct
TKLS

SEQ ID NO: 2915 - protein, 4 aa, synthetic construct
  REGION 1..4: note = Synthetic Construct
TKLT

SEQ ID NO: 2916 - protein, 4 aa, synthetic construct
  REGION 1..4: note = Synthetic Construct
TKLY

SEQ ID NO: 2917 - protein, 4 aa, synthetic construct
  REGION 1..4: note = Synthetic Construct
TKNA

SEQ ID NO: 2918 - protein, 4 aa, synthetic construct
  REGION 1..4: note = Synthetic Construct
TKND

SEQ ID NO: 2919 - protein, 4 aa, synthetic construct
  REGION 1..4: note = Synthetic Construct
TKNE

SEQ ID NO: 2920 - protein, 4 aa, synthetic construct
  REGION 1..4: note = Synthetic Construct
TKNF

SEQ ID NO: 2921 - protein, 4 aa, synthetic construct
  REGION 1..4: note = Synthetic Construct
TKNG

SEQ ID NO: 2922 - protein, 4 aa, synthetic construct
  REGION 1..4: note = Synthetic Construct
TKNH

SEQ ID NO: 2923 - protein, 4 aa, synthetic construct
  REGION 1..4: note = Synthetic Construct
TKNI

SEQ ID NO: 2924 - protein, 4 aa, synthetic construct
  REGION 1..4: note = Synthetic Construct
TKNL

SEQ ID NO: 2925 - protein, 4 aa, synthetic construct
  REGION 1..4: note = Synthetic Construct
TKNN

SEQ ID NO: 2926 - protein, 4 aa, synthetic construct
  REGION 1..4: note = Synthetic Construct
TKNQ

SEQ ID NO: 2927 - protein, 4 aa, synthetic construct
  REGION 1..4: note = Synthetic Construct
TKNR

SEQ ID NO: 2928 - protein, 4 aa, synthetic construct
  REGION 1..4: note = Synthetic Construct
TKNS

SEQ ID NO: 2929 - protein, 4 aa, synthetic construct
  REGION 1..4: note = Synthetic Construct
TKNT

SEQ ID NO: 2930 - protein, 4 aa, synthetic construct
  REGION 1..4: note = Synthetic Construct
TKNY

SEQ ID NO: 2931 - protein, 4 aa, synthetic construct
  REGION 1..4: note = Synthetic Construct
TKPA

SEQ ID NO: 2932 - protein, 4 aa, synthetic construct
  REGION 1..4: note = Synthetic Construct
TKPD

SEQ ID NO: 2933 - protein, 4 aa, synthetic construct
  REGION 1..4: note = Synthetic Construct
TKPE

SEQ ID NO: 2934 - protein, 4 aa, synthetic construct
  REGION 1..4: note = Synthetic Construct
TKPF

SEQ ID NO: 2935 - protein, 4 aa, synthetic construct
  REGION 1..4: note = Synthetic Construct
TKPG

SEQ ID NO: 2936 - protein, 4 aa, synthetic construct
  REGION 1..4: note = Synthetic Construct
TKPH

SEQ ID NO: 2937 - protein, 4 aa, synthetic construct
  REGION 1..4: note = Synthetic Construct
TKPI

SEQ ID NO: 2938 - protein, 4 aa, synthetic construct
  REGION 1..4: note = Synthetic Construct
TKPL

SEQ ID NO: 2939 - protein, 4 aa, synthetic construct
  REGION 1..4: note = Synthetic Construct
TKPN

SEQ ID NO: 2940 - protein, 4 aa, synthetic construct
  REGION 1..4: note = Synthetic Construct
TKPQ

SEQ ID NO: 2941 - protein, 4 aa, synthetic construct
  REGION 1..4: note = Synthetic Construct
TKPR

SEQ ID NO: 2942 - protein, 4 aa, synthetic construct
  REGION 1..4: note = Synthetic Construct
TKPS

SEQ ID NO: 2943 - protein, 4 aa, synthetic construct
  REGION 1..4: note = Synthetic Construct
TKPT

SEQ ID NO: 2944 - protein, 4 aa, synthetic construct
  REGION 1..4: note = Synthetic Construct
TKPY

SEQ ID NO: 2945 - protein, 4 aa, synthetic construct
  REGION 1..4: note = Synthetic Construct
TKQA

SEQ ID NO: 2946 - protein, 4 aa, synthetic construct
  REGION 1..4: note = Synthetic Construct
TKQD

SEQ ID NO: 2947 - protein, 4 aa, synthetic construct
  REGION 1..4: note = Synthetic Construct
TKQE

SEQ ID NO: 2948 - protein, 4 aa, synthetic construct
  REGION 1..4: note = Synthetic Construct
TKQF

SEQ ID NO: 2949 - protein, 4 aa, synthetic construct
  REGION 1..4: note = Synthetic Construct
TKQG

SEQ ID NO: 2950 - protein, 4 aa, synthetic construct
  REGION 1..4: note = Synthetic Construct
TKQH

SEQ ID NO: 2951 - protein, 4 aa, synthetic construct
  REGION 1..4: note = Synthetic Construct
TKQI

SEQ ID NO: 2952 - protein, 4 aa, synthetic construct
  REGION 1..4: note = Synthetic Construct
TKQL

SEQ ID NO: 2953 - protein, 4 aa, synthetic construct
  REGION 1..4: note = Synthetic Construct
TKQN

SEQ ID NO: 2954 - protein, 4 aa, synthetic construct
  REGION 1..4: note = Synthetic Construct
TKQQ

SEQ ID NO: 2955 - protein, 4 aa, synthetic construct
  REGION 1..4: note = Synthetic Construct
TKQR

SEQ ID NO: 2956 - protein, 4 aa, synthetic construct
  REGION 1..4: note = Synthetic Construct
TKQS

SEQ ID NO: 2957 - protein, 4 aa, synthetic construct
  REGION 1..4: note = Synthetic Construct
TKQT

SEQ ID NO: 2958 - protein, 4 aa, synthetic construct
  REGION 1..4: note = Synthetic Construct
TKQY

SEQ ID NO: 2959 - protein, 4 aa, synthetic construct
  REGION 1..4: note = Synthetic Construct
TKRA

SEQ ID NO: 2960 - protein, 4 aa, synthetic construct
  REGION 1..4: note = Synthetic Construct
TKRD

SEQ ID NO: 2961 - protein, 4 aa, synthetic construct
  REGION 1..4: note = Synthetic Construct
TKRE

SEQ ID NO: 2962 - protein, 4 aa, synthetic construct
  REGION 1..4: note = Synthetic Construct
TKRF

SEQ ID NO: 2963 - protein, 4 aa, synthetic construct
  REGION 1..4: note = Synthetic Construct
TKRG

SEQ ID NO: 2964 - protein, 4 aa, synthetic construct
  REGION 1..4: note = Synthetic Construct
TKRH

SEQ ID NO: 2965 - protein, 4 aa, synthetic construct
  REGION 1..4: note = Synthetic Construct
TKRI

SEQ ID NO: 2966 - protein, 4 aa, synthetic construct
  REGION 1..4: note = Synthetic Construct
TKRL

SEQ ID NO: 2967 - protein, 4 aa, synthetic construct
  REGION 1..4: note = Synthetic Construct
TKRN

SEQ ID NO: 2968 - protein, 4 aa, synthetic construct
  REGION 1..4: note = Synthetic Construct
TKRQ

SEQ ID NO: 2969 - protein, 4 aa, synthetic construct
  REGION 1..4: note = Synthetic Construct
TKRR

SEQ ID NO: 2970 - protein, 4 aa, synthetic construct
  REGION 1..4: note = Synthetic Construct
TKRS

SEQ ID NO: 2971 - protein, 4 aa, synthetic construct
  REGION 1..4: note = Synthetic Construct
TKRT

SEQ ID NO: 2972 - protein, 4 aa, synthetic construct
  REGION 1..4: note = Synthetic Construct
TKRY

SEQ ID NO: 2973 - protein, 4 aa, synthetic construct
  REGION 1..4: note = Synthetic Construct
TKSA

SEQ ID NO: 2974 - protein, 4 aa, synthetic construct
  REGION 1..4: note = Synthetic Construct
TKSD

SEQ ID NO: 2975 - protein, 4 aa, synthetic construct
  REGION 1..4: note = Synthetic Construct
TKSE

SEQ ID NO: 2976 - protein, 4 aa, synthetic construct
  REGION 1..4: note = Synthetic Construct
TKSF

SEQ ID NO: 2977 - protein, 4 aa, synthetic construct
  REGION 1..4: note = Synthetic Construct
TKSG

SEQ ID NO: 2978 - protein, 4 aa, synthetic construct
  REGION 1..4: note = Synthetic Construct
TKSH

SEQ ID NO: 2979 - protein, 4 aa, synthetic construct
  REGION 1..4: note = Synthetic Construct
TKSI

SEQ ID NO: 2980 - protein, 4 aa, synthetic construct
  REGION 1..4: note = Synthetic Construct
TKSL

SEQ ID NO: 2981 - protein, 4 aa, synthetic construct
  REGION 1..4: note = Synthetic Construct
TKSN

SEQ ID NO: 2982 - protein, 4 aa, synthetic construct
  REGION 1..4: note = Synthetic Construct
TKSQ

SEQ ID NO: 2983 - protein, 4 aa, synthetic construct
  REGION 1..4: note = Synthetic Construct
TKSR

SEQ ID NO: 2984 - protein, 4 aa, synthetic construct
  REGION 1..4: note = Synthetic Construct
TKSS

SEQ ID NO: 2985 - protein, 4 aa, synthetic construct
  REGION 1..4: note = Synthetic Construct
TKST

SEQ ID NO: 2986 - protein, 4 aa, synthetic construct
  REGION 1..4: note = Synthetic Construct
TKSY

SEQ ID NO: 2987 - protein, 4 aa, synthetic construct
  REGION 1..4: note = Synthetic Construct
TKTA

SEQ ID NO: 2988 - protein, 4 aa, synthetic construct
  REGION 1..4: note = Synthetic Construct
TKTD

SEQ ID NO: 2989 - protein, 4 aa, synthetic construct
  REGION 1..4: note = Synthetic Construct
TKTE

SEQ ID NO: 2990 - protein, 4 aa, synthetic construct
  REGION 1..4: note = Synthetic Construct
TKTF

SEQ ID NO: 2991 - protein, 4 aa, synthetic construct
  REGION 1..4: note = Synthetic Construct
TKTG

SEQ ID NO: 2992 - protein, 4 aa, synthetic construct
  REGION 1..4: note = Synthetic Construct
TKTH

SEQ ID NO: 2993 - protein, 4 aa, synthetic construct
  REGION 1..4: note = Synthetic Construct
TKTI

SEQ ID NO: 2994 - protein, 4 aa, synthetic construct
  REGION 1..4: note = Synthetic Construct
TKTL

SEQ ID NO: 2995 - protein, 4 aa, synthetic construct
  REGION 1..4: note = Synthetic Construct
TKTN

SEQ ID NO: 2996 - protein, 4 aa, synthetic construct
  REGION 1..4: note = Synthetic Construct
TKTQ

SEQ ID NO: 2997 - protein, 4 aa, synthetic construct
  REGION 1..4: note = Synthetic Construct
TKTR

SEQ ID NO: 2998 - protein, 4 aa, synthetic construct
  REGION 1..4: note = Synthetic Construct
TKTS

SEQ ID NO: 2999 - protein, 4 aa, synthetic construct
  REGION 1..4: note = Synthetic Construct
TKTT

SEQ ID NO: 3000 - protein, 4 aa, synthetic construct
  REGION 1..4: note = Synthetic Construct
TKTY

SEQ ID NO: 3001 - protein, 4 aa, synthetic construct
  REGION 1..4: note = Synthetic Construct
TKYA

SEQ ID NO: 3002 - protein, 4 aa, synthetic construct
  REGION 1..4: note = Synthetic Construct
TKYD

SEQ ID NO: 3003 - protein, 4 aa, synthetic construct
  REGION 1..4: note = Synthetic Construct
TKYE

SEQ ID NO: 3004 - protein, 4 aa, synthetic construct
  REGION 1..4: note = Synthetic Construct
TKYF

SEQ ID NO: 3005 - protein, 4 aa, synthetic construct
  REGION 1..4: note = Synthetic Construct
TKYG

SEQ ID NO: 3006 - protein, 4 aa, synthetic construct
  REGION 1..4: note = Synthetic Construct
TKYH

SEQ ID NO: 3007 - protein, 4 aa, synthetic construct
  REGION 1..4: note = Synthetic Construct
TKYI

SEQ ID NO: 3008 - protein, 4 aa, synthetic construct
  REGION 1..4: note = Synthetic Construct
TKYL

SEQ ID NO: 3009 - protein, 4 aa, synthetic construct
  REGION 1..4: note = Synthetic Construct
TKYN

SEQ ID NO: 3010 - protein, 4 aa, synthetic construct
  REGION 1..4: note = Synthetic Construct
TKYQ

SEQ ID NO: 3011 - protein, 4 aa, synthetic construct
  REGION 1..4: note = Synthetic Construct
TKYR

SEQ ID NO: 3012 - protein, 4 aa, synthetic construct
  REGION 1..4: note = Synthetic Construct
TKYS

SEQ ID NO: 3013 - protein, 4 aa, synthetic construct
  REGION 1..4: note = Synthetic Construct
TKYT

SEQ ID NO: 3014 - protein, 4 aa, synthetic construct
  REGION 1..4: note = Synthetic Construct
TKYY

SEQ ID NO: 3015 - protein, 4 aa, synthetic construct
  REGION 1..4: note = Synthetic Construct
YKAA

SEQ ID NO: 3016 - protein, 4 aa, synthetic construct
  REGION 1..4: note = Synthetic Construct
YKAD

SEQ ID NO: 3017 - protein, 4 aa, synthetic construct
  REGION 1..4: note = Synthetic Construct
YKAE

SEQ ID NO: 3018 - protein, 4 aa, synthetic construct
  REGION 1..4: note = Synthetic Construct
YKAF

SEQ ID NO: 3019 - protein, 4 aa, synthetic construct
  REGION 1..4: note = Synthetic Construct
YKAG

SEQ ID NO: 3020 - protein, 4 aa, synthetic construct
  REGION 1..4: note = Synthetic Construct
YKAH

SEQ ID NO: 3021 - protein, 4 aa, synthetic construct
  REGION 1..4: note = Synthetic Construct
YKAI

SEQ ID NO: 3022 - protein, 4 aa, synthetic construct
  REGION 1..4: note = Synthetic Construct
YKAL

SEQ ID NO: 3023 - protein, 4 aa, synthetic construct
  REGION 1..4: note = Synthetic Construct
YKAN

SEQ ID NO: 3024 - protein, 4 aa, synthetic construct
  REGION 1..4: note = Synthetic Construct
YKAQ

SEQ ID NO: 3025 - protein, 4 aa, synthetic construct
  REGION 1..4: note = Synthetic Construct
YKAR

SEQ ID NO: 3026 - protein, 4 aa, synthetic construct
  REGION 1..4: note = Synthetic Construct
YKAS

SEQ ID NO: 3027 - protein, 4 aa, synthetic construct
  REGION 1..4: note = Synthetic Construct
YKAT

SEQ ID NO: 3028 - protein, 4 aa, synthetic construct
  REGION 1..4: note = Synthetic Construct
YKAY

SEQ ID NO: 3029 - protein, 4 aa, synthetic construct
  REGION 1..4: note = Synthetic Construct
YKDA

SEQ ID NO: 3030 - protein, 4 aa, synthetic construct
  REGION 1..4: note = Synthetic Construct
YKDD

SEQ ID NO: 3031 - protein, 4 aa, synthetic construct
  REGION 1..4: note = Synthetic Construct
YKDE

SEQ ID NO: 3032 - protein, 4 aa, synthetic construct
  REGION 1..4: note = Synthetic Construct
YKDF

SEQ ID NO: 3033 - protein, 4 aa, synthetic construct
  REGION 1..4: note = Synthetic Construct
YKDG

SEQ ID NO: 3034 - protein, 4 aa, synthetic construct
  REGION 1..4: note = Synthetic Construct
YKDH

SEQ ID NO: 3035 - protein, 4 aa, synthetic construct
  REGION 1..4: note = Synthetic Construct
YKDI

SEQ ID NO: 3036 - protein, 4 aa, synthetic construct
  REGION 1..4: note = Synthetic Construct
YKDL

SEQ ID NO: 3037 - protein, 4 aa, synthetic construct
  REGION 1..4: note = Synthetic Construct
YKDN

SEQ ID NO: 3038 - protein, 4 aa, synthetic construct
  REGION 1..4: note = Synthetic Construct
YKDQ

SEQ ID NO: 3039 - protein, 4 aa, synthetic construct
  REGION 1..4: note = Synthetic Construct
YKDR

SEQ ID NO: 3040 - protein, 4 aa, synthetic construct
  REGION 1..4: note = Synthetic Construct
YKDS

SEQ ID NO: 3041 - protein, 4 aa, synthetic construct
  REGION 1..4: note = Synthetic Construct
YKDT

SEQ ID NO: 3042 - protein, 4 aa, synthetic construct
  REGION 1..4: note = Synthetic Construct
YKDY

SEQ ID NO: 3043 - protein, 4 aa, synthetic construct
  REGION 1..4: note = Synthetic Construct
YKEA

SEQ ID NO: 3044 - protein, 4 aa, synthetic construct
  REGION 1..4: note = Synthetic Construct
YKED

SEQ ID NO: 3045 - protein, 4 aa, synthetic construct
  REGION 1..4: note = Synthetic Construct
YKEE

SEQ ID NO: 3046 - protein, 4 aa, synthetic construct
  REGION 1..4: note = Synthetic Construct
YKEF

SEQ ID NO: 3047 - protein, 4 aa, synthetic construct
  REGION 1..4: note = Synthetic Construct
YKEG

SEQ ID NO: 3048 - protein, 4 aa, synthetic construct
  REGION 1..4: note = Synthetic Construct
YKEH

SEQ ID NO: 3049 - protein, 4 aa, synthetic construct
  REGION 1..4: note = Synthetic Construct
YKEI

SEQ ID NO: 3050 - protein, 4 aa, synthetic construct
  REGION 1..4: note = Synthetic Construct
YKEL

SEQ ID NO: 3051 - protein, 4 aa, synthetic construct
  REGION 1..4: note = Synthetic Construct
YKEN

SEQ ID NO: 3052 - protein, 4 aa, synthetic construct
  REGION 1..4: note = Synthetic Construct
YKEQ

SEQ ID NO: 3053 - protein, 4 aa, synthetic construct
  REGION 1..4: note = Synthetic Construct
YKER

SEQ ID NO: 3054 - protein, 4 aa, synthetic construct
  REGION 1..4: note = Synthetic Construct
YKES

SEQ ID NO: 3055 - protein, 4 aa, synthetic construct
  REGION 1..4: note = Synthetic Construct
YKET

SEQ ID NO: 3056 - protein, 4 aa, synthetic construct
  REGION 1..4: note = Synthetic Construct
YKEY

SEQ ID NO: 3057 - protein, 4 aa, synthetic construct
  REGION 1..4: note = Synthetic Construct
YKFA

SEQ ID NO: 3058 - protein, 4 aa, synthetic construct
  REGION 1..4: note = Synthetic Construct
YKFD

SEQ ID NO: 3059 - protein, 4 aa, synthetic construct
  REGION 1..4: note = Synthetic Construct
YKFE

SEQ ID NO: 3060 - protein, 4 aa, synthetic construct
  REGION 1..4: note = Synthetic Construct
YKFF

SEQ ID NO: 3061 - protein, 4 aa, synthetic construct
  REGION 1..4: note = Synthetic Construct
YKFG

SEQ ID NO: 3062 - protein, 4 aa, synthetic construct
  REGION 1..4: note = Synthetic Construct
YKFH

SEQ ID NO: 3063 - protein, 4 aa, synthetic construct
  REGION 1..4: note = Synthetic Construct
YKFI

SEQ ID NO: 3064 - protein, 4 aa, synthetic construct
  REGION 1..4: note = Synthetic Construct
YKFL

SEQ ID NO: 3065 - protein, 4 aa, synthetic construct
  REGION 1..4: note = Synthetic Construct
YKFN

SEQ ID NO: 3066 - protein, 4 aa, synthetic construct
  REGION 1..4: note = Synthetic Construct
YKFQ

SEQ ID NO: 3067 - protein, 4 aa, synthetic construct
  REGION 1..4: note = Synthetic Construct
YKFR

SEQ ID NO: 3068 - protein, 4 aa, synthetic construct
  REGION 1..4: note = Synthetic Construct
YKFS

SEQ ID NO: 3069 - protein, 4 aa, synthetic construct
  REGION 1..4: note = Synthetic Construct
YKFT

SEQ ID NO: 3070 - protein, 4 aa, synthetic construct
  REGION 1..4: note = Synthetic Construct
YKFY

SEQ ID NO: 3071 - protein, 4 aa, synthetic construct
  REGION 1..4: note = Synthetic Construct
YKGA

SEQ ID NO: 3072 - protein, 4 aa, synthetic construct
  REGION 1..4: note = Synthetic Construct
YKGD

SEQ ID NO: 3073 - protein, 4 aa, synthetic construct
  REGION 1..4: note = Synthetic Construct
YKGE

SEQ ID NO: 3074 - protein, 4 aa, synthetic construct
  REGION 1..4: note = Synthetic Construct
YKGF

SEQ ID NO: 3075 - protein, 4 aa, synthetic construct
  REGION 1..4: note = Synthetic Construct
YKGG

SEQ ID NO: 3076 - protein, 4 aa, synthetic construct
  REGION 1..4: note = Synthetic Construct
YKGH

SEQ ID NO: 3077 - protein, 4 aa, synthetic construct
  REGION 1..4: note = Synthetic Construct
YKGI

SEQ ID NO: 3078 - protein, 4 aa, synthetic construct
  REGION 1..4: note = Synthetic Construct
YKGL

SEQ ID NO: 3079 - protein, 4 aa, synthetic construct
  REGION 1..4: note = Synthetic Construct
YKGN

SEQ ID NO: 3080 - protein, 4 aa, synthetic construct
  REGION 1..4: note = Synthetic Construct
YKGQ

SEQ ID NO: 3081 - protein, 4 aa, synthetic construct
  REGION 1..4: note = Synthetic Construct
YKGR

SEQ ID NO: 3082 - protein, 4 aa, synthetic construct
  REGION 1..4: note = Synthetic Construct
YKGS

SEQ ID NO: 3083 - protein, 4 aa, synthetic construct
  REGION 1..4: note = Synthetic Construct
YKGT

SEQ ID NO: 3084 - protein, 4 aa, synthetic construct
  REGION 1..4: note = Synthetic Construct
YKGY

SEQ ID NO: 3085 - protein, 4 aa, synthetic construct
  REGION 1..4: note = Synthetic Construct
YKHA

SEQ ID NO: 3086 - protein, 4 aa, synthetic construct
  REGION 1..4: note = Synthetic Construct
YKHD

SEQ ID NO: 3087 - protein, 4 aa, synthetic construct
  REGION 1..4: note = Synthetic Construct
YKHE

SEQ ID NO: 3088 - protein, 4 aa, synthetic construct
  REGION 1..4: note = Synthetic Construct
YKHF

SEQ ID NO: 3089 - protein, 4 aa, synthetic construct
  REGION 1..4: note = Synthetic Construct
YKHG

SEQ ID NO: 3090 - protein, 4 aa, synthetic construct
  REGION 1..4: note = Synthetic Construct
YKHH

SEQ ID NO: 3091 - protein, 4 aa, synthetic construct
  REGION 1..4: note = Synthetic Construct
YKHI

SEQ ID NO: 3092 - protein, 4 aa, synthetic construct
  REGION 1..4: note = Synthetic Construct
YKHL

SEQ ID NO: 3093 - protein, 4 aa, synthetic construct
  REGION 1..4: note = Synthetic Construct
YKHN

SEQ ID NO: 3094 - protein, 4 aa, synthetic construct
  REGION 1..4: note = Synthetic Construct
YKHQ

SEQ ID NO: 3095 - protein, 4 aa, synthetic construct
  REGION 1..4: note = Synthetic Construct
YKHR

SEQ ID NO: 3096 - protein, 4 aa, synthetic construct
  REGION 1..4: note = Synthetic Construct
YKHS

SEQ ID NO: 3097 - protein, 4 aa, synthetic construct
  REGION 1..4: note = Synthetic Construct
YKHT

SEQ ID NO: 3098 - protein, 4 aa, synthetic construct
  REGION 1..4: note = Synthetic Construct
YKHY

SEQ ID NO: 3099 - protein, 4 aa, synthetic construct
  REGION 1..4: note = Synthetic Construct
YKIA

SEQ ID NO: 3100 - protein, 4 aa, synthetic construct
  REGION 1..4: note = Synthetic Construct
YKID

SEQ ID NO: 3101 - protein, 4 aa, synthetic construct
  REGION 1..4: note = Synthetic Construct
YKIE

SEQ ID NO: 3102 - protein, 4 aa, synthetic construct
  REGION 1..4: note = Synthetic Construct
YKIF

SEQ ID NO: 3103 - protein, 4 aa, synthetic construct
  REGION 1..4: note = Synthetic Construct
YKIG

SEQ ID NO: 3104 - protein, 4 aa, synthetic construct
  REGION 1..4: note = Synthetic Construct
YKIH

SEQ ID NO: 3105 - protein, 4 aa, synthetic construct
  REGION 1..4: note = Synthetic Construct
YKII

SEQ ID NO: 3106 - protein, 4 aa, synthetic construct
  REGION 1..4: note = Synthetic Construct
YKIL

SEQ ID NO: 3107 - protein, 4 aa, synthetic construct
  REGION 1..4: note = Synthetic Construct
YKIN

SEQ ID NO: 3108 - protein, 4 aa, synthetic construct
  REGION 1..4: note = Synthetic Construct
YKIQ

SEQ ID NO: 3109 - protein, 4 aa, synthetic construct
  REGION 1..4: note = Synthetic Construct
YKIR

SEQ ID NO: 3110 - protein, 4 aa, synthetic construct
  REGION 1..4: note = Synthetic Construct
YKIS

SEQ ID NO: 3111 - protein, 4 aa, synthetic construct
  REGION 1..4: note = Synthetic Construct
YKIT

SEQ ID NO: 3112 - protein, 4 aa, synthetic construct
  REGION 1..4: note = Synthetic Construct
YKIY

SEQ ID NO: 3113 - protein, 4 aa, synthetic construct
  REGION 1..4: note = Synthetic Construct
YKLA

SEQ ID NO: 3114 - protein, 4 aa, synthetic construct
  REGION 1..4: note = Synthetic Construct
YKLD

SEQ ID NO: 3115 - protein, 4 aa, synthetic construct
  REGION 1..4: note = Synthetic Construct
YKLE

SEQ ID NO: 3116 - protein, 4 aa, synthetic construct
  REGION 1..4: note = Synthetic Construct
YKLF

SEQ ID NO: 3117 - protein, 4 aa, synthetic construct
  REGION 1..4: note = Synthetic Construct
YKLG

SEQ ID NO: 3118 - protein, 4 aa, synthetic construct
  REGION 1..4: note = Synthetic Construct
YKLH

SEQ ID NO: 3119 - protein, 4 aa, synthetic construct
  REGION 1..4: note = Synthetic Construct
YKLI

SEQ ID NO: 3120 - protein, 4 aa, synthetic construct
  REGION 1..4: note = Synthetic Construct
YKLL

SEQ ID NO: 3121 - protein, 4 aa, synthetic construct
  REGION 1..4: note = Synthetic Construct
YKLN

SEQ ID NO: 3122 - protein, 4 aa, synthetic construct
  REGION 1..4: note = Synthetic Construct
YKLQ

SEQ ID NO: 3123 - protein, 4 aa, synthetic construct
  REGION 1..4: note = Synthetic Construct
YKLR

SEQ ID NO: 3124 - protein, 4 aa, synthetic construct
  REGION 1..4: note = Synthetic Construct
YKLS

SEQ ID NO: 3125 - protein, 4 aa, synthetic construct
  REGION 1..4: note = Synthetic Construct
YKLT

SEQ ID NO: 3126 - protein, 4 aa, synthetic construct
  REGION 1..4: note = Synthetic Construct
YKLY

SEQ ID NO: 3127 - protein, 4 aa, synthetic construct
  REGION 1..4: note = Synthetic Construct
YKNA

SEQ ID NO: 3128 - protein, 4 aa, synthetic construct
  REGION 1..4: note = Synthetic Construct
YKND

SEQ ID NO: 3129 - protein, 4 aa, synthetic construct
  REGION 1..4: note = Synthetic Construct
YKNE

SEQ ID NO: 3130 - protein, 4 aa, synthetic construct
  REGION 1..4: note = Synthetic Construct
YKNF

SEQ ID NO: 3131 - protein, 4 aa, synthetic construct
  REGION 1..4: note = Synthetic Construct
YKNG

SEQ ID NO: 3132 - protein, 4 aa, synthetic construct
  REGION 1..4: note = Synthetic Construct
YKNH

SEQ ID NO: 3133 - protein, 4 aa, synthetic construct
  REGION 1..4: note = Synthetic Construct
YKNI

SEQ ID NO: 3134 - protein, 4 aa, synthetic construct
  REGION 1..4: note = Synthetic Construct
YKNL

SEQ ID NO: 3135 - protein, 4 aa, synthetic construct
  REGION 1..4: note = Synthetic Construct
YKNN

SEQ ID NO: 3136 - protein, 4 aa, synthetic construct
  REGION 1..4: note = Synthetic Construct
YKNQ

SEQ ID NO: 3137 - protein, 4 aa, synthetic construct
  REGION 1..4: note = Synthetic Construct
YKNR

SEQ ID NO: 3138 - protein, 4 aa, synthetic construct
  REGION 1..4: note = Synthetic Construct
YKNS

SEQ ID NO: 3139 - protein, 4 aa, synthetic construct
  REGION 1..4: note = Synthetic Construct
YKNT

SEQ ID NO: 3140 - protein, 4 aa, synthetic construct
  REGION 1..4: note = Synthetic Construct
YKNY

SEQ ID NO: 3141 - protein, 4 aa, synthetic construct
  REGION 1..4: note = Synthetic Construct
YKPA

SEQ ID NO: 3142 - protein, 4 aa, synthetic construct
  REGION 1..4: note = Synthetic Construct
YKPD

SEQ ID NO: 3143 - protein, 4 aa, synthetic construct
  REGION 1..4: note = Synthetic Construct
YKPE

SEQ ID NO: 3144 - protein, 4 aa, synthetic construct
  REGION 1..4: note = Synthetic Construct
YKPF

SEQ ID NO: 3145 - protein, 4 aa, synthetic construct
  REGION 1..4: note = Synthetic Construct
YKPG

SEQ ID NO: 3146 - protein, 4 aa, synthetic construct
  REGION 1..4: note = Synthetic Construct
YKPH

SEQ ID NO: 3147 - protein, 4 aa, synthetic construct
  REGION 1..4: note = Synthetic Construct
YKPI

SEQ ID NO: 3148 - protein, 4 aa, synthetic construct
  REGION 1..4: note = Synthetic Construct
YKPL

SEQ ID NO: 3149 - protein, 4 aa, synthetic construct
  REGION 1..4: note = Synthetic Construct
YKPN

SEQ ID NO: 3150 - protein, 4 aa, synthetic construct
  REGION 1..4: note = Synthetic Construct
YKPQ

SEQ ID NO: 3151 - protein, 4 aa, synthetic construct
  REGION 1..4: note = Synthetic Construct
YKPR

SEQ ID NO: 3152 - protein, 4 aa, synthetic construct
  REGION 1..4: note = Synthetic Construct
YKPS

SEQ ID NO: 3153 - protein, 4 aa, synthetic construct
  REGION 1..4: note = Synthetic Construct
YKPT

SEQ ID NO: 3154 - protein, 4 aa, synthetic construct
  REGION 1..4: note = Synthetic Construct
YKPY

SEQ ID NO: 3155 - protein, 4 aa, synthetic construct
  REGION 1..4: note = Synthetic Construct
YKQA

SEQ ID NO: 3156 - protein, 4 aa, synthetic construct
  REGION 1..4: note = Synthetic Construct
YKQD

SEQ ID NO: 3157 - protein, 4 aa, synthetic construct
  REGION 1..4: note = Synthetic Construct
YKQE

SEQ ID NO: 3158 - protein, 4 aa, synthetic construct
  REGION 1..4: note = Synthetic Construct
YKQF

SEQ ID NO: 3159 - protein, 4 aa, synthetic construct
  REGION 1..4: note = Synthetic Construct
YKQG

SEQ ID NO: 3160 - protein, 4 aa, synthetic construct
  REGION 1..4: note = Synthetic Construct
YKQH

SEQ ID NO: 3161 - protein, 4 aa, synthetic construct
  REGION 1..4: note = Synthetic Construct
YKQI

SEQ ID NO: 3162 - protein, 4 aa, synthetic construct
  REGION 1..4: note = Synthetic Construct
YKQL

SEQ ID NO: 3163 - protein, 4 aa, synthetic construct
  REGION 1..4: note = Synthetic Construct
YKQN

SEQ ID NO: 3164 - protein, 4 aa, synthetic construct
  REGION 1..4: note = Synthetic Construct
YKQQ

SEQ ID NO: 3165 - protein, 4 aa, synthetic construct
  REGION 1..4: note = Synthetic Construct
YKQR

SEQ ID NO: 3166 - protein, 4 aa, synthetic construct
  REGION 1..4: note = Synthetic Construct
YKQS

SEQ ID NO: 3167 - protein, 4 aa, synthetic construct
  REGION 1..4: note = Synthetic Construct
YKQT

SEQ ID NO: 3168 - protein, 4 aa, synthetic construct
  REGION 1..4: note = Synthetic Construct
YKQY

SEQ ID NO: 3169 - protein, 4 aa, synthetic construct
  REGION 1..4: note = Synthetic Construct
YKRA

SEQ ID NO: 3170 - protein, 4 aa, synthetic construct
  REGION 1..4: note = Synthetic Construct
YKRD

SEQ ID NO: 3171 - protein, 4 aa, synthetic construct
  REGION 1..4: note = Synthetic Construct
YKRE

SEQ ID NO: 3172 - protein, 4 aa, synthetic construct
  REGION 1..4: note = Synthetic Construct
YKRF

SEQ ID NO: 3173 - protein, 4 aa, synthetic construct
  REGION 1..4: note = Synthetic Construct
YKRG

SEQ ID NO: 3174 - protein, 4 aa, synthetic construct
  REGION 1..4: note = Synthetic Construct
YKRH

SEQ ID NO: 3175 - protein, 4 aa, synthetic construct
  REGION 1..4: note = Synthetic Construct
YKRI

SEQ ID NO: 3176 - protein, 4 aa, synthetic construct
  REGION 1..4: note = Synthetic Construct
YKRL

SEQ ID NO: 3177 - protein, 4 aa, synthetic construct
  REGION 1..4: note = Synthetic Construct
YKRN

SEQ ID NO: 3178 - protein, 4 aa, synthetic construct
  REGION 1..4: note = Synthetic Construct
YKRQ

SEQ ID NO: 3179 - protein, 4 aa, synthetic construct
  REGION 1..4: note = Synthetic Construct
YKRR

SEQ ID NO: 3180 - protein, 4 aa, synthetic construct
  REGION 1..4: note = Synthetic Construct
YKRS

SEQ ID NO: 3181 - protein, 4 aa, synthetic construct
  REGION 1..4: note = Synthetic Construct
YKRT

SEQ ID NO: 3182 - protein, 4 aa, synthetic construct
  REGION 1..4: note = Synthetic Construct
YKRY

SEQ ID NO: 3183 - protein, 4 aa, synthetic construct
  REGION 1..4: note = Synthetic Construct
YKSA

SEQ ID NO: 3184 - protein, 4 aa, synthetic construct
  REGION 1..4: note = Synthetic Construct
YKSD

SEQ ID NO: 3185 - protein, 4 aa, synthetic construct
  REGION 1..4: note = Synthetic Construct
YKSE

SEQ ID NO: 3186 - protein, 4 aa, synthetic construct
  REGION 1..4: note = Synthetic Construct
YKSF

SEQ ID NO: 3187 - protein, 4 aa, synthetic construct
  REGION 1..4: note = Synthetic Construct
YKSG

SEQ ID NO: 3188 - protein, 4 aa, synthetic construct
  REGION 1..4: note = Synthetic Construct
YKSH

SEQ ID NO: 3189 - protein, 4 aa, synthetic construct
  REGION 1..4: note = Synthetic Construct
YKSI

SEQ ID NO: 3190 - protein, 4 aa, synthetic construct
  REGION 1..4: note = Synthetic Construct
YKSL

SEQ ID NO: 3191 - protein, 4 aa, synthetic construct
  REGION 1..4: note = Synthetic Construct
YKSN

SEQ ID NO: 3192 - protein, 4 aa, synthetic construct
  REGION 1..4: note = Synthetic Construct
YKSQ

SEQ ID NO: 3193 - protein, 4 aa, synthetic construct
  REGION 1..4: note = Synthetic Construct
YKSR

SEQ ID NO: 3194 - protein, 4 aa, synthetic construct
  REGION 1..4: note = Synthetic Construct
YKSS

SEQ ID NO: 3195 - protein, 4 aa, synthetic construct
  REGION 1..4: note = Synthetic Construct
YKST

SEQ ID NO: 3196 - protein, 4 aa, synthetic construct
  REGION 1..4: note = Synthetic Construct
YKSY

SEQ ID NO: 3197 - protein, 4 aa, synthetic construct
  REGION 1..4: note = Synthetic Construct
YKTA

SEQ ID NO: 3198 - protein, 4 aa, synthetic construct
  REGION 1..4: note = Synthetic Construct
YKTD

SEQ ID NO: 3199 - protein, 4 aa, synthetic construct
  REGION 1..4: note = Synthetic Construct
YKTE

SEQ ID NO: 3200 - protein, 4 aa, synthetic construct
  REGION 1..4: note = Synthetic Construct
YKTF

SEQ ID NO: 3201 - protein, 4 aa, synthetic construct
  REGION 1..4: note = Synthetic Construct
YKTG

SEQ ID NO: 3202 - protein, 4 aa, synthetic construct
  REGION 1..4: note = Synthetic Construct
YKTH

SEQ ID NO: 3203 - protein, 4 aa, synthetic construct
  REGION 1..4: note = Synthetic Construct
YKTI

SEQ ID NO: 3204 - protein, 4 aa, synthetic construct
  REGION 1..4: note = Synthetic Construct
YKTL

SEQ ID NO: 3205 - protein, 4 aa, synthetic construct
  REGION 1..4: note = Synthetic Construct
YKTN

SEQ ID NO: 3206 - protein, 4 aa, synthetic construct
  REGION 1..4: note = Synthetic Construct
YKTQ

SEQ ID NO: 3207 - protein, 4 aa, synthetic construct
  REGION 1..4: note = Synthetic Construct
YKTR

SEQ ID NO: 3208 - protein, 4 aa, synthetic construct
  REGION 1..4: note = Synthetic Construct
YKTS

SEQ ID NO: 3209 - protein, 4 aa, synthetic construct
  REGION 1..4: note = Synthetic Construct
YKTT

SEQ ID NO: 3210 - protein, 4 aa, synthetic construct
  REGION 1..4: note = Synthetic Construct
YKTY

SEQ ID NO: 3211 - protein, 4 aa, synthetic construct
  REGION 1..4: note = Synthetic Construct
YKYA

SEQ ID NO: 3212 - protein, 4 aa, synthetic construct
  REGION 1..4: note = Synthetic Construct
YKYD

SEQ ID NO: 3213 - protein, 4 aa, synthetic construct
  REGION 1..4: note = Synthetic Construct
YKYE

SEQ ID NO: 3214 - protein, 4 aa, synthetic construct
  REGION 1..4: note = Synthetic Construct
YKYF

SEQ ID NO: 3215 - protein, 4 aa, synthetic construct
  REGION 1..4: note = Synthetic Construct
YKYG

SEQ ID NO: 3216 - protein, 4 aa, synthetic construct
  REGION 1..4: note = Synthetic Construct
YKYH

SEQ ID NO: 3217 - protein, 4 aa, synthetic construct
  REGION 1..4: note = Synthetic Construct
YKYI

SEQ ID NO: 3218 - protein, 4 aa, synthetic construct
  REGION 1..4: note = Synthetic Construct
YKYL

SEQ ID NO: 3219 - protein, 4 aa, synthetic construct
  REGION 1..4: note = Synthetic Construct
YKYN

SEQ ID NO: 3220 - protein, 4 aa, synthetic construct
  REGION 1..4: note = Synthetic Construct
YKYQ

SEQ ID NO: 3221 - protein, 4 aa, synthetic construct
  REGION 1..4: note = Synthetic Construct
YKYR

SEQ ID NO: 3222 - protein, 4 aa, synthetic construct
  REGION 1..4: note = Synthetic Construct
YKYS

SEQ ID NO: 3223 - protein, 4 aa, synthetic construct
  REGION 1..4: note = Synthetic Construct
YKYT

SEQ ID NO: 3224 - protein, 4 aa, synthetic construct
  REGION 1..4: note = Synthetic Construct
YKYY

SEQ ID NO: 3225 - protein, 5 aa, synthetic construct
  REGION 1..5: note = Synthetic Construct
KAAAK

SEQ ID NO: 3226 - protein, 5 aa, synthetic construct
  REGION 1..5: note = Synthetic Construct
KAADK

SEQ ID NO: 3227 - protein, 5 aa, synthetic construct
  REGION 1..5: note = Synthetic Construct
KAAEK

SEQ ID NO: 3228 - protein, 5 aa, synthetic construct
  REGION 1..5: note = Synthetic Construct
KAAFK

SEQ ID NO: 3229 - protein, 5 aa, synthetic construct
  REGION 1..5: note = Synthetic Construct
KAAGK

SEQ ID NO: 3230 - protein, 5 aa, synthetic construct
  REGION 1..5: note = Synthetic Construct
KAAHK

SEQ ID NO: 3231 - protein, 5 aa, synthetic construct
  REGION 1..5: note = Synthetic Construct
KAAIK

SEQ ID NO: 3232 - protein, 5 aa, synthetic construct
  REGION 1..5: note = Synthetic Construct
KAALK

SEQ ID NO: 3233 - protein, 5 aa, synthetic construct
  REGION 1..5: note = Synthetic Construct
KAANK

SEQ ID NO: 3234 - protein, 5 aa, synthetic construct
  REGION 1..5: note = Synthetic Construct
KAAQK

SEQ ID NO: 3235 - protein, 5 aa, synthetic construct
  REGION 1..5: note = Synthetic Construct
KAARK

SEQ ID NO: 3236 - protein, 5 aa, synthetic construct
  REGION 1..5: note = Synthetic Construct
KAASK

SEQ ID NO: 3237 - protein, 5 aa, synthetic construct
  REGION 1..5: note = Synthetic Construct
KAATK

SEQ ID NO: 3238 - protein, 5 aa, synthetic construct
  REGION 1..5: note = Synthetic Construct
KAAYK

SEQ ID NO: 3239 - protein, 5 aa, synthetic construct
  REGION 1..5: note = Synthetic Construct
KADAK

SEQ ID NO: 3240 - protein, 5 aa, synthetic construct
  REGION 1..5: note = Synthetic Construct
KADDK

SEQ ID NO: 3241 - protein, 5 aa, synthetic construct
  REGION 1..5: note = Synthetic Construct
KADEK

SEQ ID NO: 3242 - protein, 5 aa, synthetic construct
  REGION 1..5: note = Synthetic Construct
KADFK

SEQ ID NO: 3243 - protein, 5 aa, synthetic construct
  REGION 1..5: note = Synthetic Construct
KADGK

SEQ ID NO: 3244 - protein, 5 aa, synthetic construct
  REGION 1..5: note = Synthetic Construct
KADHK

SEQ ID NO: 3245 - protein, 5 aa, synthetic construct
  REGION 1..5: note = Synthetic Construct
KADIK

SEQ ID NO: 3246 - protein, 5 aa, synthetic construct
  REGION 1..5: note = Synthetic Construct
KADLK

SEQ ID NO: 3247 - protein, 5 aa, synthetic construct
  REGION 1..5: note = Synthetic Construct
KADNK

SEQ ID NO: 3248 - protein, 5 aa, synthetic construct
  REGION 1..5: note = Synthetic Construct
KADQK

SEQ ID NO: 3249 - protein, 5 aa, synthetic construct
  REGION 1..5: note = Synthetic Construct
KADRK

SEQ ID NO: 3250 - protein, 5 aa, synthetic construct
  REGION 1..5: note = Synthetic Construct
KADSK

SEQ ID NO: 3251 - protein, 5 aa, synthetic construct
  REGION 1..5: note = Synthetic Construct
KADTK

SEQ ID NO: 3252 - protein, 5 aa, synthetic construct
  REGION 1..5: note = Synthetic Construct
KADYK

SEQ ID NO: 3253 - protein, 5 aa, synthetic construct
  REGION 1..5: note = Synthetic Construct
KAEAK

SEQ ID NO: 3254 - protein, 5 aa, synthetic construct
  REGION 1..5: note = Synthetic Construct
KAEDK

SEQ ID NO: 3255 - protein, 5 aa, synthetic construct
  REGION 1..5: note = Synthetic Construct
KAEEK

SEQ ID NO: 3256 - protein, 5 aa, synthetic construct
  REGION 1..5: note = Synthetic Construct
KAEFK

SEQ ID NO: 3257 - protein, 5 aa, synthetic construct
  REGION 1..5: note = Synthetic Construct
KAEGK

SEQ ID NO: 3258 - protein, 5 aa, synthetic construct
  REGION 1..5: note = Synthetic Construct
KAEHK

SEQ ID NO: 3259 - protein, 5 aa, synthetic construct
  REGION 1..5: note = Synthetic Construct
KAEIK

SEQ ID NO: 3260 - protein, 5 aa, synthetic construct
  REGION 1..5: note = Synthetic Construct
KAELK

SEQ ID NO: 3261 - protein, 5 aa, synthetic construct
  REGION 1..5: note = Synthetic Construct
KAENK

SEQ ID NO: 3262 - protein, 5 aa, synthetic construct
  REGION 1..5: note = Synthetic Construct
KAEQK

SEQ ID NO: 3263 - protein, 5 aa, synthetic construct
  REGION 1..5: note = Synthetic Construct
KAERK

SEQ ID NO: 3264 - protein, 5 aa, synthetic construct
  REGION 1..5: note = Synthetic Construct
KAESK

SEQ ID NO: 3265 - protein, 5 aa, synthetic construct
  REGION 1..5: note = Synthetic Construct
KAETK

SEQ ID NO: 3266 - protein, 5 aa, synthetic construct
  REGION 1..5: note = Synthetic Construct
KAEYK

SEQ ID NO: 3267 - protein, 5 aa, synthetic construct
  REGION 1..5: note = Synthetic Construct
KAFAK

SEQ ID NO: 3268 - protein, 5 aa, synthetic construct
  REGION 1..5: note = Synthetic Construct
KAFDK

SEQ ID NO: 3269 - protein, 5 aa, synthetic construct
  REGION 1..5: note = Synthetic Construct
KAFEK

SEQ ID NO: 3270 - protein, 5 aa, synthetic construct
  REGION 1..5: note = Synthetic Construct
KAFFK

SEQ ID NO: 3271 - protein, 5 aa, synthetic construct
  REGION 1..5: note = Synthetic Construct
KAFGK

SEQ ID NO: 3272 - protein, 5 aa, synthetic construct
  REGION 1..5: note = Synthetic Construct
KAFHK

SEQ ID NO: 3273 - protein, 5 aa, synthetic construct
  REGION 1..5: note = Synthetic Construct
KAFIK

SEQ ID NO: 3274 - protein, 5 aa, synthetic construct
  REGION 1..5: note = Synthetic Construct
KAFLK

SEQ ID NO: 3275 - protein, 5 aa, synthetic construct
  REGION 1..5: note = Synthetic Construct
KAFNK

SEQ ID NO: 3276 - protein, 5 aa, synthetic construct
  REGION 1..5: note = Synthetic Construct
KAFQK

SEQ ID NO: 3277 - protein, 5 aa, synthetic construct
  REGION 1..5: note = Synthetic Construct
KAFRK

SEQ ID NO: 3278 - protein, 5 aa, synthetic construct
  REGION 1..5: note = Synthetic Construct
KAFSK

SEQ ID NO: 3279 - protein, 5 aa, synthetic construct
  REGION 1..5: note = Synthetic Construct
KAFTK

SEQ ID NO: 3280 - protein, 5 aa, synthetic construct
  REGION 1..5: note = Synthetic Construct
KAFYK

SEQ ID NO: 3281 - protein, 5 aa, synthetic construct
  REGION 1..5: note = Synthetic Construct
KAGAK

SEQ ID NO: 3282 - protein, 5 aa, synthetic construct
  REGION 1..5: note = Synthetic Construct
KAGDK

SEQ ID NO: 3283 - protein, 5 aa, synthetic construct
  REGION 1..5: note = Synthetic Construct
KAGEK

SEQ ID NO: 3284 - protein, 5 aa, synthetic construct
  REGION 1..5: note = Synthetic Construct
KAGFK

SEQ ID NO: 3285 - protein, 5 aa, synthetic construct
  REGION 1..5: note = Synthetic Construct
KAGGK

SEQ ID NO: 3286 - protein, 5 aa, synthetic construct
  REGION 1..5: note = Synthetic Construct
KAGHK

SEQ ID NO: 3287 - protein, 5 aa, synthetic construct
  REGION 1..5: note = Synthetic Construct
KAGIK

SEQ ID NO: 3288 - protein, 5 aa, synthetic construct
  REGION 1..5: note = Synthetic Construct
KAGLK

SEQ ID NO: 3289 - protein, 5 aa, synthetic construct
  REGION 1..5: note = Synthetic Construct
KAGNK

SEQ ID NO: 3290 - protein, 5 aa, synthetic construct
  REGION 1..5: note = Synthetic Construct
KAGQK

SEQ ID NO: 3291 - protein, 5 aa, synthetic construct
  REGION 1..5: note = Synthetic Construct
KAGRK

SEQ ID NO: 3292 - protein, 5 aa, synthetic construct
  REGION 1..5: note = Synthetic Construct
KAGSK

SEQ ID NO: 3293 - protein, 5 aa, synthetic construct
  REGION 1..5: note = Synthetic Construct
KAGTK

SEQ ID NO: 3294 - protein, 5 aa, synthetic construct
  REGION 1..5: note = Synthetic Construct
KAGYK

SEQ ID NO: 3295 - protein, 5 aa, synthetic construct
  REGION 1..5: note = Synthetic Construct
KAHAK

SEQ ID NO: 3296 - protein, 5 aa, synthetic construct
  REGION 1..5: note = Synthetic Construct
KAHDK

SEQ ID NO: 3297 - protein, 5 aa, synthetic construct
  REGION 1..5: note = Synthetic Construct
KAHEK

SEQ ID NO: 3298 - protein, 5 aa, synthetic construct
  REGION 1..5: note = Synthetic Construct
KAHFK

SEQ ID NO: 3299 - protein, 5 aa, synthetic construct
  REGION 1..5: note = Synthetic Construct
KAHGK

SEQ ID NO: 3300 - protein, 5 aa, synthetic construct
  REGION 1..5: note = Synthetic Construct
KAHHK

SEQ ID NO: 3301 - protein, 5 aa, synthetic construct
  REGION 1..5: note = Synthetic Construct
KAHIK

SEQ ID NO: 3302 - protein, 5 aa, synthetic construct
  REGION 1..5: note = Synthetic Construct
KAHLK

SEQ ID NO: 3303 - protein, 5 aa, synthetic construct
  REGION 1..5: note = Synthetic Construct
KAHNK

SEQ ID NO: 3304 - protein, 5 aa, synthetic construct
  REGION 1..5: note = Synthetic Construct
KAHQK

SEQ ID NO: 3305 - protein, 5 aa, synthetic construct
  REGION 1..5: note = Synthetic Construct
KAHRK

SEQ ID NO: 3306 - protein, 5 aa, synthetic construct
  REGION 1..5: note = Synthetic Construct
KAHSK

SEQ ID NO: 3307 - protein, 5 aa, synthetic construct
  REGION 1..5: note = Synthetic Construct
KAHTK

SEQ ID NO: 3308 - protein, 5 aa, synthetic construct
  REGION 1..5: note = Synthetic Construct
KAHYK

SEQ ID NO: 3309 - protein, 5 aa, synthetic construct
  REGION 1..5: note = Synthetic Construct
KAIAK

SEQ ID NO: 3310 - protein, 5 aa, synthetic construct
  REGION 1..5: note = Synthetic Construct
KAIDK

SEQ ID NO: 3311 - protein, 5 aa, synthetic construct
  REGION 1..5: note = Synthetic Construct
KAIEK

SEQ ID NO: 3312 - protein, 5 aa, synthetic construct
  REGION 1..5: note = Synthetic Construct
KAIFK

SEQ ID NO: 3313 - protein, 5 aa, synthetic construct
  REGION 1..5: note = Synthetic Construct
KAIGK

SEQ ID NO: 3314 - protein, 5 aa, synthetic construct
  REGION 1..5: note = Synthetic Construct
KAIHK

SEQ ID NO: 3315 - protein, 5 aa, synthetic construct
  REGION 1..5: note = Synthetic Construct
KAIIK

SEQ ID NO: 3316 - protein, 5 aa, synthetic construct
  REGION 1..5: note = Synthetic Construct
KAILK

SEQ ID NO: 3317 - protein, 5 aa, synthetic construct
  REGION 1..5: note = Synthetic Construct
KAINK

SEQ ID NO: 3318 - protein, 5 aa, synthetic construct
  REGION 1..5: note = Synthetic Construct
KAIQK

SEQ ID NO: 3319 - protein, 5 aa, synthetic construct
  REGION 1..5: note = Synthetic Construct
KAIRK

SEQ ID NO: 3320 - protein, 5 aa, synthetic construct
  REGION 1..5: note = Synthetic Construct
KAISK

SEQ ID NO: 3321 - protein, 5 aa, synthetic construct
  REGION 1..5: note = Synthetic Construct
KAITK

SEQ ID NO: 3322 - protein, 5 aa, synthetic construct
  REGION 1..5: note = Synthetic Construct
KAIYK

SEQ ID NO: 3323 - protein, 5 aa, synthetic construct
  REGION 1..5: note = Synthetic Construct
KALAK

SEQ ID NO: 3324 - protein, 5 aa, synthetic construct
  REGION 1..5: note = Synthetic Construct
KALDK

SEQ ID NO: 3325 - protein, 5 aa, synthetic construct
  REGION 1..5: note = Synthetic Construct
KALEK

SEQ ID NO: 3326 - protein, 5 aa, synthetic construct
  REGION 1..5: note = Synthetic Construct
KALFK

SEQ ID NO: 3327 - protein, 5 aa, synthetic construct
  REGION 1..5: note = Synthetic Construct
KALGK

SEQ ID NO: 3328 - protein, 5 aa, synthetic construct
  REGION 1..5: note = Synthetic Construct
KALHK

SEQ ID NO: 3329 - protein, 5 aa, synthetic construct
  REGION 1..5: note = Synthetic Construct
KALIK

SEQ ID NO: 3330 - protein, 5 aa, synthetic construct
  REGION 1..5: note = Synthetic Construct
KALLK

SEQ ID NO: 3331 - protein, 5 aa, synthetic construct
  REGION 1..5: note = Synthetic Construct
KALNK

SEQ ID NO: 3332 - protein, 5 aa, synthetic construct
  REGION 1..5: note = Synthetic Construct
KALQK

SEQ ID NO: 3333 - protein, 5 aa, synthetic construct
  REGION 1..5: note = Synthetic Construct
KALRK

SEQ ID NO: 3334 - protein, 5 aa, synthetic construct
  REGION 1..5: note = Synthetic Construct
KALSK

SEQ ID NO: 3335 - protein, 5 aa, synthetic construct
  REGION 1..5: note = Synthetic Construct
KALTK

SEQ ID NO: 3336 - protein, 5 aa, synthetic construct
  REGION 1..5: note = Synthetic Construct
KALYK

SEQ ID NO: 3337 - protein, 5 aa, synthetic construct
  REGION 1..5: note = Synthetic Construct
KANAK

SEQ ID NO: 3338 - protein, 5 aa, synthetic construct
  REGION 1..5: note = Synthetic Construct
KANDK

SEQ ID NO: 3339 - protein, 5 aa, synthetic construct
  REGION 1..5: note = Synthetic Construct
KANEK

SEQ ID NO: 3340 - protein, 5 aa, synthetic construct
  REGION 1..5: note = Synthetic Construct
KANFK

SEQ ID NO: 3341 - protein, 5 aa, synthetic construct
  REGION 1..5: note = Synthetic Construct
KANGK

SEQ ID NO: 3342 - protein, 5 aa, synthetic construct
  REGION 1..5: note = Synthetic Construct
KANHK

SEQ ID NO: 3343 - protein, 5 aa, synthetic construct
  REGION 1..5: note = Synthetic Construct
KANIK

SEQ ID NO: 3344 - protein, 5 aa, synthetic construct
  REGION 1..5: note = Synthetic Construct
KANLK

SEQ ID NO: 3345 - protein, 5 aa, synthetic construct
  REGION 1..5: note = Synthetic Construct
KANNK

SEQ ID NO: 3346 - protein, 5 aa, synthetic construct
  REGION 1..5: note = Synthetic Construct
KANQK

SEQ ID NO: 3347 - protein, 5 aa, synthetic construct
  REGION 1..5: note = Synthetic Construct
KANRK

SEQ ID NO: 3348 - protein, 5 aa, synthetic construct
  REGION 1..5: note = Synthetic Construct
KANSK

SEQ ID NO: 3349 - protein, 5 aa, synthetic construct
  REGION 1..5: note = Synthetic Construct
KANTK

SEQ ID NO: 3350 - protein, 5 aa, synthetic construct
  REGION 1..5: note = Synthetic Construct
KANYK

SEQ ID NO: 3351 - protein, 5 aa, synthetic construct
  REGION 1..5: note = Synthetic Construct
KAPAK

SEQ ID NO: 3352 - protein, 5 aa, synthetic construct
  REGION 1..5: note = Synthetic Construct
KAPDK

SEQ ID NO: 3353 - protein, 5 aa, synthetic construct
  REGION 1..5: note = Synthetic Construct
KAPEK

SEQ ID NO: 3354 - protein, 5 aa, synthetic construct
  REGION 1..5: note = Synthetic Construct
KAPFK

SEQ ID NO: 3355 - protein, 5 aa, synthetic construct
  REGION 1..5: note = Synthetic Construct
KAPGK

SEQ ID NO: 3356 - protein, 5 aa, synthetic construct
  REGION 1..5: note = Synthetic Construct
KAPHK

SEQ ID NO: 3357 - protein, 5 aa, synthetic construct
  REGION 1..5: note = Synthetic Construct
KAPIK

SEQ ID NO: 3358 - protein, 5 aa, synthetic construct
  REGION 1..5: note = Synthetic Construct
KAPLK

SEQ ID NO: 3359 - protein, 5 aa, synthetic construct
  REGION 1..5: note = Synthetic Construct
KAPNK

SEQ ID NO: 3360 - protein, 5 aa, synthetic construct
  REGION 1..5: note = Synthetic Construct
KAPQK

SEQ ID NO: 3361 - protein, 5 aa, synthetic construct
  REGION 1..5: note = Synthetic Construct
KAPRK

SEQ ID NO: 3362 - protein, 5 aa, synthetic construct
  REGION 1..5: note = Synthetic Construct
KAPSK

SEQ ID NO: 3363 - protein, 5 aa, synthetic construct
  REGION 1..5: note = Synthetic Construct
KAPTK

SEQ ID NO: 3364 - protein, 5 aa, synthetic construct
  REGION 1..5: note = Synthetic Construct
KAPYK

SEQ ID NO: 3365 - protein, 5 aa, synthetic construct
  REGION 1..5: note = Synthetic Construct
KAQAK

SEQ ID NO: 3366 - protein, 5 aa, synthetic construct
  REGION 1..5: note = Synthetic Construct
KAQDK

SEQ ID NO: 3367 - protein, 5 aa, synthetic construct
  REGION 1..5: note = Synthetic Construct
KAQEK

SEQ ID NO: 3368 - protein, 5 aa, synthetic construct
  REGION 1..5: note = Synthetic Construct
KAQFK

SEQ ID NO: 3369 - protein, 5 aa, synthetic construct
  REGION 1..5: note = Synthetic Construct
KAQGK

SEQ ID NO: 3370 - protein, 5 aa, synthetic construct
  REGION 1..5: note = Synthetic Construct
KAQHK

SEQ ID NO: 3371 - protein, 5 aa, synthetic construct
  REGION 1..5: note = Synthetic Construct
KAQIK

SEQ ID NO: 3372 - protein, 5 aa, synthetic construct
  REGION 1..5: note = Synthetic Construct
KAQLK

SEQ ID NO: 3373 - protein, 5 aa, synthetic construct
  REGION 1..5: note = Synthetic Construct
KAQNK

SEQ ID NO: 3374 - protein, 5 aa, synthetic construct
  REGION 1..5: note = Synthetic Construct
KAQQK

SEQ ID NO: 3375 - protein, 5 aa, synthetic construct
  REGION 1..5: note = Synthetic Construct
KAQRK

SEQ ID NO: 3376 - protein, 5 aa, synthetic construct
  REGION 1..5: note = Synthetic Construct
KAQSK

SEQ ID NO: 3377 - protein, 5 aa, synthetic construct
  REGION 1..5: note = Synthetic Construct
KAQTK

SEQ ID NO: 3378 - protein, 5 aa, synthetic construct
  REGION 1..5: note = Synthetic Construct
KAQYK

SEQ ID NO: 3379 - protein, 5 aa, synthetic construct
  REGION 1..5: note = Synthetic Construct
KARAK

SEQ ID NO: 3380 - protein, 5 aa, synthetic construct
  REGION 1..5: note = Synthetic Construct
KARDK

SEQ ID NO: 3381 - protein, 5 aa, synthetic construct
  REGION 1..5: note = Synthetic Construct
KAREK

SEQ ID NO: 3382 - protein, 5 aa, synthetic construct
  REGION 1..5: note = Synthetic Construct
KARFK

SEQ ID NO: 3383 - protein, 5 aa, synthetic construct
  REGION 1..5: note = Synthetic Construct
KARGK

SEQ ID NO: 3384 - protein, 5 aa, synthetic construct
  REGION 1..5: note = Synthetic Construct
KARHK

SEQ ID NO: 3385 - protein, 5 aa, synthetic construct
  REGION 1..5: note = Synthetic Construct
KARIK

SEQ ID NO: 3386 - protein, 5 aa, synthetic construct
  REGION 1..5: note = Synthetic Construct
KARLK

SEQ ID NO: 3387 - protein, 5 aa, synthetic construct
  REGION 1..5: note = Synthetic Construct
KARNK

SEQ ID NO: 3388 - protein, 5 aa, synthetic construct
  REGION 1..5: note = Synthetic Construct
KARQK

SEQ ID NO: 3389 - protein, 5 aa, synthetic construct
  REGION 1..5: note = Synthetic Construct
KARRK

SEQ ID NO: 3390 - protein, 5 aa, synthetic construct
  REGION 1..5: note = Synthetic Construct
KARSK

SEQ ID NO: 3391 - protein, 5 aa, synthetic construct
  REGION 1..5: note = Synthetic Construct
KARTK

SEQ ID NO: 3392 - protein, 5 aa, synthetic construct
  REGION 1..5: note = Synthetic Construct
KARYK

SEQ ID NO: 3393 - protein, 5 aa, synthetic construct
  REGION 1..5: note = Synthetic Construct
KASAK

SEQ ID NO: 3394 - protein, 5 aa, synthetic construct
  REGION 1..5: note = Synthetic Construct
KASDK

SEQ ID NO: 3395 - protein, 5 aa, synthetic construct
  REGION 1..5: note = Synthetic Construct
KASEK

SEQ ID NO: 3396 - protein, 5 aa, synthetic construct
  REGION 1..5: note = Synthetic Construct
KASFK

SEQ ID NO: 3397 - protein, 5 aa, synthetic construct
  REGION 1..5: note = Synthetic Construct
KASGK

SEQ ID NO: 3398 - protein, 5 aa, synthetic construct
  REGION 1..5: note = Synthetic Construct
KASHK

SEQ ID NO: 3399 - protein, 5 aa, synthetic construct
  REGION 1..5: note = Synthetic Construct
KASIK

SEQ ID NO: 3400 - protein, 5 aa, synthetic construct
  REGION 1..5: note = Synthetic Construct
KASLK

SEQ ID NO: 3401 - protein, 5 aa, synthetic construct
  REGION 1..5: note = Synthetic Construct
KASNK

SEQ ID NO: 3402 - protein, 5 aa, synthetic construct
  REGION 1..5: note = Synthetic Construct
KASQK

SEQ ID NO: 3403 - protein, 5 aa, synthetic construct
  REGION 1..5: note = Synthetic Construct
KASRK

SEQ ID NO: 3404 - protein, 5 aa, synthetic construct
  REGION 1..5: note = Synthetic Construct
KASSK

SEQ ID NO: 3405 - protein, 5 aa, synthetic construct
  REGION 1..5: note = Synthetic Construct
KASTK

SEQ ID NO: 3406 - protein, 5 aa, synthetic construct
  REGION 1..5: note = Synthetic Construct
KASYK

SEQ ID NO: 3407 - protein, 5 aa, synthetic construct
  REGION 1..5: note = Synthetic Construct
KATAK

SEQ ID NO: 3408 - protein, 5 aa, synthetic construct
  REGION 1..5: note = Synthetic Construct
KATDK

SEQ ID NO: 3409 - protein, 5 aa, synthetic construct
  REGION 1..5: note = Synthetic Construct
KATEK

SEQ ID NO: 3410 - protein, 5 aa, synthetic construct
  REGION 1..5: note = Synthetic Construct
KATFK

SEQ ID NO: 3411 - protein, 5 aa, synthetic construct
  REGION 1..5: note = Synthetic Construct
KATGK

SEQ ID NO: 3412 - protein, 5 aa, synthetic construct
  REGION 1..5: note = Synthetic Construct
KATHK

SEQ ID NO: 3413 - protein, 5 aa, synthetic construct
  REGION 1..5: note = Synthetic Construct
KATIK

SEQ ID NO: 3414 - protein, 5 aa, synthetic construct
  REGION 1..5: note = Synthetic Construct
KATLK

SEQ ID NO: 3415 - protein, 5 aa, synthetic construct
  REGION 1..5: note = Synthetic Construct
KATNK

SEQ ID NO: 3416 - protein, 5 aa, synthetic construct
  REGION 1..5: note = Synthetic Construct
KATQK

SEQ ID NO: 3417 - protein, 5 aa, synthetic construct
  REGION 1..5: note = Synthetic Construct
KATRK

SEQ ID NO: 3418 - protein, 5 aa, synthetic construct
  REGION 1..5: note = Synthetic Construct
KATSK

SEQ ID NO: 3419 - protein, 5 aa, synthetic construct
  REGION 1..5: note = Synthetic Construct
KATTK

SEQ ID NO: 3420 - protein, 5 aa, synthetic construct
  REGION 1..5: note = Synthetic Construct
KATYK

SEQ ID NO: 3421 - protein, 5 aa, synthetic construct
  REGION 1..5: note = Synthetic Construct
KAYAK

SEQ ID NO: 3422 - protein, 5 aa, synthetic construct
  REGION 1..5: note = Synthetic Construct
KAYDK

SEQ ID NO: 3423 - protein, 5 aa, synthetic construct
  REGION 1..5: note = Synthetic Construct
KAYEK

SEQ ID NO: 3424 - protein, 5 aa, synthetic construct
  REGION 1..5: note = Synthetic Construct
KAYFK

SEQ ID NO: 3425 - protein, 5 aa, synthetic construct
  REGION 1..5: note = Synthetic Construct
KAYGK

SEQ ID NO: 3426 - protein, 5 aa, synthetic construct
  REGION 1..5: note = Synthetic Construct
KAYHK

SEQ ID NO: 3427 - protein, 5 aa, synthetic construct
  REGION 1..5: note = Synthetic Construct
KAYIK

SEQ ID NO: 3428 - protein, 5 aa, synthetic construct
  REGION 1..5: note = Synthetic Construct
KAYLK

SEQ ID NO: 3429 - protein, 5 aa, synthetic construct
  REGION 1..5: note = Synthetic Construct
KAYNK

SEQ ID NO: 3430 - protein, 5 aa, synthetic construct
  REGION 1..5: note = Synthetic Construct
KAYQK

SEQ ID NO: 3431 - protein, 5 aa, synthetic construct
  REGION 1..5: note = Synthetic Construct
KAYRK

SEQ ID NO: 3432 - protein, 5 aa, synthetic construct
  REGION 1..5: note = Synthetic Construct
KAYSK

SEQ ID NO: 3433 - protein, 5 aa, synthetic construct
  REGION 1..5: note = Synthetic Construct
KAYTK

SEQ ID NO: 3434 - protein, 5 aa, synthetic construct
  REGION 1..5: note = Synthetic Construct
KAYYK

SEQ ID NO: 3435 - protein, 5 aa, synthetic construct
  REGION 1..5: note = Synthetic Construct
KDAAK

SEQ ID NO: 3436 - protein, 5 aa, synthetic construct
  REGION 1..5: note = Synthetic Construct
KDADK

SEQ ID NO: 3437 - protein, 5 aa, synthetic construct
  REGION 1..5: note = Synthetic Construct
KDAEK

SEQ ID NO: 3438 - protein, 5 aa, synthetic construct
  REGION 1..5: note = Synthetic Construct
KDAFK

SEQ ID NO: 3439 - protein, 5 aa, synthetic construct
  REGION 1..5: note = Synthetic Construct
KDAGK

SEQ ID NO: 3440 - protein, 5 aa, synthetic construct
  REGION 1..5: note = Synthetic Construct
KDAHK

SEQ ID NO: 3441 - protein, 5 aa, synthetic construct
  REGION 1..5: note = Synthetic Construct
KDAIK

SEQ ID NO: 3442 - protein, 5 aa, synthetic construct
  REGION 1..5: note = Synthetic Construct
KDALK

SEQ ID NO: 3443 - protein, 5 aa, synthetic construct
  REGION 1..5: note = Synthetic Construct
KDANK

SEQ ID NO: 3444 - protein, 5 aa, synthetic construct
  REGION 1..5: note = Synthetic Construct
KDAQK

SEQ ID NO: 3445 - protein, 5 aa, synthetic construct
  REGION 1..5: note = Synthetic Construct
KDARK

SEQ ID NO: 3446 - protein, 5 aa, synthetic construct
  REGION 1..5: note = Synthetic Construct
KDASK

SEQ ID NO: 3447 - protein, 5 aa, synthetic construct
  REGION 1..5: note = Synthetic Construct
KDATK

SEQ ID NO: 3448 - protein, 5 aa, synthetic construct
  REGION 1..5: note = Synthetic Construct
KDAYK

SEQ ID NO: 3449 - protein, 5 aa, synthetic construct
  REGION 1..5: note = Synthetic Construct
KDDAK

SEQ ID NO: 3450 - protein, 5 aa, synthetic construct
  REGION 1..5: note = Synthetic Construct
KDDDK

SEQ ID NO: 3451 - protein, 5 aa, synthetic construct
  REGION 1..5: note = Synthetic Construct
KDDEK

SEQ ID NO: 3452 - protein, 5 aa, synthetic construct
  REGION 1..5: note = Synthetic Construct
KDDFK

SEQ ID NO: 3453 - protein, 5 aa, synthetic construct
  REGION 1..5: note = Synthetic Construct
KDDGK

SEQ ID NO: 3454 - protein, 5 aa, synthetic construct
  REGION 1..5: note = Synthetic Construct
KDDHK

SEQ ID NO: 3455 - protein, 5 aa, synthetic construct
  REGION 1..5: note = Synthetic Construct
KDDIK

SEQ ID NO: 3456 - protein, 5 aa, synthetic construct
  REGION 1..5: note = Synthetic Construct
KDDLK

SEQ ID NO: 3457 - protein, 5 aa, synthetic construct
  REGION 1..5: note = Synthetic Construct
KDDNK

SEQ ID NO: 3458 - protein, 5 aa, synthetic construct
  REGION 1..5: note = Synthetic Construct
KDDQK

SEQ ID NO: 3459 - protein, 5 aa, synthetic construct
  REGION 1..5: note = Synthetic Construct
KDDRK

SEQ ID NO: 3460 - protein, 5 aa, synthetic construct
  REGION 1..5: note = Synthetic Construct
KDDSK

SEQ ID NO: 3461 - protein, 5 aa, synthetic construct
  REGION 1..5: note = Synthetic Construct
KDDTK

SEQ ID NO: 3462 - protein, 5 aa, synthetic construct
  REGION 1..5: note = Synthetic Construct
KDDYK

SEQ ID NO: 3463 - protein, 5 aa, synthetic construct
  REGION 1..5: note = Synthetic Construct
KDEAK

SEQ ID NO: 3464 - protein, 5 aa, synthetic construct
  REGION 1..5: note = Synthetic Construct
KDEDK

SEQ ID NO: 3465 - protein, 5 aa, synthetic construct
  REGION 1..5: note = Synthetic Construct
KDEEK

SEQ ID NO: 3466 - protein, 5 aa, synthetic construct
  REGION 1..5: note = Synthetic Construct
KDEFK

SEQ ID NO: 3467 - protein, 5 aa, synthetic construct
  REGION 1..5: note = Synthetic Construct
KDEGK

SEQ ID NO: 3468 - protein, 5 aa, synthetic construct
  REGION 1..5: note = Synthetic Construct
KDEHK

SEQ ID NO: 3469 - protein, 5 aa, synthetic construct
  REGION 1..5: note = Synthetic Construct
KDEIK

SEQ ID NO: 3470 - protein, 5 aa, synthetic construct
  REGION 1..5: note = Synthetic Construct
KDELK

SEQ ID NO: 3471 - protein, 5 aa, synthetic construct
  REGION 1..5: note = Synthetic Construct
KDENK

SEQ ID NO: 3472 - protein, 5 aa, synthetic construct
  REGION 1..5: note = Synthetic Construct
KDEQK

SEQ ID NO: 3473 - protein, 5 aa, synthetic construct
  REGION 1..5: note = Synthetic Construct
KDERK

SEQ ID NO: 3474 - protein, 5 aa, synthetic construct
  REGION 1..5: note = Synthetic Construct
KDESK

SEQ ID NO: 3475 - protein, 5 aa, synthetic construct
  REGION 1..5: note = Synthetic Construct
KDETK

SEQ ID NO: 3476 - protein, 5 aa, synthetic construct
  REGION 1..5: note = Synthetic Construct
KDEYK

SEQ ID NO: 3477 - protein, 5 aa, synthetic construct
  REGION 1..5: note = Synthetic Construct
KDFAK

SEQ ID NO: 3478 - protein, 5 aa, synthetic construct
  REGION 1..5: note = Synthetic Construct
KDFDK

SEQ ID NO: 3479 - protein, 5 aa, synthetic construct
  REGION 1..5: note = Synthetic Construct
KDFEK

SEQ ID NO: 3480 - protein, 5 aa, synthetic construct
  REGION 1..5: note = Synthetic Construct
KDFFK

SEQ ID NO: 3481 - protein, 5 aa, synthetic construct
  REGION 1..5: note = Synthetic Construct
KDFGK

SEQ ID NO: 3482 - protein, 5 aa, synthetic construct
  REGION 1..5: note = Synthetic Construct
KDFHK

SEQ ID NO: 3483 - protein, 5 aa, synthetic construct
  REGION 1..5: note = Synthetic Construct
KDFIK

SEQ ID NO: 3484 - protein, 5 aa, synthetic construct
  REGION 1..5: note = Synthetic Construct
KDFLK

SEQ ID NO: 3485 - protein, 5 aa, synthetic construct
  REGION 1..5: note = Synthetic Construct
KDFNK

SEQ ID NO: 3486 - protein, 5 aa, synthetic construct
  REGION 1..5: note = Synthetic Construct
KDFQK

SEQ ID NO: 3487 - protein, 5 aa, synthetic construct
  REGION 1..5: note = Synthetic Construct
KDFRK

SEQ ID NO: 3488 - protein, 5 aa, synthetic construct
  REGION 1..5: note = Synthetic Construct
KDFSK

SEQ ID NO: 3489 - protein, 5 aa, synthetic construct
  REGION 1..5: note = Synthetic Construct
KDFTK

SEQ ID NO: 3490 - protein, 5 aa, synthetic construct
  REGION 1..5: note = Synthetic Construct
KDFYK

SEQ ID NO: 3491 - protein, 5 aa, synthetic construct
  REGION 1..5: note = Synthetic Construct
KDGAK

SEQ ID NO: 3492 - protein, 5 aa, synthetic construct
  REGION 1..5: note = Synthetic Construct
KDGDK

SEQ ID NO: 3493 - protein, 5 aa, synthetic construct
  REGION 1..5: note = Synthetic Construct
KDGEK

SEQ ID NO: 3494 - protein, 5 aa, synthetic construct
  REGION 1..5: note = Synthetic Construct
KDGFK

SEQ ID NO: 3495 - protein, 5 aa, synthetic construct
  REGION 1..5: note = Synthetic Construct
KDGGK

SEQ ID NO: 3496 - protein, 5 aa, synthetic construct
  REGION 1..5: note = Synthetic Construct
KDGHK

SEQ ID NO: 3497 - protein, 5 aa, synthetic construct
  REGION 1..5: note = Synthetic Construct
KDGIK

SEQ ID NO: 3498 - protein, 5 aa, synthetic construct
  REGION 1..5: note = Synthetic Construct
KDGLK

SEQ ID NO: 3499 - protein, 5 aa, synthetic construct
  REGION 1..5: note = Synthetic Construct
KDGNK

SEQ ID NO: 3500 - protein, 5 aa, synthetic construct
  REGION 1..5: note = Synthetic Construct
KDGQK

SEQ ID NO: 3501 - protein, 5 aa, synthetic construct
  REGION 1..5: note = Synthetic Construct
KDGRK

SEQ ID NO: 3502 - protein, 5 aa, synthetic construct
  REGION 1..5: note = Synthetic Construct
KDGSK

SEQ ID NO: 3503 - protein, 5 aa, synthetic construct
  REGION 1..5: note = Synthetic Construct
KDGTK

SEQ ID NO: 3504 - protein, 5 aa, synthetic construct
  REGION 1..5: note = Synthetic Construct
KDGYK

SEQ ID NO: 3505 - protein, 5 aa, synthetic construct
  REGION 1..5: note = Synthetic Construct
KDHAK

SEQ ID NO: 3506 - protein, 5 aa, synthetic construct
  REGION 1..5: note = Synthetic Construct
KDHDK

SEQ ID NO: 3507 - protein, 5 aa, synthetic construct
  REGION 1..5: note = Synthetic Construct
KDHEK

SEQ ID NO: 3508 - protein, 5 aa, synthetic construct
  REGION 1..5: note = Synthetic Construct
KDHFK

SEQ ID NO: 3509 - protein, 5 aa, synthetic construct
  REGION 1..5: note = Synthetic Construct
KDHGK

SEQ ID NO: 3510 - protein, 5 aa, synthetic construct
  REGION 1..5: note = Synthetic Construct
KDHHK

SEQ ID NO: 3511 - protein, 5 aa, synthetic construct
  REGION 1..5: note = Synthetic Construct
KDHIK

SEQ ID NO: 3512 - protein, 5 aa, synthetic construct
  REGION 1..5: note = Synthetic Construct
KDHLK

SEQ ID NO: 3513 - protein, 5 aa, synthetic construct
  REGION 1..5: note = Synthetic Construct
KDHNK

SEQ ID NO: 3514 - protein, 5 aa, synthetic construct
  REGION 1..5: note = Synthetic Construct
KDHQK

SEQ ID NO: 3515 - protein, 5 aa, synthetic construct
  REGION 1..5: note = Synthetic Construct
KDHRK

SEQ ID NO: 3516 - protein, 5 aa, synthetic construct
  REGION 1..5: note = Synthetic Construct
KDHSK

SEQ ID NO: 3517 - protein, 5 aa, synthetic construct
  REGION 1..5: note = Synthetic Construct
KDHTK

SEQ ID NO: 3518 - protein, 5 aa, synthetic construct
  REGION 1..5: note = Synthetic Construct
KDHYK

SEQ ID NO: 3519 - protein, 5 aa, synthetic construct
  REGION 1..5: note = Synthetic Construct
KDIAK

SEQ ID NO: 3520 - protein, 5 aa, synthetic construct
  REGION 1..5: note = Synthetic Construct
KDIDK

SEQ ID NO: 3521 - protein, 5 aa, synthetic construct
  REGION 1..5: note = Synthetic Construct
KDIEK

SEQ ID NO: 3522 - protein, 5 aa, synthetic construct
  REGION 1..5: note = Synthetic Construct
KDIFK

SEQ ID NO: 3523 - protein, 5 aa, synthetic construct
  REGION 1..5: note = Synthetic Construct
KDIGK

SEQ ID NO: 3524 - protein, 5 aa, synthetic construct
  REGION 1..5: note = Synthetic Construct
KDIHK

SEQ ID NO: 3525 - protein, 5 aa, synthetic construct
  REGION 1..5: note = Synthetic Construct
KDIIK

SEQ ID NO: 3526 - protein, 5 aa, synthetic construct
  REGION 1..5: note = Synthetic Construct
KDILK

SEQ ID NO: 3527 - protein, 5 aa, synthetic construct
  REGION 1..5: note = Synthetic Construct
KDINK

SEQ ID NO: 3528 - protein, 5 aa, synthetic construct
  REGION 1..5: note = Synthetic Construct
KDIQK

SEQ ID NO: 3529 - protein, 5 aa, synthetic construct
  REGION 1..5: note = Synthetic Construct
KDIRK

SEQ ID NO: 3530 - protein, 5 aa, synthetic construct
  REGION 1..5: note = Synthetic Construct
KDISK

SEQ ID NO: 3531 - protein, 5 aa, synthetic construct
  REGION 1..5: note = Synthetic Construct
KDITK

SEQ ID NO: 3532 - protein, 5 aa, synthetic construct
  REGION 1..5: note = Synthetic Construct
KDIYK

SEQ ID NO: 3533 - protein, 5 aa, synthetic construct
  REGION 1..5: note = Synthetic Construct
KDLAK

SEQ ID NO: 3534 - protein, 5 aa, synthetic construct
  REGION 1..5: note = Synthetic Construct
KDLDK

SEQ ID NO: 3535 - protein, 5 aa, synthetic construct
  REGION 1..5: note = Synthetic Construct
KDLEK

SEQ ID NO: 3536 - protein, 5 aa, synthetic construct
  REGION 1..5: note = Synthetic Construct
KDLFK

SEQ ID NO: 3537 - protein, 5 aa, synthetic construct
  REGION 1..5: note = Synthetic Construct
KDLGK

SEQ ID NO: 3538 - protein, 5 aa, synthetic construct
  REGION 1..5: note = Synthetic Construct
KDLHK

SEQ ID NO: 3539 - protein, 5 aa, synthetic construct
  REGION 1..5: note = Synthetic Construct
KDLIK

SEQ ID NO: 3540 - protein, 5 aa, synthetic construct
  REGION 1..5: note = Synthetic Construct
KDLLK

SEQ ID NO: 3541 - protein, 5 aa, synthetic construct
  REGION 1..5: note = Synthetic Construct
KDLNK

SEQ ID NO: 3542 - protein, 5 aa, synthetic construct
  REGION 1..5: note = Synthetic Construct
KDLQK

SEQ ID NO: 3543 - protein, 5 aa, synthetic construct
  REGION 1..5: note = Synthetic Construct
KDLRK

SEQ ID NO: 3544 - protein, 5 aa, synthetic construct
  REGION 1..5: note = Synthetic Construct
KDLSK

SEQ ID NO: 3545 - protein, 5 aa, synthetic construct
  REGION 1..5: note = Synthetic Construct
KDLTK

SEQ ID NO: 3546 - protein, 5 aa, synthetic construct
  REGION 1..5: note = Synthetic Construct
KDLYK

SEQ ID NO: 3547 - protein, 5 aa, synthetic construct
  REGION 1..5: note = Synthetic Construct
KDNAK

SEQ ID NO: 3548 - protein, 5 aa, synthetic construct
  REGION 1..5: note = Synthetic Construct
KDNDK

SEQ ID NO: 3549 - protein, 5 aa, synthetic construct
  REGION 1..5: note = Synthetic Construct
KDNEK

SEQ ID NO: 3550 - protein, 5 aa, synthetic construct
  REGION 1..5: note = Synthetic Construct
KDNFK

SEQ ID NO: 3551 - protein, 5 aa, synthetic construct
  REGION 1..5: note = Synthetic Construct
KDNGK

SEQ ID NO: 3552 - protein, 5 aa, synthetic construct
  REGION 1..5: note = Synthetic Construct
KDNHK

SEQ ID NO: 3553 - protein, 5 aa, synthetic construct
  REGION 1..5: note = Synthetic Construct
KDNIK

SEQ ID NO: 3554 - protein, 5 aa, synthetic construct
  REGION 1..5: note = Synthetic Construct
KDNLK

SEQ ID NO: 3555 - protein, 5 aa, synthetic construct
  REGION 1..5: note = Synthetic Construct
KDNNK

SEQ ID NO: 3556 - protein, 5 aa, synthetic construct
  REGION 1..5: note = Synthetic Construct
KDNQK

SEQ ID NO: 3557 - protein, 5 aa, synthetic construct
  REGION 1..5: note = Synthetic Construct
KDNRK

SEQ ID NO: 3558 - protein, 5 aa, synthetic construct
  REGION 1..5: note = Synthetic Construct
KDNSK

SEQ ID NO: 3559 - protein, 5 aa, synthetic construct
  REGION 1..5: note = Synthetic Construct
KDNTK

SEQ ID NO: 3560 - protein, 5 aa, synthetic construct
  REGION 1..5: note = Synthetic Construct
KDNYK

SEQ ID NO: 3561 - protein, 5 aa, synthetic construct
  REGION 1..5: note = Synthetic Construct
KDPAK

SEQ ID NO: 3562 - protein, 5 aa, synthetic construct
  REGION 1..5: note = Synthetic Construct
KDPDK

SEQ ID NO: 3563 - protein, 5 aa, synthetic construct
  REGION 1..5: note = Synthetic Construct
KDPEK

SEQ ID NO: 3564 - protein, 5 aa, synthetic construct
  REGION 1..5: note = Synthetic Construct
KDPFK

SEQ ID NO: 3565 - protein, 5 aa, synthetic construct
  REGION 1..5: note = Synthetic Construct
KDPGK

SEQ ID NO: 3566 - protein, 5 aa, synthetic construct
  REGION 1..5: note = Synthetic Construct
KDPHK

SEQ ID NO: 3567 - protein, 5 aa, synthetic construct
  REGION 1..5: note = Synthetic Construct
KDPIK

SEQ ID NO: 3568 - protein, 5 aa, synthetic construct
  REGION 1..5: note = Synthetic Construct
KDPLK

SEQ ID NO: 3569 - protein, 5 aa, synthetic construct
  REGION 1..5: note = Synthetic Construct
KDPNK

SEQ ID NO: 3570 - protein, 5 aa, synthetic construct
  REGION 1..5: note = Synthetic Construct
KDPQK

SEQ ID NO: 3571 - protein, 5 aa, synthetic construct
  REGION 1..5: note = Synthetic Construct
KDPRK

SEQ ID NO: 3572 - protein, 5 aa, synthetic construct
  REGION 1..5: note = Synthetic Construct
KDPSK

SEQ ID NO: 3573 - protein, 5 aa, synthetic construct
  REGION 1..5: note = Synthetic Construct
KDPTK

SEQ ID NO: 3574 - protein, 5 aa, synthetic construct
  REGION 1..5: note = Synthetic Construct
KDPYK

SEQ ID NO: 3575 - protein, 5 aa, synthetic construct
  REGION 1..5: note = Synthetic Construct
KDQAK

SEQ ID NO: 3576 - protein, 5 aa, synthetic construct
  REGION 1..5: note = Synthetic Construct
KDQDK

SEQ ID NO: 3577 - protein, 5 aa, synthetic construct
  REGION 1..5: note = Synthetic Construct
KDQEK

SEQ ID NO: 3578 - protein, 5 aa, synthetic construct
  REGION 1..5: note = Synthetic Construct
KDQFK

SEQ ID NO: 3579 - protein, 5 aa, synthetic construct
  REGION 1..5: note = Synthetic Construct
KDQGK

SEQ ID NO: 3580 - protein, 5 aa, synthetic construct
  REGION 1..5: note = Synthetic Construct
KDQHK

SEQ ID NO: 3581 - protein, 5 aa, synthetic construct
  REGION 1..5: note = Synthetic Construct
KDQIK

SEQ ID NO: 3582 - protein, 5 aa, synthetic construct
  REGION 1..5: note = Synthetic Construct
KDQLK

SEQ ID NO: 3583 - protein, 5 aa, synthetic construct
  REGION 1..5: note = Synthetic Construct
KDQNK

SEQ ID NO: 3584 - protein, 5 aa, synthetic construct
  REGION 1..5: note = Synthetic Construct
KDQQK

SEQ ID NO: 3585 - protein, 5 aa, synthetic construct
  REGION 1..5: note = Synthetic Construct
KDQRK

SEQ ID NO: 3586 - protein, 5 aa, synthetic construct
  REGION 1..5: note = Synthetic Construct
KDQSK

SEQ ID NO: 3587 - protein, 5 aa, synthetic construct
  REGION 1..5: note = Synthetic Construct
KDQTK

SEQ ID NO: 3588 - protein, 5 aa, synthetic construct
  REGION 1..5: note = Synthetic Construct
KDQYK

SEQ ID NO: 3589 - protein, 5 aa, synthetic construct
  REGION 1..5: note = Synthetic Construct
KDRAK

SEQ ID NO: 3590 - protein, 5 aa, synthetic construct
  REGION 1..5: note = Synthetic Construct
KDRDK

SEQ ID NO: 3591 - protein, 5 aa, synthetic construct
  REGION 1..5: note = Synthetic Construct
KDREK

SEQ ID NO: 3592 - protein, 5 aa, synthetic construct
  REGION 1..5: note = Synthetic Construct
KDRFK

SEQ ID NO: 3593 - protein, 5 aa, synthetic construct
  REGION 1..5: note = Synthetic Construct
KDRGK

SEQ ID NO: 3594 - protein, 5 aa, synthetic construct
  REGION 1..5: note = Synthetic Construct
KDRHK

SEQ ID NO: 3595 - protein, 5 aa, synthetic construct
  REGION 1..5: note = Synthetic Construct
KDRIK

SEQ ID NO: 3596 - protein, 5 aa, synthetic construct
  REGION 1..5: note = Synthetic Construct
KDRLK

SEQ ID NO: 3597 - protein, 5 aa, synthetic construct
  REGION 1..5: note = Synthetic Construct
KDRNK

SEQ ID NO: 3598 - protein, 5 aa, synthetic construct
  REGION 1..5: note = Synthetic Construct
KDRQK

SEQ ID NO: 3599 - protein, 5 aa, synthetic construct
  REGION 1..5: note = Synthetic Construct
KDRRK

SEQ ID NO: 3600 - protein, 5 aa, synthetic construct
  REGION 1..5: note = Synthetic Construct
KDRSK

SEQ ID NO: 3601 - protein, 5 aa, synthetic construct
  REGION 1..5: note = Synthetic Construct
KDRTK

SEQ ID NO: 3602 - protein, 5 aa, synthetic construct
  REGION 1..5: note = Synthetic Construct
KDRYK

SEQ ID NO: 3603 - protein, 5 aa, synthetic construct
  REGION 1..5: note = Synthetic Construct
KDSAK

SEQ ID NO: 3604 - protein, 5 aa, synthetic construct
  REGION 1..5: note = Synthetic Construct
KDSDK

SEQ ID NO: 3605 - protein, 5 aa, synthetic construct
  REGION 1..5: note = Synthetic Construct
KDSEK

SEQ ID NO: 3606 - protein, 5 aa, synthetic construct
  REGION 1..5: note = Synthetic Construct
KDSFK

SEQ ID NO: 3607 - protein, 5 aa, synthetic construct
  REGION 1..5: note = Synthetic Construct
KDSGK

SEQ ID NO: 3608 - protein, 5 aa, synthetic construct
  REGION 1..5: note = Synthetic Construct
KDSHK

SEQ ID NO: 3609 - protein, 5 aa, synthetic construct
  REGION 1..5: note = Synthetic Construct
KDSIK

SEQ ID NO: 3610 - protein, 5 aa, synthetic construct
  REGION 1..5: note = Synthetic Construct
KDSLK

SEQ ID NO: 3611 - protein, 5 aa, synthetic construct
  REGION 1..5: note = Synthetic Construct
KDSNK

SEQ ID NO: 3612 - protein, 5 aa, synthetic construct
  REGION 1..5: note = Synthetic Construct
KDSQK

SEQ ID NO: 3613 - protein, 5 aa, synthetic construct
  REGION 1..5: note = Synthetic Construct
KDSRK

SEQ ID NO: 3614 - protein, 5 aa, synthetic construct
  REGION 1..5: note = Synthetic Construct
KDSSK

SEQ ID NO: 3615 - protein, 5 aa, synthetic construct
  REGION 1..5: note = Synthetic Construct
KDSTK

SEQ ID NO: 3616 - protein, 5 aa, synthetic construct
  REGION 1..5: note = Synthetic Construct
KDSYK

SEQ ID NO: 3617 - protein, 5 aa, synthetic construct
  REGION 1..5: note = Synthetic Construct
KDTAK

SEQ ID NO: 3618 - protein, 5 aa, synthetic construct
  REGION 1..5: note = Synthetic Construct
KDTDK

SEQ ID NO: 3619 - protein, 5 aa, synthetic construct
  REGION 1..5: note = Synthetic Construct
KDTEK

SEQ ID NO: 3620 - protein, 5 aa, synthetic construct
  REGION 1..5: note = Synthetic Construct
KDTFK

SEQ ID NO: 3621 - protein, 5 aa, synthetic construct
  REGION 1..5: note = Synthetic Construct
KDTGK

SEQ ID NO: 3622 - protein, 5 aa, synthetic construct
  REGION 1..5: note = Synthetic Construct
KDTHK

SEQ ID NO: 3623 - protein, 5 aa, synthetic construct
  REGION 1..5: note = Synthetic Construct
KDTIK

SEQ ID NO: 3624 - protein, 5 aa, synthetic construct
  REGION 1..5: note = Synthetic Construct
KDTLK

SEQ ID NO: 3625 - protein, 5 aa, synthetic construct
  REGION 1..5: note = Synthetic Construct
KDTNK

SEQ ID NO: 3626 - protein, 5 aa, synthetic construct
  REGION 1..5: note = Synthetic Construct
KDTQK

SEQ ID NO: 3627 - protein, 5 aa, synthetic construct
  REGION 1..5: note = Synthetic Construct
KDTRK

SEQ ID NO: 3628 - protein, 5 aa, synthetic construct
  REGION 1..5: note = Synthetic Construct
KDTSK

SEQ ID NO: 3629 - protein, 5 aa, synthetic construct
  REGION 1..5: note = Synthetic Construct
KDTTK

SEQ ID NO: 3630 - protein, 5 aa, synthetic construct
  REGION 1..5: note = Synthetic Construct
KDTYK

SEQ ID NO: 3631 - protein, 5 aa, synthetic construct
  REGION 1..5: note = Synthetic Construct
KDYAK

SEQ ID NO: 3632 - protein, 5 aa, synthetic construct
  REGION 1..5: note = Synthetic Construct
KDYDK

SEQ ID NO: 3633 - protein, 5 aa, synthetic construct
  REGION 1..5: note = Synthetic Construct
KDYEK

SEQ ID NO: 3634 - protein, 5 aa, synthetic construct
  REGION 1..5: note = Synthetic Construct
KDYFK

SEQ ID NO: 3635 - protein, 5 aa, synthetic construct
  REGION 1..5: note = Synthetic Construct
KDYGK

SEQ ID NO: 3636 - protein, 5 aa, synthetic construct
  REGION 1..5: note = Synthetic Construct
KDYHK

SEQ ID NO: 3637 - protein, 5 aa, synthetic construct
  REGION 1..5: note = Synthetic Construct
KDYIK

SEQ ID NO: 3638 - protein, 5 aa, synthetic construct
  REGION 1..5: note = Synthetic Construct
KDYLK

SEQ ID NO: 3639 - protein, 5 aa, synthetic construct
  REGION 1..5: note = Synthetic Construct
KDYNK

SEQ ID NO: 3640 - protein, 5 aa, synthetic construct
  REGION 1..5: note = Synthetic Construct
KDYQK

SEQ ID NO: 3641 - protein, 5 aa, synthetic construct
  REGION 1..5: note = Synthetic Construct
KDYRK

SEQ ID NO: 3642 - protein, 5 aa, synthetic construct
  REGION 1..5: note = Synthetic Construct
KDYSK

SEQ ID NO: 3643 - protein, 5 aa, synthetic construct
  REGION 1..5: note = Synthetic Construct
KDYTK

SEQ ID NO: 3644 - protein, 5 aa, synthetic construct
  REGION 1..5: note = Synthetic Construct
KDYYK

SEQ ID NO: 3645 - protein, 5 aa, synthetic construct
  REGION 1..5: note = Synthetic Construct
KEAAK

SEQ ID NO: 3646 - protein, 5 aa, synthetic construct
  REGION 1..5: note = Synthetic Construct
KEADK

SEQ ID NO: 3647 - protein, 5 aa, synthetic construct
  REGION 1..5: note = Synthetic Construct
KEAEK

SEQ ID NO: 3648 - protein, 5 aa, synthetic construct
  REGION 1..5: note = Synthetic Construct
KEAFK

SEQ ID NO: 3649 - protein, 5 aa, synthetic construct
  REGION 1..5: note = Synthetic Construct
KEAGK

SEQ ID NO: 3650 - protein, 5 aa, synthetic construct
  REGION 1..5: note = Synthetic Construct
KEAHK

SEQ ID NO: 3651 - protein, 5 aa, synthetic construct
  REGION 1..5: note = Synthetic Construct
KEAIK

SEQ ID NO: 3652 - protein, 5 aa, synthetic construct
  REGION 1..5: note = Synthetic Construct
KEALK

SEQ ID NO: 3653 - protein, 5 aa, synthetic construct
  REGION 1..5: note = Synthetic Construct
KEANK

SEQ ID NO: 3654 - protein, 5 aa, synthetic construct
  REGION 1..5: note = Synthetic Construct
KEAQK

SEQ ID NO: 3655 - protein, 5 aa, synthetic construct
  REGION 1..5: note = Synthetic Construct
KEARK

SEQ ID NO: 3656 - protein, 5 aa, synthetic construct
  REGION 1..5: note = Synthetic Construct
KEASK

SEQ ID NO: 3657 - protein, 5 aa, synthetic construct
  REGION 1..5: note = Synthetic Construct
KEATK

SEQ ID NO: 3658 - protein, 5 aa, synthetic construct
  REGION 1..5: note = Synthetic Construct
KEAYK

SEQ ID NO: 3659 - protein, 5 aa, synthetic construct
  REGION 1..5: note = Synthetic Construct
KEDAK

SEQ ID NO: 3660 - protein, 5 aa, synthetic construct
  REGION 1..5: note = Synthetic Construct
KEDDK

SEQ ID NO: 3661 - protein, 5 aa, synthetic construct
  REGION 1..5: note = Synthetic Construct
KEDEK

SEQ ID NO: 3662 - protein, 5 aa, synthetic construct
  REGION 1..5: note = Synthetic Construct
KEDFK

SEQ ID NO: 3663 - protein, 5 aa, synthetic construct
  REGION 1..5: note = Synthetic Construct
KEDGK

SEQ ID NO: 3664 - protein, 5 aa, synthetic construct
  REGION 1..5: note = Synthetic Construct
KEDHK

SEQ ID NO: 3665 - protein, 5 aa, synthetic construct
  REGION 1..5: note = Synthetic Construct
KEDIK

SEQ ID NO: 3666 - protein, 5 aa, synthetic construct
  REGION 1..5: note = Synthetic Construct
KEDLK

SEQ ID NO: 3667 - protein, 5 aa, synthetic construct
  REGION 1..5: note = Synthetic Construct
KEDNK

SEQ ID NO: 3668 - protein, 5 aa, synthetic construct
  REGION 1..5: note = Synthetic Construct
KEDQK

SEQ ID NO: 3669 - protein, 5 aa, synthetic construct
  REGION 1..5: note = Synthetic Construct
KEDRK

SEQ ID NO: 3670 - protein, 5 aa, synthetic construct
  REGION 1..5: note = Synthetic Construct
KEDSK

SEQ ID NO: 3671 - protein, 5 aa, synthetic construct
  REGION 1..5: note = Synthetic Construct
KEDTK

SEQ ID NO: 3672 - protein, 5 aa, synthetic construct
  REGION 1..5: note = Synthetic Construct
KEDYK

SEQ ID NO: 3673 - protein, 5 aa, synthetic construct
  REGION 1..5: note = Synthetic Construct
KEEAK

SEQ ID NO: 3674 - protein, 5 aa, synthetic construct
  REGION 1..5: note = Synthetic Construct
KEEDK

SEQ ID NO: 3675 - protein, 5 aa, synthetic construct
  REGION 1..5: note = Synthetic Construct
KEEEK

SEQ ID NO: 3676 - protein, 5 aa, synthetic construct
  REGION 1..5: note = Synthetic Construct
KEEFK

SEQ ID NO: 3677 - protein, 5 aa, synthetic construct
  REGION 1..5: note = Synthetic Construct
KEEGK

SEQ ID NO: 3678 - protein, 5 aa, synthetic construct
  REGION 1..5: note = Synthetic Construct
KEEHK

SEQ ID NO: 3679 - protein, 5 aa, synthetic construct
  REGION 1..5: note = Synthetic Construct
KEEIK

SEQ ID NO: 3680 - protein, 5 aa, synthetic construct
  REGION 1..5: note = Synthetic Construct
KEELK

SEQ ID NO: 3681 - protein, 5 aa, synthetic construct
  REGION 1..5: note = Synthetic Construct
KEENK

SEQ ID NO: 3682 - protein, 5 aa, synthetic construct
  REGION 1..5: note = Synthetic Construct
KEEQK

SEQ ID NO: 3683 - protein, 5 aa, synthetic construct
  REGION 1..5: note = Synthetic Construct
KEERK

SEQ ID NO: 3684 - protein, 5 aa, synthetic construct
  REGION 1..5: note = Synthetic Construct
KEESK

SEQ ID NO: 3685 - protein, 5 aa, synthetic construct
  REGION 1..5: note = Synthetic Construct
KEETK

SEQ ID NO: 3686 - protein, 5 aa, synthetic construct
  REGION 1..5: note = Synthetic Construct
KEEYK

SEQ ID NO: 3687 - protein, 5 aa, synthetic construct
  REGION 1..5: note = Synthetic Construct
KEFAK

SEQ ID NO: 3688 - protein, 5 aa, synthetic construct
  REGION 1..5: note = Synthetic Construct
KEFDK

SEQ ID NO: 3689 - protein, 5 aa, synthetic construct
  REGION 1..5: note = Synthetic Construct
KEFEK

SEQ ID NO: 3690 - protein, 5 aa, synthetic construct
  REGION 1..5: note = Synthetic Construct
KEFFK

SEQ ID NO: 3691 - protein, 5 aa, synthetic construct
  REGION 1..5: note = Synthetic Construct
KEFGK

SEQ ID NO: 3692 - protein, 5 aa, synthetic construct
  REGION 1..5: note = Synthetic Construct
KEFHK

SEQ ID NO: 3693 - protein, 5 aa, synthetic construct
  REGION 1..5: note = Synthetic Construct
KEFIK

SEQ ID NO: 3694 - protein, 5 aa, synthetic construct
  REGION 1..5: note = Synthetic Construct
KEFLK

SEQ ID NO: 3695 - protein, 5 aa, synthetic construct
  REGION 1..5: note = Synthetic Construct
KEFNK

SEQ ID NO: 3696 - protein, 5 aa, synthetic construct
  REGION 1..5: note = Synthetic Construct
KEFQK

SEQ ID NO: 3697 - protein, 5 aa, synthetic construct
  REGION 1..5: note = Synthetic Construct
KEFRK

SEQ ID NO: 3698 - protein, 5 aa, synthetic construct
  REGION 1..5: note = Synthetic Construct
KEFSK

SEQ ID NO: 3699 - protein, 5 aa, synthetic construct
  REGION 1..5: note = Synthetic Construct
KEFTK

SEQ ID NO: 3700 - protein, 5 aa, synthetic construct
  REGION 1..5: note = Synthetic Construct
KEFYK

SEQ ID NO: 3701 - protein, 5 aa, synthetic construct
  REGION 1..5: note = Synthetic Construct
KEGAK

SEQ ID NO: 3702 - protein, 5 aa, synthetic construct
  REGION 1..5: note = Synthetic Construct
KEGDK

SEQ ID NO: 3703 - protein, 5 aa, synthetic construct
  REGION 1..5: note = Synthetic Construct
KEGEK

SEQ ID NO: 3704 - protein, 5 aa, synthetic construct
  REGION 1..5: note = Synthetic Construct
KEGFK

SEQ ID NO: 3705 - protein, 5 aa, synthetic construct
  REGION 1..5: note = Synthetic Construct
KEGGK

SEQ ID NO: 3706 - protein, 5 aa, synthetic construct
  REGION 1..5: note = Synthetic Construct
KEGHK

SEQ ID NO: 3707 - protein, 5 aa, synthetic construct
  REGION 1..5: note = Synthetic Construct
KEGIK

SEQ ID NO: 3708 - protein, 5 aa, synthetic construct
  REGION 1..5: note = Synthetic Construct
KEGLK

SEQ ID NO: 3709 - protein, 5 aa, synthetic construct
  REGION 1..5: note = Synthetic Construct
KEGNK

SEQ ID NO: 3710 - protein, 5 aa, synthetic construct
  REGION 1..5: note = Synthetic Construct
KEGQK

SEQ ID NO: 3711 - protein, 5 aa, synthetic construct
  REGION 1..5: note = Synthetic Construct
KEGRK

SEQ ID NO: 3712 - protein, 5 aa, synthetic construct
  REGION 1..5: note = Synthetic Construct
KEGSK

SEQ ID NO: 3713 - protein, 5 aa, synthetic construct
  REGION 1..5: note = Synthetic Construct
KEGTK

SEQ ID NO: 3714 - protein, 5 aa, synthetic construct
  REGION 1..5: note = Synthetic Construct
KEGYK

SEQ ID NO: 3715 - protein, 5 aa, synthetic construct
  REGION 1..5: note = Synthetic Construct
KEHAK

SEQ ID NO: 3716 - protein, 5 aa, synthetic construct
  REGION 1..5: note = Synthetic Construct
KEHDK

SEQ ID NO: 3717 - protein, 5 aa, synthetic construct
  REGION 1..5: note = Synthetic Construct
KEHEK

SEQ ID NO: 3718 - protein, 5 aa, synthetic construct
  REGION 1..5: note = Synthetic Construct
KEHFK

SEQ ID NO: 3719 - protein, 5 aa, synthetic construct
  REGION 1..5: note = Synthetic Construct
KEHGK

SEQ ID NO: 3720 - protein, 5 aa, synthetic construct
  REGION 1..5: note = Synthetic Construct
KEHHK

SEQ ID NO: 3721 - protein, 5 aa, synthetic construct
  REGION 1..5: note = Synthetic Construct
KEHIK

SEQ ID NO: 3722 - protein, 5 aa, synthetic construct
  REGION 1..5: note = Synthetic Construct
KEHLK

SEQ ID NO: 3723 - protein, 5 aa, synthetic construct
  REGION 1..5: note = Synthetic Construct
KEHNK

SEQ ID NO: 3724 - protein, 5 aa, synthetic construct
  REGION 1..5: note = Synthetic Construct
KEHQK

SEQ ID NO: 3725 - protein, 5 aa, synthetic construct
  REGION 1..5: note = Synthetic Construct
KEHRK

SEQ ID NO: 3726 - protein, 5 aa, synthetic construct
  REGION 1..5: note = Synthetic Construct
KEHSK

SEQ ID NO: 3727 - protein, 5 aa, synthetic construct
  REGION 1..5: note = Synthetic Construct
KEHTK

SEQ ID NO: 3728 - protein, 5 aa, synthetic construct
  REGION 1..5: note = Synthetic Construct
KEHYK

SEQ ID NO: 3729 - protein, 5 aa, synthetic construct
  REGION 1..5: note = Synthetic Construct
KEIAK

SEQ ID NO: 3730 - protein, 5 aa, synthetic construct
  REGION 1..5: note = Synthetic Construct
KEIDK

SEQ ID NO: 3731 - protein, 5 aa, synthetic construct
  REGION 1..5: note = Synthetic Construct
KEIEK

SEQ ID NO: 3732 - protein, 5 aa, synthetic construct
  REGION 1..5: note = Synthetic Construct
KEIFK

SEQ ID NO: 3733 - protein, 5 aa, synthetic construct
  REGION 1..5: note = Synthetic Construct
KEIGK

SEQ ID NO: 3734 - protein, 5 aa, synthetic construct
  REGION 1..5: note = Synthetic Construct
KEIHK

SEQ ID NO: 3735 - protein, 5 aa, synthetic construct
  REGION 1..5: note = Synthetic Construct
KEIIK

SEQ ID NO: 3736 - protein, 5 aa, synthetic construct
  REGION 1..5: note = Synthetic Construct
KEILK

SEQ ID NO: 3737 - protein, 5 aa, synthetic construct
  REGION 1..5: note = Synthetic Construct
KEINK

SEQ ID NO: 3738 - protein, 5 aa, synthetic construct
  REGION 1..5: note = Synthetic Construct
KEIQK

SEQ ID NO: 3739 - protein, 5 aa, synthetic construct
  REGION 1..5: note = Synthetic Construct
KEIRK

SEQ ID NO: 3740 - protein, 5 aa, synthetic construct
  REGION 1..5: note = Synthetic Construct
KEISK

SEQ ID NO: 3741 - protein, 5 aa, synthetic construct
  REGION 1..5: note = Synthetic Construct
KEITK

SEQ ID NO: 3742 - protein, 5 aa, synthetic construct
  REGION 1..5: note = Synthetic Construct
KEIYK

SEQ ID NO: 3743 - protein, 5 aa, synthetic construct
  REGION 1..5: note = Synthetic Construct
KELAK

SEQ ID NO: 3744 - protein, 5 aa, synthetic construct
  REGION 1..5: note = Synthetic Construct
KELDK

SEQ ID NO: 3745 - protein, 5 aa, synthetic construct
  REGION 1..5: note = Synthetic Construct
KELEK

SEQ ID NO: 3746 - protein, 5 aa, synthetic construct
  REGION 1..5: note = Synthetic Construct
KELFK

SEQ ID NO: 3747 - protein, 5 aa, synthetic construct
  REGION 1..5: note = Synthetic Construct
KELGK

SEQ ID NO: 3748 - protein, 5 aa, synthetic construct
  REGION 1..5: note = Synthetic Construct
KELHK

SEQ ID NO: 3749 - protein, 5 aa, synthetic construct
  REGION 1..5: note = Synthetic Construct
KELIK

SEQ ID NO: 3750 - protein, 5 aa, synthetic construct
  REGION 1..5: note = Synthetic Construct
KELLK

SEQ ID NO: 3751 - protein, 5 aa, synthetic construct
  REGION 1..5: note = Synthetic Construct
KELNK

SEQ ID NO: 3752 - protein, 5 aa, synthetic construct
  REGION 1..5: note = Synthetic Construct
KELQK

SEQ ID NO: 3753 - protein, 5 aa, synthetic construct
  REGION 1..5: note = Synthetic Construct
KELRK

SEQ ID NO: 3754 - protein, 5 aa, synthetic construct
  REGION 1..5: note = Synthetic Construct
KELSK

SEQ ID NO: 3755 - protein, 5 aa, synthetic construct
  REGION 1..5: note = Synthetic Construct
KELTK

SEQ ID NO: 3756 - protein, 5 aa, synthetic construct
  REGION 1..5: note = Synthetic Construct
KELYK

SEQ ID NO: 3757 - protein, 5 aa, synthetic construct
  REGION 1..5: note = Synthetic Construct
KENAK

SEQ ID NO: 3758 - protein, 5 aa, synthetic construct
  REGION 1..5: note = Synthetic Construct
KENDK

SEQ ID NO: 3759 - protein, 5 aa, synthetic construct
  REGION 1..5: note = Synthetic Construct
KENEK

SEQ ID NO: 3760 - protein, 5 aa, synthetic construct
  REGION 1..5: note = Synthetic Construct
KENFK

SEQ ID NO: 3761 - protein, 5 aa, synthetic construct
  REGION 1..5: note = Synthetic Construct
KENGK

SEQ ID NO: 3762 - protein, 5 aa, synthetic construct
  REGION 1..5: note = Synthetic Construct
KENHK

SEQ ID NO: 3763 - protein, 5 aa, synthetic construct
  REGION 1..5: note = Synthetic Construct
KENIK

SEQ ID NO: 3764 - protein, 5 aa, synthetic construct
  REGION 1..5: note = Synthetic Construct
KENLK

SEQ ID NO: 3765 - protein, 5 aa, synthetic construct
  REGION 1..5: note = Synthetic Construct
KENNK

SEQ ID NO: 3766 - protein, 5 aa, synthetic construct
  REGION 1..5: note = Synthetic Construct
KENQK

SEQ ID NO: 3767 - protein, 5 aa, synthetic construct
  REGION 1..5: note = Synthetic Construct
KENRK

SEQ ID NO: 3768 - protein, 5 aa, synthetic construct
  REGION 1..5: note = Synthetic Construct
KENSK

SEQ ID NO: 3769 - protein, 5 aa, synthetic construct
  REGION 1..5: note = Synthetic Construct
KENTK

SEQ ID NO: 3770 - protein, 5 aa, synthetic construct
  REGION 1..5: note = Synthetic Construct
KENYK

SEQ ID NO: 3771 - protein, 5 aa, synthetic construct
  REGION 1..5: note = Synthetic Construct
KEPAK

SEQ ID NO: 3772 - protein, 5 aa, synthetic construct
  REGION 1..5: note = Synthetic Construct
KEPDK

SEQ ID NO: 3773 - protein, 5 aa, synthetic construct
  REGION 1..5: note = Synthetic Construct
KEPEK

SEQ ID NO: 3774 - protein, 5 aa, synthetic construct
  REGION 1..5: note = Synthetic Construct
KEPFK

SEQ ID NO: 3775 - protein, 5 aa, synthetic construct
  REGION 1..5: note = Synthetic Construct
KEPGK

SEQ ID NO: 3776 - protein, 5 aa, synthetic construct
  REGION 1..5: note = Synthetic Construct
KEPHK

SEQ ID NO: 3777 - protein, 5 aa, synthetic construct
  REGION 1..5: note = Synthetic Construct
KEPIK

SEQ ID NO: 3778 - protein, 5 aa, synthetic construct
  REGION 1..5: note = Synthetic Construct
KEPLK

SEQ ID NO: 3779 - protein, 5 aa, synthetic construct
  REGION 1..5: note = Synthetic Construct
KEPNK

SEQ ID NO: 3780 - protein, 5 aa, synthetic construct
  REGION 1..5: note = Synthetic Construct
KEPQK

SEQ ID NO: 3781 - protein, 5 aa, synthetic construct
  REGION 1..5: note = Synthetic Construct
KEPRK

SEQ ID NO: 3782 - protein, 5 aa, synthetic construct
  REGION 1..5: note = Synthetic Construct
KEPSK

SEQ ID NO: 3783 - protein, 5 aa, synthetic construct
  REGION 1..5: note = Synthetic Construct
KEPTK

SEQ ID NO: 3784 - protein, 5 aa, synthetic construct
  REGION 1..5: note = Synthetic Construct
KEPYK

SEQ ID NO: 3785 - protein, 5 aa, synthetic construct
  REGION 1..5: note = Synthetic Construct
KEQAK

SEQ ID NO: 3786 - protein, 5 aa, synthetic construct
  REGION 1..5: note = Synthetic Construct
KEQDK

SEQ ID NO: 3787 - protein, 5 aa, synthetic construct
  REGION 1..5: note = Synthetic Construct
KEQEK

SEQ ID NO: 3788 - protein, 5 aa, synthetic construct
  REGION 1..5: note = Synthetic Construct
KEQFK

SEQ ID NO: 3789 - protein, 5 aa, synthetic construct
  REGION 1..5: note = Synthetic Construct
KEQGK

SEQ ID NO: 3790 - protein, 5 aa, synthetic construct
  REGION 1..5: note = Synthetic Construct
KEQHK

SEQ ID NO: 3791 - protein, 5 aa, synthetic construct
  REGION 1..5: note = Synthetic Construct
KEQIK

SEQ ID NO: 3792 - protein, 5 aa, synthetic construct
  REGION 1..5: note = Synthetic Construct
KEQLK

SEQ ID NO: 3793 - protein, 5 aa, synthetic construct
  REGION 1..5: note = Synthetic Construct
KEQNK

SEQ ID NO: 3794 - protein, 5 aa, synthetic construct
  REGION 1..5: note = Synthetic Construct
KEQQK

SEQ ID NO: 3795 - protein, 5 aa, synthetic construct
  REGION 1..5: note = Synthetic Construct
KEQRK

SEQ ID NO: 3796 - protein, 5 aa, synthetic construct
  REGION 1..5: note = Synthetic Construct
KEQSK

SEQ ID NO: 3797 - protein, 5 aa, synthetic construct
  REGION 1..5: note = Synthetic Construct
KEQTK

SEQ ID NO: 3798 - protein, 5 aa, synthetic construct
  REGION 1..5: note = Synthetic Construct
KEQYK

SEQ ID NO: 3799 - protein, 5 aa, synthetic construct
  REGION 1..5: note = Synthetic Construct
KERAK

SEQ ID NO: 3800 - protein, 5 aa, synthetic construct
  REGION 1..5: note = Synthetic Construct
KERDK

SEQ ID NO: 3801 - protein, 5 aa, synthetic construct
  REGION 1..5: note = Synthetic Construct
KEREK

SEQ ID NO: 3802 - protein, 5 aa, synthetic construct
  REGION 1..5: note = Synthetic Construct
KERFK

SEQ ID NO: 3803 - protein, 5 aa, synthetic construct
  REGION 1..5: note = Synthetic Construct
KERGK

SEQ ID NO: 3804 - protein, 5 aa, synthetic construct
  REGION 1..5: note = Synthetic Construct
KERHK

SEQ ID NO: 3805 - protein, 5 aa, synthetic construct
  REGION 1..5: note = Synthetic Construct
KERIK

SEQ ID NO: 3806 - protein, 5 aa, synthetic construct
  REGION 1..5: note = Synthetic Construct
KERLK

SEQ ID NO: 3807 - protein, 5 aa, synthetic construct
  REGION 1..5: note = Synthetic Construct
KERNK

SEQ ID NO: 3808 - protein, 5 aa, synthetic construct
  REGION 1..5: note = Synthetic Construct
KERQK

SEQ ID NO: 3809 - protein, 5 aa, synthetic construct
  REGION 1..5: note = Synthetic Construct
KERRK

SEQ ID NO: 3810 - protein, 5 aa, synthetic construct
  REGION 1..5: note = Synthetic Construct
KERSK

SEQ ID NO: 3811 - protein, 5 aa, synthetic construct
  REGION 1..5: note = Synthetic Construct
KERTK

SEQ ID NO: 3812 - protein, 5 aa, synthetic construct
  REGION 1..5: note = Synthetic Construct
KERYK

SEQ ID NO: 3813 - protein, 5 aa, synthetic construct
  REGION 1..5: note = Synthetic Construct
KESAK

SEQ ID NO: 3814 - protein, 5 aa, synthetic construct
  REGION 1..5: note = Synthetic Construct
KESDK

SEQ ID NO: 3815 - protein, 5 aa, synthetic construct
  REGION 1..5: note = Synthetic Construct
KESEK

SEQ ID NO: 3816 - protein, 5 aa, synthetic construct
  REGION 1..5: note = Synthetic Construct
KESFK

SEQ ID NO: 3817 - protein, 5 aa, synthetic construct
  REGION 1..5: note = Synthetic Construct
KESGK

SEQ ID NO: 3818 - protein, 5 aa, synthetic construct
  REGION 1..5: note = Synthetic Construct
KESHK

SEQ ID NO: 3819 - protein, 5 aa, synthetic construct
  REGION 1..5: note = Synthetic Construct
KESIK

SEQ ID NO: 3820 - protein, 5 aa, synthetic construct
  REGION 1..5: note = Synthetic Construct
KESLK

SEQ ID NO: 3821 - protein, 5 aa, synthetic construct
  REGION 1..5: note = Synthetic Construct
KESNK

SEQ ID NO: 3822 - protein, 5 aa, synthetic construct
  REGION 1..5: note = Synthetic Construct
KESQK

SEQ ID NO: 3823 - protein, 5 aa, synthetic construct
  REGION 1..5: note = Synthetic Construct
KESRK

SEQ ID NO: 3824 - protein, 5 aa, synthetic construct
  REGION 1..5: note = Synthetic Construct
KESSK

SEQ ID NO: 3825 - protein, 5 aa, synthetic construct
  REGION 1..5: note = Synthetic Construct
KESTK

SEQ ID NO: 3826 - protein, 5 aa, synthetic construct
  REGION 1..5: note = Synthetic Construct
KESYK

SEQ ID NO: 3827 - protein, 5 aa, synthetic construct
  REGION 1..5: note = Synthetic Construct
KETAK

SEQ ID NO: 3828 - protein, 5 aa, synthetic construct
  REGION 1..5: note = Synthetic Construct
KETDK

SEQ ID NO: 3829 - protein, 5 aa, synthetic construct
  REGION 1..5: note = Synthetic Construct
KETEK

SEQ ID NO: 3830 - protein, 5 aa, synthetic construct
  REGION 1..5: note = Synthetic Construct
KETFK

SEQ ID NO: 3831 - protein, 5 aa, synthetic construct
  REGION 1..5: note = Synthetic Construct
KETGK

SEQ ID NO: 3832 - protein, 5 aa, synthetic construct
  REGION 1..5: note = Synthetic Construct
KETHK

SEQ ID NO: 3833 - protein, 5 aa, synthetic construct
  REGION 1..5: note = Synthetic Construct
KETIK

SEQ ID NO: 3834 - protein, 5 aa, synthetic construct
  REGION 1..5: note = Synthetic Construct
KETLK

SEQ ID NO: 3835 - protein, 5 aa, synthetic construct
  REGION 1..5: note = Synthetic Construct
KETNK

SEQ ID NO: 3836 - protein, 5 aa, synthetic construct
  REGION 1..5: note = Synthetic Construct
KETQK

SEQ ID NO: 3837 - protein, 5 aa, synthetic construct
  REGION 1..5: note = Synthetic Construct
KETRK

SEQ ID NO: 3838 - protein, 5 aa, synthetic construct
  REGION 1..5: note = Synthetic Construct
KETSK

SEQ ID NO: 3839 - protein, 5 aa, synthetic construct
  REGION 1..5: note = Synthetic Construct
KETTK

SEQ ID NO: 3840 - protein, 5 aa, synthetic construct
  REGION 1..5: note = Synthetic Construct
KETYK

SEQ ID NO: 3841 - protein, 5 aa, synthetic construct
  REGION 1..5: note = Synthetic Construct
KEYAK

SEQ ID NO: 3842 - protein, 5 aa, synthetic construct
  REGION 1..5: note = Synthetic Construct
KEYDK

SEQ ID NO: 3843 - protein, 5 aa, synthetic construct
  REGION 1..5: note = Synthetic Construct
KEYEK

SEQ ID NO: 3844 - protein, 5 aa, synthetic construct
  REGION 1..5: note = Synthetic Construct
KEYFK

SEQ ID NO: 3845 - protein, 5 aa, synthetic construct
  REGION 1..5: note = Synthetic Construct
KEYGK

SEQ ID NO: 3846 - protein, 5 aa, synthetic construct
  REGION 1..5: note = Synthetic Construct
KEYHK

SEQ ID NO: 3847 - protein, 5 aa, synthetic construct
  REGION 1..5: note = Synthetic Construct
KEYIK

SEQ ID NO: 3848 - protein, 5 aa, synthetic construct
  REGION 1..5: note = Synthetic Construct
KEYLK

SEQ ID NO: 3849 - protein, 5 aa, synthetic construct
  REGION 1..5: note = Synthetic Construct
KEYNK

SEQ ID NO: 3850 - protein, 5 aa, synthetic construct
  REGION 1..5: note = Synthetic Construct
KEYQK

SEQ ID NO: 3851 - protein, 5 aa, synthetic construct
  REGION 1..5: note = Synthetic Construct
KEYRK

SEQ ID NO: 3852 - protein, 5 aa, synthetic construct
  REGION 1..5: note = Synthetic Construct
KEYSK

SEQ ID NO: 3853 - protein, 5 aa, synthetic construct
  REGION 1..5: note = Synthetic Construct
KEYTK

SEQ ID NO: 3854 - protein, 5 aa, synthetic construct
  REGION 1..5: note = Synthetic Construct
KEYYK

SEQ ID NO: 3855 - protein, 5 aa, synthetic construct
  REGION 1..5: note = Synthetic Construct
KFAAK

SEQ ID NO: 3856 - protein, 5 aa, synthetic construct
  REGION 1..5: note = Synthetic Construct
KFADK

SEQ ID NO: 3857 - protein, 5 aa, synthetic construct
  REGION 1..5: note = Synthetic Construct
KFAEK

SEQ ID NO: 3858 - protein, 5 aa, synthetic construct
  REGION 1..5: note = Synthetic Construct
KFAFK

SEQ ID NO: 3859 - protein, 5 aa, synthetic construct
  REGION 1..5: note = Synthetic Construct
KFAGK

SEQ ID NO: 3860 - protein, 5 aa, synthetic construct
  REGION 1..5: note = Synthetic Construct
KFAHK

SEQ ID NO: 3861 - protein, 5 aa, synthetic construct
  REGION 1..5: note = Synthetic Construct
KFAIK

SEQ ID NO: 3862 - protein, 5 aa, synthetic construct
  REGION 1..5: note = Synthetic Construct
KFALK

SEQ ID NO: 3863 - protein, 5 aa, synthetic construct
  REGION 1..5: note = Synthetic Construct
KFANK

SEQ ID NO: 3864 - protein, 5 aa, synthetic construct
  REGION 1..5: note = Synthetic Construct
KFAQK

SEQ ID NO: 3865 - protein, 5 aa, synthetic construct
  REGION 1..5: note = Synthetic Construct
KFARK

SEQ ID NO: 3866 - protein, 5 aa, synthetic construct
  REGION 1..5: note = Synthetic Construct
KFASK

SEQ ID NO: 3867 - protein, 5 aa, synthetic construct
  REGION 1..5: note = Synthetic Construct
KFATK

SEQ ID NO: 3868 - protein, 5 aa, synthetic construct
  REGION 1..5: note = Synthetic Construct
KFAYK

SEQ ID NO: 3869 - protein, 5 aa, synthetic construct
  REGION 1..5: note = Synthetic Construct
KFDAK

SEQ ID NO: 3870 - protein, 5 aa, synthetic construct
  REGION 1..5: note = Synthetic Construct
KFDDK

SEQ ID NO: 3871 - protein, 5 aa, synthetic construct
  REGION 1..5: note = Synthetic Construct
KFDEK

SEQ ID NO: 3872 - protein, 5 aa, synthetic construct
  REGION 1..5: note = Synthetic Construct
KFDFK

SEQ ID NO: 3873 - protein, 5 aa, synthetic construct
  REGION 1..5: note = Synthetic Construct
KFDGK

SEQ ID NO: 3874 - protein, 5 aa, synthetic construct
  REGION 1..5: note = Synthetic Construct
KFDHK

SEQ ID NO: 3875 - protein, 5 aa, synthetic construct
  REGION 1..5: note = Synthetic Construct
KFDIK

SEQ ID NO: 3876 - protein, 5 aa, synthetic construct
  REGION 1..5: note = Synthetic Construct
KFDLK

SEQ ID NO: 3877 - protein, 5 aa, synthetic construct
  REGION 1..5: note = Synthetic Construct
KFDNK

SEQ ID NO: 3878 - protein, 5 aa, synthetic construct
  REGION 1..5: note = Synthetic Construct
KFDQK

SEQ ID NO: 3879 - protein, 5 aa, synthetic construct
  REGION 1..5: note = Synthetic Construct
KFDRK

SEQ ID NO: 3880 - protein, 5 aa, synthetic construct
  REGION 1..5: note = Synthetic Construct
KFDSK

SEQ ID NO: 3881 - protein, 5 aa, synthetic construct
  REGION 1..5: note = Synthetic Construct
KFDTK

SEQ ID NO: 3882 - protein, 5 aa, synthetic construct
  REGION 1..5: note = Synthetic Construct
KFDYK

SEQ ID NO: 3883 - protein, 5 aa, synthetic construct
  REGION 1..5: note = Synthetic Construct
KFEAK

SEQ ID NO: 3884 - protein, 5 aa, synthetic construct
  REGION 1..5: note = Synthetic Construct
KFEDK

SEQ ID NO: 3885 - protein, 5 aa, synthetic construct
  REGION 1..5: note = Synthetic Construct
KFEEK

SEQ ID NO: 3886 - protein, 5 aa, synthetic construct
  REGION 1..5: note = Synthetic Construct
KFEFK

SEQ ID NO: 3887 - protein, 5 aa, synthetic construct
  REGION 1..5: note = Synthetic Construct
KFEGK

SEQ ID NO: 3888 - protein, 5 aa, synthetic construct
  REGION 1..5: note = Synthetic Construct
KFEHK

SEQ ID NO: 3889 - protein, 5 aa, synthetic construct
  REGION 1..5: note = Synthetic Construct
KFEIK

SEQ ID NO: 3890 - protein, 5 aa, synthetic construct
  REGION 1..5: note = Synthetic Construct
KFELK

SEQ ID NO: 3891 - protein, 5 aa, synthetic construct
  REGION 1..5: note = Synthetic Construct
KFENK

SEQ ID NO: 3892 - protein, 5 aa, synthetic construct
  REGION 1..5: note = Synthetic Construct
KFEQK

SEQ ID NO: 3893 - protein, 5 aa, synthetic construct
  REGION 1..5: note = Synthetic Construct
KFERK

SEQ ID NO: 3894 - protein, 5 aa, synthetic construct
  REGION 1..5: note = Synthetic Construct
KFESK

SEQ ID NO: 3895 - protein, 5 aa, synthetic construct
  REGION 1..5: note = Synthetic Construct
KFETK

SEQ ID NO: 3896 - protein, 5 aa, synthetic construct
  REGION 1..5: note = Synthetic Construct
KFEYK

SEQ ID NO: 3897 - protein, 5 aa, synthetic construct
  REGION 1..5: note = Synthetic Construct
KFFAK

SEQ ID NO: 3898 - protein, 5 aa, synthetic construct
  REGION 1..5: note = Synthetic Construct
KFFDK

SEQ ID NO: 3899 - protein, 5 aa, synthetic construct
  REGION 1..5: note = Synthetic Construct
KFFEK

SEQ ID NO: 3900 - protein, 5 aa, synthetic construct
  REGION 1..5: note = Synthetic Construct
KFFFK

SEQ ID NO: 3901 - protein, 5 aa, synthetic construct
  REGION 1..5: note = Synthetic Construct
KFFGK

SEQ ID NO: 3902 - protein, 5 aa, synthetic construct
  REGION 1..5: note = Synthetic Construct
KFFHK

SEQ ID NO: 3903 - protein, 5 aa, synthetic construct
  REGION 1..5: note = Synthetic Construct
KFFIK

SEQ ID NO: 3904 - protein, 5 aa, synthetic construct
  REGION 1..5: note = Synthetic Construct
KFFLK

SEQ ID NO: 3905 - protein, 5 aa, synthetic construct
  REGION 1..5: note = Synthetic Construct
KFFNK

SEQ ID NO: 3906 - protein, 5 aa, synthetic construct
  REGION 1..5: note = Synthetic Construct
KFFQK

SEQ ID NO: 3907 - protein, 5 aa, synthetic construct
  REGION 1..5: note = Synthetic Construct
KFFRK

SEQ ID NO: 3908 - protein, 5 aa, synthetic construct
  REGION 1..5: note = Synthetic Construct
KFFSK

SEQ ID NO: 3909 - protein, 5 aa, synthetic construct
  REGION 1..5: note = Synthetic Construct
KFFTK

SEQ ID NO: 3910 - protein, 5 aa, synthetic construct
  REGION 1..5: note = Synthetic Construct
KFFYK

SEQ ID NO: 3911 - protein, 5 aa, synthetic construct
  REGION 1..5: note = Synthetic Construct
KFGAK

SEQ ID NO: 3912 - protein, 5 aa, synthetic construct
  REGION 1..5: note = Synthetic Construct
KFGDK

SEQ ID NO: 3913 - protein, 5 aa, synthetic construct
  REGION 1..5: note = Synthetic Construct
KFGEK

SEQ ID NO: 3914 - protein, 5 aa, synthetic construct
  REGION 1..5: note = Synthetic Construct
KFGFK

SEQ ID NO: 3915 - protein, 5 aa, synthetic construct
  REGION 1..5: note = Synthetic Construct
KFGGK

SEQ ID NO: 3916 - protein, 5 aa, synthetic construct
  REGION 1..5: note = Synthetic Construct
KFGHK

SEQ ID NO: 3917 - protein, 5 aa, synthetic construct
  REGION 1..5: note = Synthetic Construct
KFGIK

SEQ ID NO: 3918 - protein, 5 aa, synthetic construct
  REGION 1..5: note = Synthetic Construct
KFGLK

SEQ ID NO: 3919 - protein, 5 aa, synthetic construct
  REGION 1..5: note = Synthetic Construct
KFGNK

SEQ ID NO: 3920 - protein, 5 aa, synthetic construct
  REGION 1..5: note = Synthetic Construct
KFGQK

SEQ ID NO: 3921 - protein, 5 aa, synthetic construct
  REGION 1..5: note = Synthetic Construct
KFGRK

SEQ ID NO: 3922 - protein, 5 aa, synthetic construct
  REGION 1..5: note = Synthetic Construct
KFGSK

SEQ ID NO: 3923 - protein, 5 aa, synthetic construct
  REGION 1..5: note = Synthetic Construct
KFGTK

SEQ ID NO: 3924 - protein, 5 aa, synthetic construct
  REGION 1..5: note = Synthetic Construct
KFGYK

SEQ ID NO: 3925 - protein, 5 aa, synthetic construct
  REGION 1..5: note = Synthetic Construct
KFHAK

SEQ ID NO: 3926 - protein, 5 aa, synthetic construct
  REGION 1..5: note = Synthetic Construct
KFHDK

SEQ ID NO: 3927 - protein, 5 aa, synthetic construct
  REGION 1..5: note = Synthetic Construct
KFHEK

SEQ ID NO: 3928 - protein, 5 aa, synthetic construct
  REGION 1..5: note = Synthetic Construct
KFHFK

SEQ ID NO: 3929 - protein, 5 aa, synthetic construct
  REGION 1..5: note = Synthetic Construct
KFHGK

SEQ ID NO: 3930 - protein, 5 aa, synthetic construct
  REGION 1..5: note = Synthetic Construct
KFHHK

SEQ ID NO: 3931 - protein, 5 aa, synthetic construct
  REGION 1..5: note = Synthetic Construct
KFHIK

SEQ ID NO: 3932 - protein, 5 aa, synthetic construct
  REGION 1..5: note = Synthetic Construct
KFHLK

SEQ ID NO: 3933 - protein, 5 aa, synthetic construct
  REGION 1..5: note = Synthetic Construct
KFHNK

SEQ ID NO: 3934 - protein, 5 aa, synthetic construct
  REGION 1..5: note = Synthetic Construct
KFHQK

SEQ ID NO: 3935 - protein, 5 aa, synthetic construct
  REGION 1..5: note = Synthetic Construct
KFHRK

SEQ ID NO: 3936 - protein, 5 aa, synthetic construct
  REGION 1..5: note = Synthetic Construct
KFHSK

SEQ ID NO: 3937 - protein, 5 aa, synthetic construct
  REGION 1..5: note = Synthetic Construct
KFHTK

SEQ ID NO: 3938 - protein, 5 aa, synthetic construct
  REGION 1..5: note = Synthetic Construct
KFHYK

SEQ ID NO: 3939 - protein, 5 aa, synthetic construct
  REGION 1..5: note = Synthetic Construct
KFIAK

SEQ ID NO: 3940 - protein, 5 aa, synthetic construct
  REGION 1..5: note = Synthetic Construct
KFIDK

SEQ ID NO: 3941 - protein, 5 aa, synthetic construct
  REGION 1..5: note = Synthetic Construct
KFIEK

SEQ ID NO: 3942 - protein, 5 aa, synthetic construct
  REGION 1..5: note = Synthetic Construct
KFIFK

SEQ ID NO: 3943 - protein, 5 aa, synthetic construct
  REGION 1..5: note = Synthetic Construct
KFIGK

SEQ ID NO: 3944 - protein, 5 aa, synthetic construct
  REGION 1..5: note = Synthetic Construct
KFIHK

SEQ ID NO: 3945 - protein, 5 aa, synthetic construct
  REGION 1..5: note = Synthetic Construct
KFIIK

SEQ ID NO: 3946 - protein, 5 aa, synthetic construct
  REGION 1..5: note = Synthetic Construct
KFILK

SEQ ID NO: 3947 - protein, 5 aa, synthetic construct
  REGION 1..5: note = Synthetic Construct
KFINK

SEQ ID NO: 3948 - protein, 5 aa, synthetic construct
  REGION 1..5: note = Synthetic Construct
KFIQK

SEQ ID NO: 3949 - protein, 5 aa, synthetic construct
  REGION 1..5: note = Synthetic Construct
KFIRK

SEQ ID NO: 3950 - protein, 5 aa, synthetic construct
  REGION 1..5: note = Synthetic Construct
KFISK

SEQ ID NO: 3951 - protein, 5 aa, synthetic construct
  REGION 1..5: note = Synthetic Construct
KFITK

SEQ ID NO: 3952 - protein, 5 aa, synthetic construct
  REGION 1..5: note = Synthetic Construct
KFIYK

SEQ ID NO: 3953 - protein, 5 aa, synthetic construct
  REGION 1..5: note = Synthetic Construct
KFLAK

SEQ ID NO: 3954 - protein, 5 aa, synthetic construct
  REGION 1..5: note = Synthetic Construct
KFLDK

SEQ ID NO: 3955 - protein, 5 aa, synthetic construct
  REGION 1..5: note = Synthetic Construct
KFLEK

SEQ ID NO: 3956 - protein, 5 aa, synthetic construct
  REGION 1..5: note = Synthetic Construct
KFLFK

SEQ ID NO: 3957 - protein, 5 aa, synthetic construct
  REGION 1..5: note = Synthetic Construct
KFLGK

SEQ ID NO: 3958 - protein, 5 aa, synthetic construct
  REGION 1..5: note = Synthetic Construct
KFLHK

SEQ ID NO: 3959 - protein, 5 aa, synthetic construct
  REGION 1..5: note = Synthetic Construct
KFLIK

SEQ ID NO: 3960 - protein, 5 aa, synthetic construct
  REGION 1..5: note = Synthetic Construct
KFLLK

SEQ ID NO: 3961 - protein, 5 aa, synthetic construct
  REGION 1..5: note = Synthetic Construct
KFLNK

SEQ ID NO: 3962 - protein, 5 aa, synthetic construct
  REGION 1..5: note = Synthetic Construct
KFLQK

SEQ ID NO: 3963 - protein, 5 aa, synthetic construct
  REGION 1..5: note = Synthetic Construct
KFLRK

SEQ ID NO: 3964 - protein, 5 aa, synthetic construct
  REGION 1..5: note = Synthetic Construct
KFLSK

SEQ ID NO: 3965 - protein, 5 aa, synthetic construct
  REGION 1..5: note = Synthetic Construct
KFLTK

SEQ ID NO: 3966 - protein, 5 aa, synthetic construct
  REGION 1..5: note = Synthetic Construct
KFLYK

SEQ ID NO: 3967 - protein, 5 aa, synthetic construct
  REGION 1..5: note = Synthetic Construct
KFNAK

SEQ ID NO: 3968 - protein, 5 aa, synthetic construct
  REGION 1..5: note = Synthetic Construct
KFNDK

SEQ ID NO: 3969 - protein, 5 aa, synthetic construct
  REGION 1..5: note = Synthetic Construct
KFNEK

SEQ ID NO: 3970 - protein, 5 aa, synthetic construct
  REGION 1..5: note = Synthetic Construct
KFNFK

SEQ ID NO: 3971 - protein, 5 aa, synthetic construct
  REGION 1..5: note = Synthetic Construct
KFNGK

SEQ ID NO: 3972 - protein, 5 aa, synthetic construct
  REGION 1..5: note = Synthetic Construct
KFNHK

SEQ ID NO: 3973 - protein, 5 aa, synthetic construct
  REGION 1..5: note = Synthetic Construct
KFNIK

SEQ ID NO: 3974 - protein, 5 aa, synthetic construct
  REGION 1..5: note = Synthetic Construct
KFNLK

SEQ ID NO: 3975 - protein, 5 aa, synthetic construct
  REGION 1..5: note = Synthetic Construct
KFNNK

SEQ ID NO: 3976 - protein, 5 aa, synthetic construct
  REGION 1..5: note = Synthetic Construct
KFNQK

SEQ ID NO: 3977 - protein, 5 aa, synthetic construct
  REGION 1..5: note = Synthetic Construct
KFNRK

SEQ ID NO: 3978 - protein, 5 aa, synthetic construct
  REGION 1..5: note = Synthetic Construct
KFNSK

SEQ ID NO: 3979 - protein, 5 aa, synthetic construct
  REGION 1..5: note = Synthetic Construct
KFNTK

SEQ ID NO: 3980 - protein, 5 aa, synthetic construct
  REGION 1..5: note = Synthetic Construct
KFNYK

SEQ ID NO: 3981 - protein, 5 aa, synthetic construct
  REGION 1..5: note = Synthetic Construct
KFPAK

SEQ ID NO: 3982 - protein, 5 aa, synthetic construct
  REGION 1..5: note = Synthetic Construct
KFPDK

SEQ ID NO: 3983 - protein, 5 aa, synthetic construct
  REGION 1..5: note = Synthetic Construct
KFPEK

SEQ ID NO: 3984 - protein, 5 aa, synthetic construct
  REGION 1..5: note = Synthetic Construct
KFPFK

SEQ ID NO: 3985 - protein, 5 aa, synthetic construct
  REGION 1..5: note = Synthetic Construct
KFPGK

SEQ ID NO: 3986 - protein, 5 aa, synthetic construct
  REGION 1..5: note = Synthetic Construct
KFPHK

SEQ ID NO: 3987 - protein, 5 aa, synthetic construct
  REGION 1..5: note = Synthetic Construct
KFPIK

SEQ ID NO: 3988 - protein, 5 aa, synthetic construct
  REGION 1..5: note = Synthetic Construct
KFPLK

SEQ ID NO: 3989 - protein, 5 aa, synthetic construct
  REGION 1..5: note = Synthetic Construct
KFPNK

SEQ ID NO: 3990 - protein, 5 aa, synthetic construct
  REGION 1..5: note = Synthetic Construct
KFPQK

SEQ ID NO: 3991 - protein, 5 aa, synthetic construct
  REGION 1..5: note = Synthetic Construct
KFPRK

SEQ ID NO: 3992 - protein, 5 aa, synthetic construct
  REGION 1..5: note = Synthetic Construct
KFPSK

SEQ ID NO: 3993 - protein, 5 aa, synthetic construct
  REGION 1..5: note = Synthetic Construct
KFPTK

SEQ ID NO: 3994 - protein, 5 aa, synthetic construct
  REGION 1..5: note = Synthetic Construct
KFPYK

SEQ ID NO: 3995 - protein, 5 aa, synthetic construct
  REGION 1..5: note = Synthetic Construct
KFQAK

SEQ ID NO: 3996 - protein, 5 aa, synthetic construct
  REGION 1..5: note = Synthetic Construct
KFQDK

SEQ ID NO: 3997 - protein, 5 aa, synthetic construct
  REGION 1..5: note = Synthetic Construct
KFQEK

SEQ ID NO: 3998 - protein, 5 aa, synthetic construct
  REGION 1..5: note = Synthetic Construct
KFQFK

SEQ ID NO: 3999 - protein, 5 aa, synthetic construct
  REGION 1..5: note = Synthetic Construct
KFQGK

SEQ ID NO: 4000 - protein, 5 aa, synthetic construct
  REGION 1..5: note = Synthetic Construct
KFQHK

SEQ ID NO: 4001 - protein, 5 aa, synthetic construct
  REGION 1..5: note = Synthetic Construct
KFQIK

SEQ ID NO: 4002 - protein, 5 aa, synthetic construct
  REGION 1..5: note = Synthetic Construct
KFQLK

SEQ ID NO: 4003 - protein, 5 aa, synthetic construct
  REGION 1..5: note = Synthetic Construct
KFQNK

SEQ ID NO: 4004 - protein, 5 aa, synthetic construct
  REGION 1..5: note = Synthetic Construct
KFQQK

SEQ ID NO: 4005 - protein, 5 aa, synthetic construct
  REGION 1..5: note = Synthetic Construct
KFQRK

SEQ ID NO: 4006 - protein, 5 aa, synthetic construct
  REGION 1..5: note = Synthetic Construct
KFQSK

SEQ ID NO: 4007 - protein, 5 aa, synthetic construct
  REGION 1..5: note = Synthetic Construct
KFQTK

SEQ ID NO: 4008 - protein, 5 aa, synthetic construct
  REGION 1..5: note = Synthetic Construct
KFQYK

SEQ ID NO: 4009 - protein, 5 aa, synthetic construct
  REGION 1..5: note = Synthetic Construct
KFRAK

SEQ ID NO: 4010 - protein, 5 aa, synthetic construct
  REGION 1..5: note = Synthetic Construct
KFRDK

SEQ ID NO: 4011 - protein, 5 aa, synthetic construct
  REGION 1..5: note = Synthetic Construct
KFREK

SEQ ID NO: 4012 - protein, 5 aa, synthetic construct
  REGION 1..5: note = Synthetic Construct
KFRFK

SEQ ID NO: 4013 - protein, 5 aa, synthetic construct
  REGION 1..5: note = Synthetic Construct
KFRGK

SEQ ID NO: 4014 - protein, 5 aa, synthetic construct
  REGION 1..5: note = Synthetic Construct
KFRHK

SEQ ID NO: 4015 - protein, 5 aa, synthetic construct
  REGION 1..5: note = Synthetic Construct
KFRIK

SEQ ID NO: 4016 - protein, 5 aa, synthetic construct
  REGION 1..5: note = Synthetic Construct
KFRLK

SEQ ID NO: 4017 - protein, 5 aa, synthetic construct
  REGION 1..5: note = Synthetic Construct
KFRNK

SEQ ID NO: 4018 - protein, 5 aa, synthetic construct
  REGION 1..5: note = Synthetic Construct
KFRQK

SEQ ID NO: 4019 - protein, 5 aa, synthetic construct
  REGION 1..5: note = Synthetic Construct
KFRRK

SEQ ID NO: 4020 - protein, 5 aa, synthetic construct
  REGION 1..5: note = Synthetic Construct
KFRSK

SEQ ID NO: 4021 - protein, 5 aa, synthetic construct
  REGION 1..5: note = Synthetic Construct
KFRTK

SEQ ID NO: 4022 - protein, 5 aa, synthetic construct
  REGION 1..5: note = Synthetic Construct
KFRYK

SEQ ID NO: 4023 - protein, 5 aa, synthetic construct
  REGION 1..5: note = Synthetic Construct
KFSAK

SEQ ID NO: 4024 - protein, 5 aa, synthetic construct
  REGION 1..5: note = Synthetic Construct
KFSDK

SEQ ID NO: 4025 - protein, 5 aa, synthetic construct
  REGION 1..5: note = Synthetic Construct
KFSEK

SEQ ID NO: 4026 - protein, 5 aa, synthetic construct
  REGION 1..5: note = Synthetic Construct
KFSFK

SEQ ID NO: 4027 - protein, 5 aa, synthetic construct
  REGION 1..5: note = Synthetic Construct
KFSGK

SEQ ID NO: 4028 - protein, 5 aa, synthetic construct
  REGION 1..5: note = Synthetic Construct
KFSHK

SEQ ID NO: 4029 - protein, 5 aa, synthetic construct
  REGION 1..5: note = Synthetic Construct
KFSIK

SEQ ID NO: 4030 - protein, 5 aa, synthetic construct
  REGION 1..5: note = Synthetic Construct
KFSLK

SEQ ID NO: 4031 - protein, 5 aa, synthetic construct
  REGION 1..5: note = Synthetic Construct
KFSNK

SEQ ID NO: 4032 - protein, 5 aa, synthetic construct
  REGION 1..5: note = Synthetic Construct
KFSQK

SEQ ID NO: 4033 - protein, 5 aa, synthetic construct
  REGION 1..5: note = Synthetic Construct
KFSRK

SEQ ID NO: 4034 - protein, 5 aa, synthetic construct
  REGION 1..5: note = Synthetic Construct
KFSSK

SEQ ID NO: 4035 - protein, 5 aa, synthetic construct
  REGION 1..5: note = Synthetic Construct
KFSTK

SEQ ID NO: 4036 - protein, 5 aa, synthetic construct
  REGION 1..5: note = Synthetic Construct
KFSYK

SEQ ID NO: 4037 - protein, 5 aa, synthetic construct
  REGION 1..5: note = Synthetic Construct
KFTAK

SEQ ID NO: 4038 - protein, 5 aa, synthetic construct
  REGION 1..5: note = Synthetic Construct
KFTDK

SEQ ID NO: 4039 - protein, 5 aa, synthetic construct
  REGION 1..5: note = Synthetic Construct
KFTEK

SEQ ID NO: 4040 - protein, 5 aa, synthetic construct
  REGION 1..5: note = Synthetic Construct
KFTFK

SEQ ID NO: 4041 - protein, 5 aa, synthetic construct
  REGION 1..5: note = Synthetic Construct
KFTGK

SEQ ID NO: 4042 - protein, 5 aa, synthetic construct
  REGION 1..5: note = Synthetic Construct
KFTHK

SEQ ID NO: 4043 - protein, 5 aa, synthetic construct
  REGION 1..5: note = Synthetic Construct
KFTIK

SEQ ID NO: 4044 - protein, 5 aa, synthetic construct
  REGION 1..5: note = Synthetic Construct
KFTLK

SEQ ID NO: 4045 - protein, 5 aa, synthetic construct
  REGION 1..5: note = Synthetic Construct
KFTNK

SEQ ID NO: 4046 - protein, 5 aa, synthetic construct
  REGION 1..5: note = Synthetic Construct
KFTQK

SEQ ID NO: 4047 - protein, 5 aa, synthetic construct
  REGION 1..5: note = Synthetic Construct
KFTRK

SEQ ID NO: 4048 - protein, 5 aa, synthetic construct
  REGION 1..5: note = Synthetic Construct
KFTSK

SEQ ID NO: 4049 - protein, 5 aa, synthetic construct
  REGION 1..5: note = Synthetic Construct
KFTTK

SEQ ID NO: 4050 - protein, 5 aa, synthetic construct
  REGION 1..5: note = Synthetic Construct
KFTYK

SEQ ID NO: 4051 - protein, 5 aa, synthetic construct
  REGION 1..5: note = Synthetic Construct
KFYAK

SEQ ID NO: 4052 - protein, 5 aa, synthetic construct
  REGION 1..5: note = Synthetic Construct
KFYDK

SEQ ID NO: 4053 - protein, 5 aa, synthetic construct
  REGION 1..5: note = Synthetic Construct
KFYEK

SEQ ID NO: 4054 - protein, 5 aa, synthetic construct
  REGION 1..5: note = Synthetic Construct
KFYFK

SEQ ID NO: 4055 - protein, 5 aa, synthetic construct
  REGION 1..5: note = Synthetic Construct
KFYGK

SEQ ID NO: 4056 - protein, 5 aa, synthetic construct
  REGION 1..5: note = Synthetic Construct
KFYHK

SEQ ID NO: 4057 - protein, 5 aa, synthetic construct
  REGION 1..5: note = Synthetic Construct
KFYIK

SEQ ID NO: 4058 - protein, 5 aa, synthetic construct
  REGION 1..5: note = Synthetic Construct
KFYLK

SEQ ID NO: 4059 - protein, 5 aa, synthetic construct
  REGION 1..5: note = Synthetic Construct
KFYNK

SEQ ID NO: 4060 - protein, 5 aa, synthetic construct
  REGION 1..5: note = Synthetic Construct
KFYQK

SEQ ID NO: 4061 - protein, 5 aa, synthetic construct
  REGION 1..5: note = Synthetic Construct
KFYRK

SEQ ID NO: 4062 - protein, 5 aa, synthetic construct
  REGION 1..5: note = Synthetic Construct
KFYSK

SEQ ID NO: 4063 - protein, 5 aa, synthetic construct
  REGION 1..5: note = Synthetic Construct
KFYTK

SEQ ID NO: 4064 - protein, 5 aa, synthetic construct
  REGION 1..5: note = Synthetic Construct
KFYYK

SEQ ID NO: 4065 - protein, 5 aa, synthetic construct
  REGION 1..5: note = Synthetic Construct
KGAAK

SEQ ID NO: 4066 - protein, 5 aa, synthetic construct
  REGION 1..5: note = Synthetic Construct
KGADK

SEQ ID NO: 4067 - protein, 5 aa, synthetic construct
  REGION 1..5: note = Synthetic Construct
KGAEK

SEQ ID NO: 4068 - protein, 5 aa, synthetic construct
  REGION 1..5: note = Synthetic Construct
KGAFK

SEQ ID NO: 4069 - protein, 5 aa, synthetic construct
  REGION 1..5: note = Synthetic Construct
KGAGK

SEQ ID NO: 4070 - protein, 5 aa, synthetic construct
  REGION 1..5: note = Synthetic Construct
KGAHK

SEQ ID NO: 4071 - protein, 5 aa, synthetic construct
  REGION 1..5: note = Synthetic Construct
KGAIK

SEQ ID NO: 4072 - protein, 5 aa, synthetic construct
  REGION 1..5: note = Synthetic Construct
KGALK

SEQ ID NO: 4073 - protein, 5 aa, synthetic construct
  REGION 1..5: note = Synthetic Construct
KGANK

SEQ ID NO: 4074 - protein, 5 aa, synthetic construct
  REGION 1..5: note = Synthetic Construct
KGAQK

SEQ ID NO: 4075 - protein, 5 aa, synthetic construct
  REGION 1..5: note = Synthetic Construct
KGARK

SEQ ID NO: 4076 - protein, 5 aa, synthetic construct
  REGION 1..5: note = Synthetic Construct
KGASK

SEQ ID NO: 4077 - protein, 5 aa, synthetic construct
  REGION 1..5: note = Synthetic Construct
KGATK

SEQ ID NO: 4078 - protein, 5 aa, synthetic construct
  REGION 1..5: note = Synthetic Construct
KGAYK

SEQ ID NO: 4079 - protein, 5 aa, synthetic construct
  REGION 1..5: note = Synthetic Construct
KGDAK

SEQ ID NO: 4080 - protein, 5 aa, synthetic construct
  REGION 1..5: note = Synthetic Construct
KGDDK

SEQ ID NO: 4081 - protein, 5 aa, synthetic construct
  REGION 1..5: note = Synthetic Construct
KGDEK

SEQ ID NO: 4082 - protein, 5 aa, synthetic construct
  REGION 1..5: note = Synthetic Construct
KGDFK

SEQ ID NO: 4083 - protein, 5 aa, synthetic construct
  REGION 1..5: note = Synthetic Construct
KGDGK

SEQ ID NO: 4084 - protein, 5 aa, synthetic construct
  REGION 1..5: note = Synthetic Construct
KGDHK

SEQ ID NO: 4085 - protein, 5 aa, synthetic construct
  REGION 1..5: note = Synthetic Construct
KGDIK

SEQ ID NO: 4086 - protein, 5 aa, synthetic construct
  REGION 1..5: note = Synthetic Construct
KGDLK

SEQ ID NO: 4087 - protein, 5 aa, synthetic construct
  REGION 1..5: note = Synthetic Construct
KGDNK

SEQ ID NO: 4088 - protein, 5 aa, synthetic construct
  REGION 1..5: note = Synthetic Construct
KGDQK

SEQ ID NO: 4089 - protein, 5 aa, synthetic construct
  REGION 1..5: note = Synthetic Construct
KGDRK

SEQ ID NO: 4090 - protein, 5 aa, synthetic construct
  REGION 1..5: note = Synthetic Construct
KGDSK

SEQ ID NO: 4091 - protein, 5 aa, synthetic construct
  REGION 1..5: note = Synthetic Construct
KGDTK

SEQ ID NO: 4092 - protein, 5 aa, synthetic construct
  REGION 1..5: note = Synthetic Construct
KGDYK

SEQ ID NO: 4093 - protein, 5 aa, synthetic construct
  REGION 1..5: note = Synthetic Construct
KGEAK

SEQ ID NO: 4094 - protein, 5 aa, synthetic construct
  REGION 1..5: note = Synthetic Construct
KGEDK

SEQ ID NO: 4095 - protein, 5 aa, synthetic construct
  REGION 1..5: note = Synthetic Construct
KGEEK

SEQ ID NO: 4096 - protein, 5 aa, synthetic construct
  REGION 1..5: note = Synthetic Construct
KGEFK

SEQ ID NO: 4097 - protein, 5 aa, synthetic construct
  REGION 1..5: note = Synthetic Construct
KGEGK

SEQ ID NO: 4098 - protein, 5 aa, synthetic construct
  REGION 1..5: note = Synthetic Construct
KGEHK

SEQ ID NO: 4099 - protein, 5 aa, synthetic construct
  REGION 1..5: note = Synthetic Construct
KGEIK

SEQ ID NO: 4100 - protein, 5 aa, synthetic construct
  REGION 1..5: note = Synthetic Construct
KGELK

SEQ ID NO: 4101 - protein, 5 aa, synthetic construct
  REGION 1..5: note = Synthetic Construct
KGENK

SEQ ID NO: 4102 - protein, 5 aa, synthetic construct
  REGION 1..5: note = Synthetic Construct
KGEQK

SEQ ID NO: 4103 - protein, 5 aa, synthetic construct
  REGION 1..5: note = Synthetic Construct
KGERK

SEQ ID NO: 4104 - protein, 5 aa, synthetic construct
  REGION 1..5: note = Synthetic Construct
KGESK

SEQ ID NO: 4105 - protein, 5 aa, synthetic construct
  REGION 1..5: note = Synthetic Construct
KGETK

SEQ ID NO: 4106 - protein, 5 aa, synthetic construct
  REGION 1..5: note = Synthetic Construct
KGEYK

SEQ ID NO: 4107 - protein, 5 aa, synthetic construct
  REGION 1..5: note = Synthetic Construct
KGFAK

SEQ ID NO: 4108 - protein, 5 aa, synthetic construct
  REGION 1..5: note = Synthetic Construct
KGFDK

SEQ ID NO: 4109 - protein, 5 aa, synthetic construct
  REGION 1..5: note = Synthetic Construct
KGFEK

SEQ ID NO: 4110 - protein, 5 aa, synthetic construct
  REGION 1..5: note = Synthetic Construct
KGFFK

SEQ ID NO: 4111 - protein, 5 aa, synthetic construct
  REGION 1..5: note = Synthetic Construct
KGFGK

SEQ ID NO: 4112 - protein, 5 aa, synthetic construct
  REGION 1..5: note = Synthetic Construct
KGFHK

SEQ ID NO: 4113 - protein, 5 aa, synthetic construct
  REGION 1..5: note = Synthetic Construct
KGFIK

SEQ ID NO: 4114 - protein, 5 aa, synthetic construct
  REGION 1..5: note = Synthetic Construct
KGFLK

SEQ ID NO: 4115 - protein, 5 aa, synthetic construct
  REGION 1..5: note = Synthetic Construct
KGFNK

SEQ ID NO: 4116 - protein, 5 aa, synthetic construct
  REGION 1..5: note = Synthetic Construct
KGFQK

SEQ ID NO: 4117 - protein, 5 aa, synthetic construct
  REGION 1..5: note = Synthetic Construct
KGFRK

SEQ ID NO: 4118 - protein, 5 aa, synthetic construct
  REGION 1..5: note = Synthetic Construct
KGFSK

SEQ ID NO: 4119 - protein, 5 aa, synthetic construct
  REGION 1..5: note = Synthetic Construct
KGFTK

SEQ ID NO: 4120 - protein, 5 aa, synthetic construct
  REGION 1..5: note = Synthetic Construct
KGFYK

SEQ ID NO: 4121 - protein, 5 aa, synthetic construct
  REGION 1..5: note = Synthetic Construct
KGGAK

SEQ ID NO: 4122 - protein, 5 aa, synthetic construct
  REGION 1..5: note = Synthetic Construct
KGGDK

SEQ ID NO: 4123 - protein, 5 aa, synthetic construct
  REGION 1..5: note = Synthetic Construct
KGGEK

SEQ ID NO: 4124 - protein, 5 aa, synthetic construct
  REGION 1..5: note = Synthetic Construct
KGGFK

SEQ ID NO: 4125 - protein, 5 aa, synthetic construct
  REGION 1..5: note = Synthetic Construct
KGGGK

SEQ ID NO: 4126 - protein, 5 aa, synthetic construct
  REGION 1..5: note = Synthetic Construct
KGGHK

SEQ ID NO: 4127 - protein, 5 aa, synthetic construct
  REGION 1..5: note = Synthetic Construct
KGGIK

SEQ ID NO: 4128 - protein, 5 aa, synthetic construct
  REGION 1..5: note = Synthetic Construct
KGGLK

SEQ ID NO: 4129 - protein, 5 aa, synthetic construct
  REGION 1..5: note = Synthetic Construct
KGGNK

SEQ ID NO: 4130 - protein, 5 aa, synthetic construct
  REGION 1..5: note = Synthetic Construct
KGGQK

SEQ ID NO: 4131 - protein, 5 aa, synthetic construct
  REGION 1..5: note = Synthetic Construct
KGGRK

SEQ ID NO: 4132 - protein, 5 aa, synthetic construct
  REGION 1..5: note = Synthetic Construct
KGGSK

SEQ ID NO: 4133 - protein, 5 aa, synthetic construct
  REGION 1..5: note = Synthetic Construct
KGGTK

SEQ ID NO: 4134 - protein, 5 aa, synthetic construct
  REGION 1..5: note = Synthetic Construct
KGGYK

SEQ ID NO: 4135 - protein, 5 aa, synthetic construct
  REGION 1..5: note = Synthetic Construct
KGHAK

SEQ ID NO: 4136 - protein, 5 aa, synthetic construct
  REGION 1..5: note = Synthetic Construct
KGHDK

SEQ ID NO: 4137 - protein, 5 aa, synthetic construct
  REGION 1..5: note = Synthetic Construct
KGHEK

SEQ ID NO: 4138 - protein, 5 aa, synthetic construct
  REGION 1..5: note = Synthetic Construct
KGHFK

SEQ ID NO: 4139 - protein, 5 aa, synthetic construct
  REGION 1..5: note = Synthetic Construct
KGHGK

SEQ ID NO: 4140 - protein, 5 aa, synthetic construct
  REGION 1..5: note = Synthetic Construct
KGHHK

SEQ ID NO: 4141 - protein, 5 aa, synthetic construct
  REGION 1..5: note = Synthetic Construct
KGHIK

SEQ ID NO: 4142 - protein, 5 aa, synthetic construct
  REGION 1..5: note = Synthetic Construct
KGHLK

SEQ ID NO: 4143 - protein, 5 aa, synthetic construct
  REGION 1..5: note = Synthetic Construct
KGHNK

SEQ ID NO: 4144 - protein, 5 aa, synthetic construct
  REGION 1..5: note = Synthetic Construct
KGHQK

SEQ ID NO: 4145 - protein, 5 aa, synthetic construct
  REGION 1..5: note = Synthetic Construct
KGHRK

SEQ ID NO: 4146 - protein, 5 aa, synthetic construct
  REGION 1..5: note = Synthetic Construct
KGHSK

SEQ ID NO: 4147 - protein, 5 aa, synthetic construct
  REGION 1..5: note = Synthetic Construct
KGHTK

SEQ ID NO: 4148 - protein, 5 aa, synthetic construct
  REGION 1..5: note = Synthetic Construct
KGHYK

SEQ ID NO: 4149 - protein, 5 aa, synthetic construct
  REGION 1..5: note = Synthetic Construct
KGIAK

SEQ ID NO: 4150 - protein, 5 aa, synthetic construct
  REGION 1..5: note = Synthetic Construct
KGIDK

SEQ ID NO: 4151 - protein, 5 aa, synthetic construct
  REGION 1..5: note = Synthetic Construct
KGIEK

SEQ ID NO: 4152 - protein, 5 aa, synthetic construct
  REGION 1..5: note = Synthetic Construct
KGIFK

SEQ ID NO: 4153 - protein, 5 aa, synthetic construct
  REGION 1..5: note = Synthetic Construct
KGIGK

SEQ ID NO: 4154 - protein, 5 aa, synthetic construct
  REGION 1..5: note = Synthetic Construct
KGIHK

SEQ ID NO: 4155 - protein, 5 aa, synthetic construct
  REGION 1..5: note = Synthetic Construct
KGIIK

SEQ ID NO: 4156 - protein, 5 aa, synthetic construct
  REGION 1..5: note = Synthetic Construct
KGILK

SEQ ID NO: 4157 - protein, 5 aa, synthetic construct
  REGION 1..5: note = Synthetic Construct
KGINK

SEQ ID NO: 4158 - protein, 5 aa, synthetic construct
  REGION 1..5: note = Synthetic Construct
KGIQK

SEQ ID NO: 4159 - protein, 5 aa, synthetic construct
  REGION 1..5: note = Synthetic Construct
KGIRK

SEQ ID NO: 4160 - protein, 5 aa, synthetic construct
  REGION 1..5: note = Synthetic Construct
KGISK

SEQ ID NO: 4161 - protein, 5 aa, synthetic construct
  REGION 1..5: note = Synthetic Construct
KGITK

SEQ ID NO: 4162 - protein, 5 aa, synthetic construct
  REGION 1..5: note = Synthetic Construct
KGIYK

SEQ ID NO: 4163 - protein, 5 aa, synthetic construct
  REGION 1..5: note = Synthetic Construct
KGLAK

SEQ ID NO: 4164 - protein, 5 aa, synthetic construct
  REGION 1..5: note = Synthetic Construct
KGLDK

SEQ ID NO: 4165 - protein, 5 aa, synthetic construct
  REGION 1..5: note = Synthetic Construct
KGLEK

SEQ ID NO: 4166 - protein, 5 aa, synthetic construct
  REGION 1..5: note = Synthetic Construct
KGLFK

SEQ ID NO: 4167 - protein, 5 aa, synthetic construct
  REGION 1..5: note = Synthetic Construct
KGLGK

SEQ ID NO: 4168 - protein, 5 aa, synthetic construct
  REGION 1..5: note = Synthetic Construct
KGLHK

SEQ ID NO: 4169 - protein, 5 aa, synthetic construct
  REGION 1..5: note = Synthetic Construct
KGLIK

SEQ ID NO: 4170 - protein, 5 aa, synthetic construct
  REGION 1..5: note = Synthetic Construct
KGLLK

SEQ ID NO: 4171 - protein, 5 aa, synthetic construct
  REGION 1..5: note = Synthetic Construct
KGLNK

SEQ ID NO: 4172 - protein, 5 aa, synthetic construct
  REGION 1..5: note = Synthetic Construct
KGLQK

SEQ ID NO: 4173 - protein, 5 aa, synthetic construct
  REGION 1..5: note = Synthetic Construct
KGLRK

SEQ ID NO: 4174 - protein, 5 aa, synthetic construct
  REGION 1..5: note = Synthetic Construct
KGLSK

SEQ ID NO: 4175 - protein, 5 aa, synthetic construct
  REGION 1..5: note = Synthetic Construct
KGLTK

SEQ ID NO: 4176 - protein, 5 aa, synthetic construct
  REGION 1..5: note = Synthetic Construct
KGLYK

SEQ ID NO: 4177 - protein, 5 aa, synthetic construct
  REGION 1..5: note = Synthetic Construct
KGNAK

SEQ ID NO: 4178 - protein, 5 aa, synthetic construct
  REGION 1..5: note = Synthetic Construct
KGNDK

SEQ ID NO: 4179 - protein, 5 aa, synthetic construct
  REGION 1..5: note = Synthetic Construct
KGNEK

SEQ ID NO: 4180 - protein, 5 aa, synthetic construct
  REGION 1..5: note = Synthetic Construct
KGNFK

SEQ ID NO: 4181 - protein, 5 aa, synthetic construct
  REGION 1..5: note = Synthetic Construct
KGNGK

SEQ ID NO: 4182 - protein, 5 aa, synthetic construct
  REGION 1..5: note = Synthetic Construct
KGNHK

SEQ ID NO: 4183 - protein, 5 aa, synthetic construct
  REGION 1..5: note = Synthetic Construct
KGNIK

SEQ ID NO: 4184 - protein, 5 aa, synthetic construct
  REGION 1..5: note = Synthetic Construct
KGNLK

SEQ ID NO: 4185 - protein, 5 aa, synthetic construct
  REGION 1..5: note = Synthetic Construct
KGNNK

SEQ ID NO: 4186 - protein, 5 aa, synthetic construct
  REGION 1..5: note = Synthetic Construct
KGNQK

SEQ ID NO: 4187 - protein, 5 aa, synthetic construct
  REGION 1..5: note = Synthetic Construct
KGNRK

SEQ ID NO: 4188 - protein, 5 aa, synthetic construct
  REGION 1..5: note = Synthetic Construct
KGNSK

SEQ ID NO: 4189 - protein, 5 aa, synthetic construct
  REGION 1..5: note = Synthetic Construct
KGNTK

SEQ ID NO: 4190 - protein, 5 aa, synthetic construct
  REGION 1..5: note = Synthetic Construct
KGNYK

SEQ ID NO: 4191 - protein, 5 aa, synthetic construct
  REGION 1..5: note = Synthetic Construct
KGPAK

SEQ ID NO: 4192 - protein, 5 aa, synthetic construct
  REGION 1..5: note = Synthetic Construct
KGPDK

SEQ ID NO: 4193 - protein, 5 aa, synthetic construct
  REGION 1..5: note = Synthetic Construct
KGPEK

SEQ ID NO: 4194 - protein, 5 aa, synthetic construct
  REGION 1..5: note = Synthetic Construct
KGPFK

SEQ ID NO: 4195 - protein, 5 aa, synthetic construct
  REGION 1..5: note = Synthetic Construct
KGPGK

SEQ ID NO: 4196 - protein, 5 aa, synthetic construct
  REGION 1..5: note = Synthetic Construct
KGPHK

SEQ ID NO: 4197 - protein, 5 aa, synthetic construct
  REGION 1..5: note = Synthetic Construct
KGPIK

SEQ ID NO: 4198 - protein, 5 aa, synthetic construct
  REGION 1..5: note = Synthetic Construct
KGPLK

SEQ ID NO: 4199 - protein, 5 aa, synthetic construct
  REGION 1..5: note = Synthetic Construct
KGPNK

SEQ ID NO: 4200 - protein, 5 aa, synthetic construct
  REGION 1..5: note = Synthetic Construct
KGPQK

SEQ ID NO: 4201 - protein, 5 aa, synthetic construct
  REGION 1..5: note = Synthetic Construct
KGPRK

SEQ ID NO: 4202 - protein, 5 aa, synthetic construct
  REGION 1..5: note = Synthetic Construct
KGPSK

SEQ ID NO: 4203 - protein, 5 aa, synthetic construct
  REGION 1..5: note = Synthetic Construct
KGPTK

SEQ ID NO: 4204 - protein, 5 aa, synthetic construct
  REGION 1..5: note = Synthetic Construct
KGPYK

SEQ ID NO: 4205 - protein, 5 aa, synthetic construct
  REGION 1..5: note = Synthetic Construct
KGQAK

SEQ ID NO: 4206 - protein, 5 aa, synthetic construct
  REGION 1..5: note = Synthetic Construct
KGQDK

SEQ ID NO: 4207 - protein, 5 aa, synthetic construct
  REGION 1..5: note = Synthetic Construct
KGQEK

SEQ ID NO: 4208 - protein, 5 aa, synthetic construct
  REGION 1..5: note = Synthetic Construct
KGQFK

SEQ ID NO: 4209 - protein, 5 aa, synthetic construct
  REGION 1..5: note = Synthetic Construct
KGQGK

SEQ ID NO: 4210 - protein, 5 aa, synthetic construct
  REGION 1..5: note = Synthetic Construct
KGQHK

SEQ ID NO: 4211 - protein, 5 aa, synthetic construct
  REGION 1..5: note = Synthetic Construct
KGQIK

SEQ ID NO: 4212 - protein, 5 aa, synthetic construct
  REGION 1..5: note = Synthetic Construct
KGQLK

SEQ ID NO: 4213 - protein, 5 aa, synthetic construct
  REGION 1..5: note = Synthetic Construct
KGQNK

SEQ ID NO: 4214 - protein, 5 aa, synthetic construct
  REGION 1..5: note = Synthetic Construct
KGQQK

SEQ ID NO: 4215 - protein, 5 aa, synthetic construct
  REGION 1..5: note = Synthetic Construct
KGQRK

SEQ ID NO: 4216 - protein, 5 aa, synthetic construct
  REGION 1..5: note = Synthetic Construct
KGQSK

SEQ ID NO: 4217 - protein, 5 aa, synthetic construct
  REGION 1..5: note = Synthetic Construct
KGQTK

SEQ ID NO: 4218 - protein, 5 aa, synthetic construct
  REGION 1..5: note = Synthetic Construct
KGQYK

SEQ ID NO: 4219 - protein, 5 aa, synthetic construct
  REGION 1..5: note = Synthetic Construct
KGRAK

SEQ ID NO: 4220 - protein, 5 aa, synthetic construct
  REGION 1..5: note = Synthetic Construct
KGRDK

SEQ ID NO: 4221 - protein, 5 aa, synthetic construct
  REGION 1..5: note = Synthetic Construct
KGREK

SEQ ID NO: 4222 - protein, 5 aa, synthetic construct
  REGION 1..5: note = Synthetic Construct
KGRFK

SEQ ID NO: 4223 - protein, 5 aa, synthetic construct
  REGION 1..5: note = Synthetic Construct
KGRGK

SEQ ID NO: 4224 - protein, 5 aa, synthetic construct
  REGION 1..5: note = Synthetic Construct
KGRHK

SEQ ID NO: 4225 - protein, 5 aa, synthetic construct
  REGION 1..5: note = Synthetic Construct
KGRIK

SEQ ID NO: 4226 - protein, 5 aa, synthetic construct
  REGION 1..5: note = Synthetic Construct
KGRLK

SEQ ID NO: 4227 - protein, 5 aa, synthetic construct
  REGION 1..5: note = Synthetic Construct
KGRNK

SEQ ID NO: 4228 - protein, 5 aa, synthetic construct
  REGION 1..5: note = Synthetic Construct
KGRQK

SEQ ID NO: 4229 - protein, 5 aa, synthetic construct
  REGION 1..5: note = Synthetic Construct
KGRRK

SEQ ID NO: 4230 - protein, 5 aa, synthetic construct
  REGION 1..5: note = Synthetic Construct
KGRSK

SEQ ID NO: 4231 - protein, 5 aa, synthetic construct
  REGION 1..5: note = Synthetic Construct
KGRTK

SEQ ID NO: 4232 - protein, 5 aa, synthetic construct
  REGION 1..5: note = Synthetic Construct
KGRYK

SEQ ID NO: 4233 - protein, 5 aa, synthetic construct
  REGION 1..5: note = Synthetic Construct
KGSAK

SEQ ID NO: 4234 - protein, 5 aa, synthetic construct
  REGION 1..5: note = Synthetic Construct
KGSDK

SEQ ID NO: 4235 - protein, 5 aa, synthetic construct
  REGION 1..5: note = Synthetic Construct
KGSEK

SEQ ID NO: 4236 - protein, 5 aa, synthetic construct
  REGION 1..5: note = Synthetic Construct
KGSFK

SEQ ID NO: 4237 - protein, 5 aa, synthetic construct
  REGION 1..5: note = Synthetic Construct
KGSGK

SEQ ID NO: 4238 - protein, 5 aa, synthetic construct
  REGION 1..5: note = Synthetic Construct
KGSHK

SEQ ID NO: 4239 - protein, 5 aa, synthetic construct
  REGION 1..5: note = Synthetic Construct
KGSIK

SEQ ID NO: 4240 - protein, 5 aa, synthetic construct
  REGION 1..5: note = Synthetic Construct
KGSLK

SEQ ID NO: 4241 - protein, 5 aa, synthetic construct
  REGION 1..5: note = Synthetic Construct
KGSNK

SEQ ID NO: 4242 - protein, 5 aa, synthetic construct
  REGION 1..5: note = Synthetic Construct
KGSQK

SEQ ID NO: 4243 - protein, 5 aa, synthetic construct
  REGION 1..5: note = Synthetic Construct
KGSRK

SEQ ID NO: 4244 - protein, 5 aa, synthetic construct
  REGION 1..5: note = Synthetic Construct
KGSSK

SEQ ID NO: 4245 - protein, 5 aa, synthetic construct
  REGION 1..5: note = Synthetic Construct
KGSTK

SEQ ID NO: 4246 - protein, 5 aa, synthetic construct
  REGION 1..5: note = Synthetic Construct
KGSYK

SEQ ID NO: 4247 - protein, 5 aa, synthetic construct
  REGION 1..5: note = Synthetic Construct
KGTAK

SEQ ID NO: 4248 - protein, 5 aa, synthetic construct
  REGION 1..5: note = Synthetic Construct
KGTDK

SEQ ID NO: 4249 - protein, 5 aa, synthetic construct
  REGION 1..5: note = Synthetic Construct
KGTEK

SEQ ID NO: 4250 - protein, 5 aa, synthetic construct
  REGION 1..5: note = Synthetic Construct
KGTFK

SEQ ID NO: 4251 - protein, 5 aa, synthetic construct
  REGION 1..5: note = Synthetic Construct
KGTGK

SEQ ID NO: 4252 - protein, 5 aa, synthetic construct
  REGION 1..5: note = Synthetic Construct
KGTHK

SEQ ID NO: 4253 - protein, 5 aa, synthetic construct
  REGION 1..5: note = Synthetic Construct
KGTIK

SEQ ID NO: 4254 - protein, 5 aa, synthetic construct
  REGION 1..5: note = Synthetic Construct
KGTLK

SEQ ID NO: 4255 - protein, 5 aa, synthetic construct
  REGION 1..5: note = Synthetic Construct
KGTNK

SEQ ID NO: 4256 - protein, 5 aa, synthetic construct
  REGION 1..5: note = Synthetic Construct
KGTQK

SEQ ID NO: 4257 - protein, 5 aa, synthetic construct
  REGION 1..5: note = Synthetic Construct
KGTRK

SEQ ID NO: 4258 - protein, 5 aa, synthetic construct
  REGION 1..5: note = Synthetic Construct
KGTSK

SEQ ID NO: 4259 - protein, 5 aa, synthetic construct
  REGION 1..5: note = Synthetic Construct
KGTTK

SEQ ID NO: 4260 - protein, 5 aa, synthetic construct
  REGION 1..5: note = Synthetic Construct
KGTYK

SEQ ID NO: 4261 - protein, 5 aa, synthetic construct
  REGION 1..5: note = Synthetic Construct
KGYAK

SEQ ID NO: 4262 - protein, 5 aa, synthetic construct
  REGION 1..5: note = Synthetic Construct
KGYDK

SEQ ID NO: 4263 - protein, 5 aa, synthetic construct
  REGION 1..5: note = Synthetic Construct
KGYEK

SEQ ID NO: 4264 - protein, 5 aa, synthetic construct
  REGION 1..5: note = Synthetic Construct
KGYFK

SEQ ID NO: 4265 - protein, 5 aa, synthetic construct
  REGION 1..5: note = Synthetic Construct
KGYGK

SEQ ID NO: 4266 - protein, 5 aa, synthetic construct
  REGION 1..5: note = Synthetic Construct
KGYHK

SEQ ID NO: 4267 - protein, 5 aa, synthetic construct
  REGION 1..5: note = Synthetic Construct
KGYIK

SEQ ID NO: 4268 - protein, 5 aa, synthetic construct
  REGION 1..5: note = Synthetic Construct
KGYLK

SEQ ID NO: 4269 - protein, 5 aa, synthetic construct
  REGION 1..5: note = Synthetic Construct
KGYNK

SEQ ID NO: 4270 - protein, 5 aa, synthetic construct
  REGION 1..5: note = Synthetic Construct
KGYQK

SEQ ID NO: 4271 - protein, 5 aa, synthetic construct
  REGION 1..5: note = Synthetic Construct
KGYRK

SEQ ID NO: 4272 - protein, 5 aa, synthetic construct
  REGION 1..5: note = Synthetic Construct
KGYSK

SEQ ID NO: 4273 - protein, 5 aa, synthetic construct
  REGION 1..5: note = Synthetic Construct
KGYTK

SEQ ID NO: 4274 - protein, 5 aa, synthetic construct
  REGION 1..5: note = Synthetic Construct
KGYYK

SEQ ID NO: 4275 - protein, 5 aa, synthetic construct
  REGION 1..5: note = Synthetic Construct
KHAAK

SEQ ID NO: 4276 - protein, 5 aa, synthetic construct
  REGION 1..5: note = Synthetic Construct
KHADK

SEQ ID NO: 4277 - protein, 5 aa, synthetic construct
  REGION 1..5: note = Synthetic Construct
KHAEK

SEQ ID NO: 4278 - protein, 5 aa, synthetic construct
  REGION 1..5: note = Synthetic Construct
KHAFK

SEQ ID NO: 4279 - protein, 5 aa, synthetic construct
  REGION 1..5: note = Synthetic Construct
KHAGK

SEQ ID NO: 4280 - protein, 5 aa, synthetic construct
  REGION 1..5: note = Synthetic Construct
KHAHK

SEQ ID NO: 4281 - protein, 5 aa, synthetic construct
  REGION 1..5: note = Synthetic Construct
KHAIK

SEQ ID NO: 4282 - protein, 5 aa, synthetic construct
  REGION 1..5: note = Synthetic Construct
KHALK

SEQ ID NO: 4283 - protein, 5 aa, synthetic construct
  REGION 1..5: note = Synthetic Construct
KHANK

SEQ ID NO: 4284 - protein, 5 aa, synthetic construct
  REGION 1..5: note = Synthetic Construct
KHAQK

SEQ ID NO: 4285 - protein, 5 aa, synthetic construct
  REGION 1..5: note = Synthetic Construct
KHARK

SEQ ID NO: 4286 - protein, 5 aa, synthetic construct
  REGION 1..5: note = Synthetic Construct
KHASK

SEQ ID NO: 4287 - protein, 5 aa, synthetic construct
  REGION 1..5: note = Synthetic Construct
KHATK

SEQ ID NO: 4288 - protein, 5 aa, synthetic construct
  REGION 1..5: note = Synthetic Construct
KHAYK

SEQ ID NO: 4289 - protein, 5 aa, synthetic construct
  REGION 1..5: note = Synthetic Construct
KHDAK

SEQ ID NO: 4290 - protein, 5 aa, synthetic construct
  REGION 1..5: note = Synthetic Construct
KHDDK

SEQ ID NO: 4291 - protein, 5 aa, synthetic construct
  REGION 1..5: note = Synthetic Construct
KHDEK

SEQ ID NO: 4292 - protein, 5 aa, synthetic construct
  REGION 1..5: note = Synthetic Construct
KHDFK

SEQ ID NO: 4293 - protein, 5 aa, synthetic construct
  REGION 1..5: note = Synthetic Construct
KHDGK

SEQ ID NO: 4294 - protein, 5 aa, synthetic construct
  REGION 1..5: note = Synthetic Construct
KHDHK

SEQ ID NO: 4295 - protein, 5 aa, synthetic construct
  REGION 1..5: note = Synthetic Construct
KHDIK

SEQ ID NO: 4296 - protein, 5 aa, synthetic construct
  REGION 1..5: note = Synthetic Construct
KHDLK

SEQ ID NO: 4297 - protein, 5 aa, synthetic construct
  REGION 1..5: note = Synthetic Construct
KHDNK

SEQ ID NO: 4298 - protein, 5 aa, synthetic construct
  REGION 1..5: note = Synthetic Construct
KHDQK

SEQ ID NO: 4299 - protein, 5 aa, synthetic construct
  REGION 1..5: note = Synthetic Construct
KHDRK

SEQ ID NO: 4300 - protein, 5 aa, synthetic construct
  REGION 1..5: note = Synthetic Construct
KHDSK

SEQ ID NO: 4301 - protein, 5 aa, synthetic construct
  REGION 1..5: note = Synthetic Construct
KHDTK

SEQ ID NO: 4302 - protein, 5 aa, synthetic construct
  REGION 1..5: note = Synthetic Construct
KHDYK

SEQ ID NO: 4303 - protein, 5 aa, synthetic construct
  REGION 1..5: note = Synthetic Construct
KHEAK

SEQ ID NO: 4304 - protein, 5 aa, synthetic construct
  REGION 1..5: note = Synthetic Construct
KHEDK

SEQ ID NO: 4305 - protein, 5 aa, synthetic construct
  REGION 1..5: note = Synthetic Construct
KHEEK

SEQ ID NO: 4306 - protein, 5 aa, synthetic construct
  REGION 1..5: note = Synthetic Construct
KHEFK

SEQ ID NO: 4307 - protein, 5 aa, synthetic construct
  REGION 1..5: note = Synthetic Construct
KHEGK

SEQ ID NO: 4308 - protein, 5 aa, synthetic construct
  REGION 1..5: note = Synthetic Construct
KHEHK

SEQ ID NO: 4309 - protein, 5 aa, synthetic construct
  REGION 1..5: note = Synthetic Construct
KHEIK

SEQ ID NO: 4310 - protein, 5 aa, synthetic construct
  REGION 1..5: note = Synthetic Construct
KHELK

SEQ ID NO: 4311 - protein, 5 aa, synthetic construct
  REGION 1..5: note = Synthetic Construct
KHENK

SEQ ID NO: 4312 - protein, 5 aa, synthetic construct
  REGION 1..5: note = Synthetic Construct
KHEQK

SEQ ID NO: 4313 - protein, 5 aa, synthetic construct
  REGION 1..5: note = Synthetic Construct
KHERK

SEQ ID NO: 4314 - protein, 5 aa, synthetic construct
  REGION 1..5: note = Synthetic Construct
KHESK

SEQ ID NO: 4315 - protein, 5 aa, synthetic construct
  REGION 1..5: note = Synthetic Construct
KHETK

SEQ ID NO: 4316 - protein, 5 aa, synthetic construct
  REGION 1..5: note = Synthetic Construct
KHEYK

SEQ ID NO: 4317 - protein, 5 aa, synthetic construct
  REGION 1..5: note = Synthetic Construct
KHFAK

SEQ ID NO: 4318 - protein, 5 aa, synthetic construct
  REGION 1..5: note = Synthetic Construct
KHFDK

SEQ ID NO: 4319 - protein, 5 aa, synthetic construct
  REGION 1..5: note = Synthetic Construct
KHFEK

SEQ ID NO: 4320 - protein, 5 aa, synthetic construct
  REGION 1..5: note = Synthetic Construct
KHFFK

SEQ ID NO: 4321 - protein, 5 aa, synthetic construct
  REGION 1..5: note = Synthetic Construct
KHFGK

SEQ ID NO: 4322 - protein, 5 aa, synthetic construct
  REGION 1..5: note = Synthetic Construct
KHFHK

SEQ ID NO: 4323 - protein, 5 aa, synthetic construct
  REGION 1..5: note = Synthetic Construct
KHFIK

SEQ ID NO: 4324 - protein, 5 aa, synthetic construct
  REGION 1..5: note = Synthetic Construct
KHFLK

SEQ ID NO: 4325 - protein, 5 aa, synthetic construct
  REGION 1..5: note = Synthetic Construct
KHFNK

SEQ ID NO: 4326 - protein, 5 aa, synthetic construct
  REGION 1..5: note = Synthetic Construct
KHFQK

SEQ ID NO: 4327 - protein, 5 aa, synthetic construct
  REGION 1..5: note = Synthetic Construct
KHFRK

SEQ ID NO: 4328 - protein, 5 aa, synthetic construct
  REGION 1..5: note = Synthetic Construct
KHFSK

SEQ ID NO: 4329 - protein, 5 aa, synthetic construct
  REGION 1..5: note = Synthetic Construct
KHFTK

SEQ ID NO: 4330 - protein, 5 aa, synthetic construct
  REGION 1..5: note = Synthetic Construct
KHFYK

SEQ ID NO: 4331 - protein, 5 aa, synthetic construct
  REGION 1..5: note = Synthetic Construct
KHGAK

SEQ ID NO: 4332 - protein, 5 aa, synthetic construct
  REGION 1..5: note = Synthetic Construct
KHGDK

SEQ ID NO: 4333 - protein, 5 aa, synthetic construct
  REGION 1..5: note = Synthetic Construct
KHGEK

SEQ ID NO: 4334 - protein, 5 aa, synthetic construct
  REGION 1..5: note = Synthetic Construct
KHGFK

SEQ ID NO: 4335 - protein, 5 aa, synthetic construct
  REGION 1..5: note = Synthetic Construct
KHGGK

SEQ ID NO: 4336 - protein, 5 aa, synthetic construct
  REGION 1..5: note = Synthetic Construct
KHGHK

SEQ ID NO: 4337 - protein, 5 aa, synthetic construct
  REGION 1..5: note = Synthetic Construct
KHGIK

SEQ ID NO: 4338 - protein, 5 aa, synthetic construct
  REGION 1..5: note = Synthetic Construct
KHGLK

SEQ ID NO: 4339 - protein, 5 aa, synthetic construct
  REGION 1..5: note = Synthetic Construct
KHGNK

SEQ ID NO: 4340 - protein, 5 aa, synthetic construct
  REGION 1..5: note = Synthetic Construct
KHGQK

SEQ ID NO: 4341 - protein, 5 aa, synthetic construct
  REGION 1..5: note = Synthetic Construct
KHGRK

SEQ ID NO: 4342 - protein, 5 aa, synthetic construct
  REGION 1..5: note = Synthetic Construct
KHGSK

SEQ ID NO: 4343 - protein, 5 aa, synthetic construct
  REGION 1..5: note = Synthetic Construct
KHGTK

SEQ ID NO: 4344 - protein, 5 aa, synthetic construct
  REGION 1..5: note = Synthetic Construct
KHGYK

SEQ ID NO: 4345 - protein, 5 aa, synthetic construct
  REGION 1..5: note = Synthetic Construct
KHHAK

SEQ ID NO: 4346 - protein, 5 aa, synthetic construct
  REGION 1..5: note = Synthetic Construct
KHHDK

SEQ ID NO: 4347 - protein, 5 aa, synthetic construct
  REGION 1..5: note = Synthetic Construct
KHHEK

SEQ ID NO: 4348 - protein, 5 aa, synthetic construct
  REGION 1..5: note = Synthetic Construct
KHHFK

SEQ ID NO: 4349 - protein, 5 aa, synthetic construct
  REGION 1..5: note = Synthetic Construct
KHHGK

SEQ ID NO: 4350 - protein, 5 aa, synthetic construct
  REGION 1..5: note = Synthetic Construct
KHHHK

SEQ ID NO: 4351 - protein, 5 aa, synthetic construct
  REGION 1..5: note = Synthetic Construct
KHHIK

SEQ ID NO: 4352 - protein, 5 aa, synthetic construct
  REGION 1..5: note = Synthetic Construct
KHHLK

SEQ ID NO: 4353 - protein, 5 aa, synthetic construct
  REGION 1..5: note = Synthetic Construct
KHHNK

SEQ ID NO: 4354 - protein, 5 aa, synthetic construct
  REGION 1..5: note = Synthetic Construct
KHHQK

SEQ ID NO: 4355 - protein, 5 aa, synthetic construct
  REGION 1..5: note = Synthetic Construct
KHHRK

SEQ ID NO: 4356 - protein, 5 aa, synthetic construct
  REGION 1..5: note = Synthetic Construct
KHHSK

SEQ ID NO: 4357 - protein, 5 aa, synthetic construct
  REGION 1..5: note = Synthetic Construct
KHHTK

SEQ ID NO: 4358 - protein, 5 aa, synthetic construct
  REGION 1..5: note = Synthetic Construct
KHHYK

SEQ ID NO: 4359 - protein, 5 aa, synthetic construct
  REGION 1..5: note = Synthetic Construct
KHIAK

SEQ ID NO: 4360 - protein, 5 aa, synthetic construct
  REGION 1..5: note = Synthetic Construct
KHIDK

SEQ ID NO: 4361 - protein, 5 aa, synthetic construct
  REGION 1..5: note = Synthetic Construct
KHIEK

SEQ ID NO: 4362 - protein, 5 aa, synthetic construct
  REGION 1..5: note = Synthetic Construct
KHIFK

SEQ ID NO: 4363 - protein, 5 aa, synthetic construct
  REGION 1..5: note = Synthetic Construct
KHIGK

SEQ ID NO: 4364 - protein, 5 aa, synthetic construct
  REGION 1..5: note = Synthetic Construct
KHIHK

SEQ ID NO: 4365 - protein, 5 aa, synthetic construct
  REGION 1..5: note = Synthetic Construct
KHIIK

SEQ ID NO: 4366 - protein, 5 aa, synthetic construct
  REGION 1..5: note = Synthetic Construct
KHILK

SEQ ID NO: 4367 - protein, 5 aa, synthetic construct
  REGION 1..5: note = Synthetic Construct
KHINK

SEQ ID NO: 4368 - protein, 5 aa, synthetic construct
  REGION 1..5: note = Synthetic Construct
KHIQK

SEQ ID NO: 4369 - protein, 5 aa, synthetic construct
  REGION 1..5: note = Synthetic Construct
KHIRK

SEQ ID NO: 4370 - protein, 5 aa, synthetic construct
  REGION 1..5: note = Synthetic Construct
KHISK

SEQ ID NO: 4371 - protein, 5 aa, synthetic construct
  REGION 1..5: note = Synthetic Construct
KHITK

SEQ ID NO: 4372 - protein, 5 aa, synthetic construct
  REGION 1..5: note = Synthetic Construct
KHIYK

SEQ ID NO: 4373 - protein, 5 aa, synthetic construct
  REGION 1..5: note = Synthetic Construct
KHLAK

SEQ ID NO: 4374 - protein, 5 aa, synthetic construct
  REGION 1..5: note = Synthetic Construct
KHLDK

SEQ ID NO: 4375 - protein, 5 aa, synthetic construct
  REGION 1..5: note = Synthetic Construct
KHLEK

SEQ ID NO: 4376 - protein, 5 aa, synthetic construct
  REGION 1..5: note = Synthetic Construct
KHLFK

SEQ ID NO: 4377 - protein, 5 aa, synthetic construct
  REGION 1..5: note = Synthetic Construct
KHLGK

SEQ ID NO: 4378 - protein, 5 aa, synthetic construct
  REGION 1..5: note = Synthetic Construct
KHLHK

SEQ ID NO: 4379 - protein, 5 aa, synthetic construct
  REGION 1..5: note = Synthetic Construct
KHLIK

SEQ ID NO: 4380 - protein, 5 aa, synthetic construct
  REGION 1..5: note = Synthetic Construct
KHLLK

SEQ ID NO: 4381 - protein, 5 aa, synthetic construct
  REGION 1..5: note = Synthetic Construct
KHLNK

SEQ ID NO: 4382 - protein, 5 aa, synthetic construct
  REGION 1..5: note = Synthetic Construct
KHLQK

SEQ ID NO: 4383 - protein, 5 aa, synthetic construct
  REGION 1..5: note = Synthetic Construct
KHLRK

SEQ ID NO: 4384 - protein, 5 aa, synthetic construct
  REGION 1..5: note = Synthetic Construct
KHLSK

SEQ ID NO: 4385 - protein, 5 aa, synthetic construct
  REGION 1..5: note = Synthetic Construct
KHLTK

SEQ ID NO: 4386 - protein, 5 aa, synthetic construct
  REGION 1..5: note = Synthetic Construct
KHLYK

SEQ ID NO: 4387 - protein, 5 aa, synthetic construct
  REGION 1..5: note = Synthetic Construct
KHNAK

SEQ ID NO: 4388 - protein, 5 aa, synthetic construct
  REGION 1..5: note = Synthetic Construct
KHNDK

SEQ ID NO: 4389 - protein, 5 aa, synthetic construct
  REGION 1..5: note = Synthetic Construct
KHNEK

SEQ ID NO: 4390 - protein, 5 aa, synthetic construct
  REGION 1..5: note = Synthetic Construct
KHNFK

SEQ ID NO: 4391 - protein, 5 aa, synthetic construct
  REGION 1..5: note = Synthetic Construct
KHNGK

SEQ ID NO: 4392 - protein, 5 aa, synthetic construct
  REGION 1..5: note = Synthetic Construct
KHNHK

SEQ ID NO: 4393 - protein, 5 aa, synthetic construct
  REGION 1..5: note = Synthetic Construct
KHNIK

SEQ ID NO: 4394 - protein, 5 aa, synthetic construct
  REGION 1..5: note = Synthetic Construct
KHNLK

SEQ ID NO: 4395 - protein, 5 aa, synthetic construct
  REGION 1..5: note = Synthetic Construct
KHNNK

SEQ ID NO: 4396 - protein, 5 aa, synthetic construct
  REGION 1..5: note = Synthetic Construct
KHNQK

SEQ ID NO: 4397 - protein, 5 aa, synthetic construct
  REGION 1..5: note = Synthetic Construct
KHNRK

SEQ ID NO: 4398 - protein, 5 aa, synthetic construct
  REGION 1..5: note = Synthetic Construct
KHNSK

SEQ ID NO: 4399 - protein, 5 aa, synthetic construct
  REGION 1..5: note = Synthetic Construct
KHNTK

SEQ ID NO: 4400 - protein, 5 aa, synthetic construct
  REGION 1..5: note = Synthetic Construct
KHNYK

SEQ ID NO: 4401 - protein, 5 aa, synthetic construct
  REGION 1..5: note = Synthetic Construct
KHPAK

SEQ ID NO: 4402 - protein, 5 aa, synthetic construct
  REGION 1..5: note = Synthetic Construct
KHPDK

SEQ ID NO: 4403 - protein, 5 aa, synthetic construct
  REGION 1..5: note = Synthetic Construct
KHPEK

SEQ ID NO: 4404 - protein, 5 aa, synthetic construct
  REGION 1..5: note = Synthetic Construct
KHPFK

SEQ ID NO: 4405 - protein, 5 aa, synthetic construct
  REGION 1..5: note = Synthetic Construct
KHPGK

SEQ ID NO: 4406 - protein, 5 aa, synthetic construct
  REGION 1..5: note = Synthetic Construct
KHPHK

SEQ ID NO: 4407 - protein, 5 aa, synthetic construct
  REGION 1..5: note = Synthetic Construct
KHPIK

SEQ ID NO: 4408 - protein, 5 aa, synthetic construct
  REGION 1..5: note = Synthetic Construct
KHPLK

SEQ ID NO: 4409 - protein, 5 aa, synthetic construct
  REGION 1..5: note = Synthetic Construct
KHPNK

SEQ ID NO: 4410 - protein, 5 aa, synthetic construct
  REGION 1..5: note = Synthetic Construct
KHPQK

SEQ ID NO: 4411 - protein, 5 aa, synthetic construct
  REGION 1..5: note = Synthetic Construct
KHPRK

SEQ ID NO: 4412 - protein, 5 aa, synthetic construct
  REGION 1..5: note = Synthetic Construct
KHPSK

SEQ ID NO: 4413 - protein, 5 aa, synthetic construct
  REGION 1..5: note = Synthetic Construct
KHPTK

SEQ ID NO: 4414 - protein, 5 aa, synthetic construct
  REGION 1..5: note = Synthetic Construct
KHPYK

SEQ ID NO: 4415 - protein, 5 aa, synthetic construct
  REGION 1..5: note = Synthetic Construct
KHQAK

SEQ ID NO: 4416 - protein, 5 aa, synthetic construct
  REGION 1..5: note = Synthetic Construct
KHQDK

SEQ ID NO: 4417 - protein, 5 aa, synthetic construct
  REGION 1..5: note = Synthetic Construct
KHQEK

SEQ ID NO: 4418 - protein, 5 aa, synthetic construct
  REGION 1..5: note = Synthetic Construct
KHQFK

SEQ ID NO: 4419 - protein, 5 aa, synthetic construct
  REGION 1..5: note = Synthetic Construct
KHQGK

SEQ ID NO: 4420 - protein, 5 aa, synthetic construct
  REGION 1..5: note = Synthetic Construct
KHQHK

SEQ ID NO: 4421 - protein, 5 aa, synthetic construct
  REGION 1..5: note = Synthetic Construct
KHQIK

SEQ ID NO: 4422 - protein, 5 aa, synthetic construct
  REGION 1..5: note = Synthetic Construct
KHQLK

SEQ ID NO: 4423 - protein, 5 aa, synthetic construct
  REGION 1..5: note = Synthetic Construct
KHQNK

SEQ ID NO: 4424 - protein, 5 aa, synthetic construct
  REGION 1..5: note = Synthetic Construct
KHQQK

SEQ ID NO: 4425 - protein, 5 aa, synthetic construct
  REGION 1..5: note = Synthetic Construct
KHQRK

SEQ ID NO: 4426 - protein, 5 aa, synthetic construct
  REGION 1..5: note = Synthetic Construct
KHQSK

SEQ ID NO: 4427 - protein, 5 aa, synthetic construct
  REGION 1..5: note = Synthetic Construct
KHQTK

SEQ ID NO: 4428 - protein, 5 aa, synthetic construct
  REGION 1..5: note = Synthetic Construct
KHQYK

SEQ ID NO: 4429 - protein, 5 aa, synthetic construct
  REGION 1..5: note = Synthetic Construct
KHRAK

SEQ ID NO: 4430 - protein, 5 aa, synthetic construct
  REGION 1..5: note = Synthetic Construct
KHRDK

SEQ ID NO: 4431 - protein, 5 aa, synthetic construct
  REGION 1..5: note = Synthetic Construct
KHREK

SEQ ID NO: 4432 - protein, 5 aa, synthetic construct
  REGION 1..5: note = Synthetic Construct
KHRFK

SEQ ID NO: 4433 - protein, 5 aa, synthetic construct
  REGION 1..5: note = Synthetic Construct
KHRGK

SEQ ID NO: 4434 - protein, 5 aa, synthetic construct
  REGION 1..5: note = Synthetic Construct
KHRHK

SEQ ID NO: 4435 - protein, 5 aa, synthetic construct
  REGION 1..5: note = Synthetic Construct
KHRIK

SEQ ID NO: 4436 - protein, 5 aa, synthetic construct
  REGION 1..5: note = Synthetic Construct
KHRLK

SEQ ID NO: 4437 - protein, 5 aa, synthetic construct
  REGION 1..5: note = Synthetic Construct
KHRNK

SEQ ID NO: 4438 - protein, 5 aa, synthetic construct
  REGION 1..5: note = Synthetic Construct
KHRQK

SEQ ID NO: 4439 - protein, 5 aa, synthetic construct
  REGION 1..5: note = Synthetic Construct
KHRRK

SEQ ID NO: 4440 - protein, 5 aa, synthetic construct
  REGION 1..5: note = Synthetic Construct
KHRSK

SEQ ID NO: 4441 - protein, 5 aa, synthetic construct
  REGION 1..5: note = Synthetic Construct
KHRTK

SEQ ID NO: 4442 - protein, 5 aa, synthetic construct
  REGION 1..5: note = Synthetic Construct
KHRYK

SEQ ID NO: 4443 - protein, 5 aa, synthetic construct
  REGION 1..5: note = Synthetic Construct
KHSAK

SEQ ID NO: 4444 - protein, 5 aa, synthetic construct
  REGION 1..5: note = Synthetic Construct
KHSDK

SEQ ID NO: 4445 - protein, 5 aa, synthetic construct
  REGION 1..5: note = Synthetic Construct
KHSEK

SEQ ID NO: 4446 - protein, 5 aa, synthetic construct
  REGION 1..5: note = Synthetic Construct
KHSFK

SEQ ID NO: 4447 - protein, 5 aa, synthetic construct
  REGION 1..5: note = Synthetic Construct
KHSGK

SEQ ID NO: 4448 - protein, 5 aa, synthetic construct
  REGION 1..5: note = Synthetic Construct
KHSHK

SEQ ID NO: 4449 - protein, 5 aa, synthetic construct
  REGION 1..5: note = Synthetic Construct
KHSIK

SEQ ID NO: 4450 - protein, 5 aa, synthetic construct
  REGION 1..5: note = Synthetic Construct
KHSLK

SEQ ID NO: 4451 - protein, 5 aa, synthetic construct
  REGION 1..5: note = Synthetic Construct
KHSNK

SEQ ID NO: 4452 - protein, 5 aa, synthetic construct
  REGION 1..5: note = Synthetic Construct
KHSQK

SEQ ID NO: 4453 - protein, 5 aa, synthetic construct
  REGION 1..5: note = Synthetic Construct
KHSRK

SEQ ID NO: 4454 - protein, 5 aa, synthetic construct
  REGION 1..5: note = Synthetic Construct
KHSSK

SEQ ID NO: 4455 - protein, 5 aa, synthetic construct
  REGION 1..5: note = Synthetic Construct
KHSTK

SEQ ID NO: 4456 - protein, 5 aa, synthetic construct
  REGION 1..5: note = Synthetic Construct
KHSYK

SEQ ID NO: 4457 - protein, 5 aa, synthetic construct
  REGION 1..5: note = Synthetic Construct
KHTAK

SEQ ID NO: 4458 - protein, 5 aa, synthetic construct
  REGION 1..5: note = Synthetic Construct
KHTDK

SEQ ID NO: 4459 - protein, 5 aa, synthetic construct
  REGION 1..5: note = Synthetic Construct
KHTEK

SEQ ID NO: 4460 - protein, 5 aa, synthetic construct
  REGION 1..5: note = Synthetic Construct
KHTFK

SEQ ID NO: 4461 - protein, 5 aa, synthetic construct
  REGION 1..5: note = Synthetic Construct
KHTGK

SEQ ID NO: 4462 - protein, 5 aa, synthetic construct
  REGION 1..5: note = Synthetic Construct
KHTHK

SEQ ID NO: 4463 - protein, 5 aa, synthetic construct
  REGION 1..5: note = Synthetic Construct
KHTIK

SEQ ID NO: 4464 - protein, 5 aa, synthetic construct
  REGION 1..5: note = Synthetic Construct
KHTLK

SEQ ID NO: 4465 - protein, 5 aa, synthetic construct
  REGION 1..5: note = Synthetic Construct
KHTNK

SEQ ID NO: 4466 - protein, 5 aa, synthetic construct
  REGION 1..5: note = Synthetic Construct
KHTQK

SEQ ID NO: 4467 - protein, 5 aa, synthetic construct
  REGION 1..5: note = Synthetic Construct
KHTRK

SEQ ID NO: 4468 - protein, 5 aa, synthetic construct
  REGION 1..5: note = Synthetic Construct
KHTSK

SEQ ID NO: 4469 - protein, 5 aa, synthetic construct
  REGION 1..5: note = Synthetic Construct
KHTTK

SEQ ID NO: 4470 - protein, 5 aa, synthetic construct
  REGION 1..5: note = Synthetic Construct
KHTYK

SEQ ID NO: 4471 - protein, 5 aa, synthetic construct
  REGION 1..5: note = Synthetic Construct
KHYAK

SEQ ID NO: 4472 - protein, 5 aa, synthetic construct
  REGION 1..5: note = Synthetic Construct
KHYDK

SEQ ID NO: 4473 - protein, 5 aa, synthetic construct
  REGION 1..5: note = Synthetic Construct
KHYEK

SEQ ID NO: 4474 - protein, 5 aa, synthetic construct
  REGION 1..5: note = Synthetic Construct
KHYFK

SEQ ID NO: 4475 - protein, 5 aa, synthetic construct
  REGION 1..5: note = Synthetic Construct
KHYGK

SEQ ID NO: 4476 - protein, 5 aa, synthetic construct
  REGION 1..5: note = Synthetic Construct
KHYHK

SEQ ID NO: 4477 - protein, 5 aa, synthetic construct
  REGION 1..5: note = Synthetic Construct
KHYIK

SEQ ID NO: 4478 - protein, 5 aa, synthetic construct
  REGION 1..5: note = Synthetic Construct
KHYLK

SEQ ID NO: 4479 - protein, 5 aa, synthetic construct
  REGION 1..5: note = Synthetic Construct
KHYNK

SEQ ID NO: 4480 - protein, 5 aa, synthetic construct
  REGION 1..5: note = Synthetic Construct
KHYQK

SEQ ID NO: 4481 - protein, 5 aa, synthetic construct
  REGION 1..5: note = Synthetic Construct
KHYRK

SEQ ID NO: 4482 - protein, 5 aa, synthetic construct
  REGION 1..5: note = Synthetic Construct
KHYSK

SEQ ID NO: 4483 - protein, 5 aa, synthetic construct
  REGION 1..5: note = Synthetic Construct
KHYTK

SEQ ID NO: 4484 - protein, 5 aa, synthetic construct
  REGION 1..5: note = Synthetic Construct
KHYYK

SEQ ID NO: 4485 - protein, 5 aa, synthetic construct
  REGION 1..5: note = Synthetic Construct
KIAAK

SEQ ID NO: 4486 - protein, 5 aa, synthetic construct
  REGION 1..5: note = Synthetic Construct
KIADK

SEQ ID NO: 4487 - protein, 5 aa, synthetic construct
  REGION 1..5: note = Synthetic Construct
KIAEK

SEQ ID NO: 4488 - protein, 5 aa, synthetic construct
  REGION 1..5: note = Synthetic Construct
KIAFK

SEQ ID NO: 4489 - protein, 5 aa, synthetic construct
  REGION 1..5: note = Synthetic Construct
KIAGK

SEQ ID NO: 4490 - protein, 5 aa, synthetic construct
  REGION 1..5: note = Synthetic Construct
KIAHK

SEQ ID NO: 4491 - protein, 5 aa, synthetic construct
  REGION 1..5: note = Synthetic Construct
KIAIK

SEQ ID NO: 4492 - protein, 5 aa, synthetic construct
  REGION 1..5: note = Synthetic Construct
KIALK

SEQ ID NO: 4493 - protein, 5 aa, synthetic construct
  REGION 1..5: note = Synthetic Construct
KIANK

SEQ ID NO: 4494 - protein, 5 aa, synthetic construct
  REGION 1..5: note = Synthetic Construct
KIAQK

SEQ ID NO: 4495 - protein, 5 aa, synthetic construct
  REGION 1..5: note = Synthetic Construct
KIARK

SEQ ID NO: 4496 - protein, 5 aa, synthetic construct
  REGION 1..5: note = Synthetic Construct
KIASK

SEQ ID NO: 4497 - protein, 5 aa, synthetic construct
  REGION 1..5: note = Synthetic Construct
KIATK

SEQ ID NO: 4498 - protein, 5 aa, synthetic construct
  REGION 1..5: note = Synthetic Construct
KIAYK

SEQ ID NO: 4499 - protein, 5 aa, synthetic construct
  REGION 1..5: note = Synthetic Construct
KIDAK

SEQ ID NO: 4500 - protein, 5 aa, synthetic construct
  REGION 1..5: note = Synthetic Construct
KIDDK

SEQ ID NO: 4501 - protein, 5 aa, synthetic construct
  REGION 1..5: note = Synthetic Construct
KIDEK

SEQ ID NO: 4502 - protein, 5 aa, synthetic construct
  REGION 1..5: note = Synthetic Construct
KIDFK

SEQ ID NO: 4503 - protein, 5 aa, synthetic construct
  REGION 1..5: note = Synthetic Construct
KIDGK

SEQ ID NO: 4504 - protein, 5 aa, synthetic construct
  REGION 1..5: note = Synthetic Construct
KIDHK

SEQ ID NO: 4505 - protein, 5 aa, synthetic construct
  REGION 1..5: note = Synthetic Construct
KIDIK

SEQ ID NO: 4506 - protein, 5 aa, synthetic construct
  REGION 1..5: note = Synthetic Construct
KIDLK

SEQ ID NO: 4507 - protein, 5 aa, synthetic construct
  REGION 1..5: note = Synthetic Construct
KIDNK

SEQ ID NO: 4508 - protein, 5 aa, synthetic construct
  REGION 1..5: note = Synthetic Construct
KIDQK

SEQ ID NO: 4509 - protein, 5 aa, synthetic construct
  REGION 1..5: note = Synthetic Construct
KIDRK

SEQ ID NO: 4510 - protein, 5 aa, synthetic construct
  REGION 1..5: note = Synthetic Construct
KIDSK

SEQ ID NO: 4511 - protein, 5 aa, synthetic construct
  REGION 1..5: note = Synthetic Construct
KIDTK

SEQ ID NO: 4512 - protein, 5 aa, synthetic construct
  REGION 1..5: note = Synthetic Construct
KIDYK

SEQ ID NO: 4513 - protein, 5 aa, synthetic construct
  REGION 1..5: note = Synthetic Construct
KIEAK

SEQ ID NO: 4514 - protein, 5 aa, synthetic construct
  REGION 1..5: note = Synthetic Construct
KIEDK

SEQ ID NO: 4515 - protein, 5 aa, synthetic construct
  REGION 1..5: note = Synthetic Construct
KIEEK

SEQ ID NO: 4516 - protein, 5 aa, synthetic construct
  REGION 1..5: note = Synthetic Construct
KIEFK

SEQ ID NO: 4517 - protein, 5 aa, synthetic construct
  REGION 1..5: note = Synthetic Construct
KIEGK

SEQ ID NO: 4518 - protein, 5 aa, synthetic construct
  REGION 1..5: note = Synthetic Construct
KIEHK

SEQ ID NO: 4519 - protein, 5 aa, synthetic construct
  REGION 1..5: note = Synthetic Construct
KIEIK

SEQ ID NO: 4520 - protein, 5 aa, synthetic construct
  REGION 1..5: note = Synthetic Construct
KIELK

SEQ ID NO: 4521 - protein, 5 aa, synthetic construct
  REGION 1..5: note = Synthetic Construct
KIENK

SEQ ID NO: 4522 - protein, 5 aa, synthetic construct
  REGION 1..5: note = Synthetic Construct
KIEQK

SEQ ID NO: 4523 - protein, 5 aa, synthetic construct
  REGION 1..5: note = Synthetic Construct
KIERK

SEQ ID NO: 4524 - protein, 5 aa, synthetic construct
  REGION 1..5: note = Synthetic Construct
KIESK

SEQ ID NO: 4525 - protein, 5 aa, synthetic construct
  REGION 1..5: note = Synthetic Construct
KIETK

SEQ ID NO: 4526 - protein, 5 aa, synthetic construct
  REGION 1..5: note = Synthetic Construct
KIEYK

SEQ ID NO: 4527 - protein, 5 aa, synthetic construct
  REGION 1..5: note = Synthetic Construct
KIFAK

SEQ ID NO: 4528 - protein, 5 aa, synthetic construct
  REGION 1..5: note = Synthetic Construct
KIFDK

SEQ ID NO: 4529 - protein, 5 aa, synthetic construct
  REGION 1..5: note = Synthetic Construct
KIFEK

SEQ ID NO: 4530 - protein, 5 aa, synthetic construct
  REGION 1..5: note = Synthetic Construct
KIFFK

SEQ ID NO: 4531 - protein, 5 aa, synthetic construct
  REGION 1..5: note = Synthetic Construct
KIFGK

SEQ ID NO: 4532 - protein, 5 aa, synthetic construct
  REGION 1..5: note = Synthetic Construct
KIFHK

SEQ ID NO: 4533 - protein, 5 aa, synthetic construct
  REGION 1..5: note = Synthetic Construct
KIFIK

SEQ ID NO: 4534 - protein, 5 aa, synthetic construct
  REGION 1..5: note = Synthetic Construct
KIFLK

SEQ ID NO: 4535 - protein, 5 aa, synthetic construct
  REGION 1..5: note = Synthetic Construct
KIFNK

SEQ ID NO: 4536 - protein, 5 aa, synthetic construct
  REGION 1..5: note = Synthetic Construct
KIFQK

SEQ ID NO: 4537 - protein, 5 aa, synthetic construct
  REGION 1..5: note = Synthetic Construct
KIFRK

SEQ ID NO: 4538 - protein, 5 aa, synthetic construct
  REGION 1..5: note = Synthetic Construct
KIFSK

SEQ ID NO: 4539 - protein, 5 aa, synthetic construct
  REGION 1..5: note = Synthetic Construct
KIFTK

SEQ ID NO: 4540 - protein, 5 aa, synthetic construct
  REGION 1..5: note = Synthetic Construct
KIFYK

SEQ ID NO: 4541 - protein, 5 aa, synthetic construct
  REGION 1..5: note = Synthetic Construct
KIGAK

SEQ ID NO: 4542 - protein, 5 aa, synthetic construct
  REGION 1..5: note = Synthetic Construct
KIGDK

SEQ ID NO: 4543 - protein, 5 aa, synthetic construct
  REGION 1..5: note = Synthetic Construct
KIGEK

SEQ ID NO: 4544 - protein, 5 aa, synthetic construct
  REGION 1..5: note = Synthetic Construct
KIGFK

SEQ ID NO: 4545 - protein, 5 aa, synthetic construct
  REGION 1..5: note = Synthetic Construct
KIGGK

SEQ ID NO: 4546 - protein, 5 aa, synthetic construct
  REGION 1..5: note = Synthetic Construct
KIGHK

SEQ ID NO: 4547 - protein, 5 aa, synthetic construct
  REGION 1..5: note = Synthetic Construct
KIGIK

SEQ ID NO: 4548 - protein, 5 aa, synthetic construct
  REGION 1..5: note = Synthetic Construct
KIGLK

SEQ ID NO: 4549 - protein, 5 aa, synthetic construct
  REGION 1..5: note = Synthetic Construct
KIGNK

SEQ ID NO: 4550 - protein, 5 aa, synthetic construct
  REGION 1..5: note = Synthetic Construct
KIGQK

SEQ ID NO: 4551 - protein, 5 aa, synthetic construct
  REGION 1..5: note = Synthetic Construct
KIGRK

SEQ ID NO: 4552 - protein, 5 aa, synthetic construct
  REGION 1..5: note = Synthetic Construct
KIGSK

SEQ ID NO: 4553 - protein, 5 aa, synthetic construct
  REGION 1..5: note = Synthetic Construct
KIGTK

SEQ ID NO: 4554 - protein, 5 aa, synthetic construct
  REGION 1..5: note = Synthetic Construct
KIGYK

SEQ ID NO: 4555 - protein, 5 aa, synthetic construct
  REGION 1..5: note = Synthetic Construct
KIHAK

SEQ ID NO: 4556 - protein, 5 aa, synthetic construct
  REGION 1..5: note = Synthetic Construct
KIHDK

SEQ ID NO: 4557 - protein, 5 aa, synthetic construct
  REGION 1..5: note = Synthetic Construct
KIHEK

SEQ ID NO: 4558 - protein, 5 aa, synthetic construct
  REGION 1..5: note = Synthetic Construct
KIHFK

SEQ ID NO: 4559 - protein, 5 aa, synthetic construct
  REGION 1..5: note = Synthetic Construct
KIHGK

SEQ ID NO: 4560 - protein, 5 aa, synthetic construct
  REGION 1..5: note = Synthetic Construct
KIHHK

SEQ ID NO: 4561 - protein, 5 aa, synthetic construct
  REGION 1..5: note = Synthetic Construct
KIHIK

SEQ ID NO: 4562 - protein, 5 aa, synthetic construct
  REGION 1..5: note = Synthetic Construct
KIHLK

SEQ ID NO: 4563 - protein, 5 aa, synthetic construct
  REGION 1..5: note = Synthetic Construct
KIHNK

SEQ ID NO: 4564 - protein, 5 aa, synthetic construct
  REGION 1..5: note = Synthetic Construct
KIHQK

SEQ ID NO: 4565 - protein, 5 aa, synthetic construct
  REGION 1..5: note = Synthetic Construct
KIHRK

SEQ ID NO: 4566 - protein, 5 aa, synthetic construct
  REGION 1..5: note = Synthetic Construct
KIHSK

SEQ ID NO: 4567 - protein, 5 aa, synthetic construct
  REGION 1..5: note = Synthetic Construct
KIHTK

SEQ ID NO: 4568 - protein, 5 aa, synthetic construct
  REGION 1..5: note = Synthetic Construct
KIHYK

SEQ ID NO: 4569 - protein, 5 aa, synthetic construct
  REGION 1..5: note = Synthetic Construct
KIIAK

SEQ ID NO: 4570 - protein, 5 aa, synthetic construct
  REGION 1..5: note = Synthetic Construct
KIIDK

SEQ ID NO: 4571 - protein, 5 aa, synthetic construct
  REGION 1..5: note = Synthetic Construct
KIIEK

SEQ ID NO: 4572 - protein, 5 aa, synthetic construct
  REGION 1..5: note = Synthetic Construct
KIIFK

SEQ ID NO: 4573 - protein, 5 aa, synthetic construct
  REGION 1..5: note = Synthetic Construct
KIIGK

SEQ ID NO: 4574 - protein, 5 aa, synthetic construct
  REGION 1..5: note = Synthetic Construct
KIIHK

SEQ ID NO: 4575 - protein, 5 aa, synthetic construct
  REGION 1..5: note = Synthetic Construct
KIIIK

SEQ ID NO: 4576 - protein, 5 aa, synthetic construct
  REGION 1..5: note = Synthetic Construct
KIILK

SEQ ID NO: 4577 - protein, 5 aa, synthetic construct
  REGION 1..5: note = Synthetic Construct
KIINK

SEQ ID NO: 4578 - protein, 5 aa, synthetic construct
  REGION 1..5: note = Synthetic Construct
KIIQK

SEQ ID NO: 4579 - protein, 5 aa, synthetic construct
  REGION 1..5: note = Synthetic Construct
KIIRK

SEQ ID NO: 4580 - protein, 5 aa, synthetic construct
  REGION 1..5: note = Synthetic Construct
KIISK

SEQ ID NO: 4581 - protein, 5 aa, synthetic construct
  REGION 1..5: note = Synthetic Construct
KIITK

SEQ ID NO: 4582 - protein, 5 aa, synthetic construct
  REGION 1..5: note = Synthetic Construct
KIIYK

SEQ ID NO: 4583 - protein, 5 aa, synthetic construct
  REGION 1..5: note = Synthetic Construct
KILAK

SEQ ID NO: 4584 - protein, 5 aa, synthetic construct
  REGION 1..5: note = Synthetic Construct
KILDK

SEQ ID NO: 4585 - protein, 5 aa, synthetic construct
  REGION 1..5: note = Synthetic Construct
KILEK

SEQ ID NO: 4586 - protein, 5 aa, synthetic construct
  REGION 1..5: note = Synthetic Construct
KILFK

SEQ ID NO: 4587 - protein, 5 aa, synthetic construct
  REGION 1..5: note = Synthetic Construct
KILGK

SEQ ID NO: 4588 - protein, 5 aa, synthetic construct
  REGION 1..5: note = Synthetic Construct
KILHK

SEQ ID NO: 4589 - protein, 5 aa, synthetic construct
  REGION 1..5: note = Synthetic Construct
KILIK

SEQ ID NO: 4590 - protein, 5 aa, synthetic construct
  REGION 1..5: note = Synthetic Construct
KILLK

SEQ ID NO: 4591 - protein, 5 aa, synthetic construct
  REGION 1..5: note = Synthetic Construct
KILNK

SEQ ID NO: 4592 - protein, 5 aa, synthetic construct
  REGION 1..5: note = Synthetic Construct
KILQK

SEQ ID NO: 4593 - protein, 5 aa, synthetic construct
  REGION 1..5: note = Synthetic Construct
KILRK

SEQ ID NO: 4594 - protein, 5 aa, synthetic construct
  REGION 1..5: note = Synthetic Construct
KILSK

SEQ ID NO: 4595 - protein, 5 aa, synthetic construct
  REGION 1..5: note = Synthetic Construct
KILTK

SEQ ID NO: 4596 - protein, 5 aa, synthetic construct
  REGION 1..5: note = Synthetic Construct
KILYK

SEQ ID NO: 4597 - protein, 5 aa, synthetic construct
  REGION 1..5: note = Synthetic Construct
KINAK

SEQ ID NO: 4598 - protein, 5 aa, synthetic construct
  REGION 1..5: note = Synthetic Construct
KINDK

SEQ ID NO: 4599 - protein, 5 aa, synthetic construct
  REGION 1..5: note = Synthetic Construct
KINEK

SEQ ID NO: 4600 - protein, 5 aa, synthetic construct
  REGION 1..5: note = Synthetic Construct
KINFK

SEQ ID NO: 4601 - protein, 5 aa, synthetic construct
  REGION 1..5: note = Synthetic Construct
KINGK

SEQ ID NO: 4602 - protein, 5 aa, synthetic construct
  REGION 1..5: note = Synthetic Construct
KINHK

SEQ ID NO: 4603 - protein, 5 aa, synthetic construct
  REGION 1..5: note = Synthetic Construct
KINIK

SEQ ID NO: 4604 - protein, 5 aa, synthetic construct
  REGION 1..5: note = Synthetic Construct
KINLK

SEQ ID NO: 4605 - protein, 5 aa, synthetic construct
  REGION 1..5: note = Synthetic Construct
KINNK

SEQ ID NO: 4606 - protein, 5 aa, synthetic construct
  REGION 1..5: note = Synthetic Construct
KINQK

SEQ ID NO: 4607 - protein, 5 aa, synthetic construct
  REGION 1..5: note = Synthetic Construct
KINRK

SEQ ID NO: 4608 - protein, 5 aa, synthetic construct
  REGION 1..5: note = Synthetic Construct
KINSK

SEQ ID NO: 4609 - protein, 5 aa, synthetic construct
  REGION 1..5: note = Synthetic Construct
KINTK

SEQ ID NO: 4610 - protein, 5 aa, synthetic construct
  REGION 1..5: note = Synthetic Construct
KINYK

SEQ ID NO: 4611 - protein, 5 aa, synthetic construct
  REGION 1..5: note = Synthetic Construct
KIPAK

SEQ ID NO: 4612 - protein, 5 aa, synthetic construct
  REGION 1..5: note = Synthetic Construct
KIPDK

SEQ ID NO: 4613 - protein, 5 aa, synthetic construct
  REGION 1..5: note = Synthetic Construct
KIPEK

SEQ ID NO: 4614 - protein, 5 aa, synthetic construct
  REGION 1..5: note = Synthetic Construct
KIPFK

SEQ ID NO: 4615 - protein, 5 aa, synthetic construct
  REGION 1..5: note = Synthetic Construct
KIPGK

SEQ ID NO: 4616 - protein, 5 aa, synthetic construct
  REGION 1..5: note = Synthetic Construct
KIPHK

SEQ ID NO: 4617 - protein, 5 aa, synthetic construct
  REGION 1..5: note = Synthetic Construct
KIPIK

SEQ ID NO: 4618 - protein, 5 aa, synthetic construct
  REGION 1..5: note = Synthetic Construct
KIPLK

SEQ ID NO: 4619 - protein, 5 aa, synthetic construct
  REGION 1..5: note = Synthetic Construct
KIPNK

SEQ ID NO: 4620 - protein, 5 aa, synthetic construct
  REGION 1..5: note = Synthetic Construct
KIPQK

SEQ ID NO: 4621 - protein, 5 aa, synthetic construct
  REGION 1..5: note = Synthetic Construct
KIPRK

SEQ ID NO: 4622 - protein, 5 aa, synthetic construct
  REGION 1..5: note = Synthetic Construct
KIPSK

SEQ ID NO: 4623 - protein, 5 aa, synthetic construct
  REGION 1..5: note = Synthetic Construct
KIPTK

SEQ ID NO: 4624 - protein, 5 aa, synthetic construct
  REGION 1..5: note = Synthetic Construct
KIPYK

SEQ ID NO: 4625 - protein, 5 aa, synthetic construct
  REGION 1..5: note = Synthetic Construct
KIQAK

SEQ ID NO: 4626 - protein, 5 aa, synthetic construct
  REGION 1..5: note = Synthetic Construct
KIQDK

SEQ ID NO: 4627 - protein, 5 aa, synthetic construct
  REGION 1..5: note = Synthetic Construct
KIQEK

SEQ ID NO: 4628 - protein, 5 aa, synthetic construct
  REGION 1..5: note = Synthetic Construct
KIQFK

SEQ ID NO: 4629 - protein, 5 aa, synthetic construct
  REGION 1..5: note = Synthetic Construct
KIQGK

SEQ ID NO: 4630 - protein, 5 aa, synthetic construct
  REGION 1..5: note = Synthetic Construct
KIQHK

SEQ ID NO: 4631 - protein, 5 aa, synthetic construct
  REGION 1..5: note = Synthetic Construct
KIQIK

SEQ ID NO: 4632 - protein, 5 aa, synthetic construct
  REGION 1..5: note = Synthetic Construct
KIQLK

SEQ ID NO: 4633 - protein, 5 aa, synthetic construct
  REGION 1..5: note = Synthetic Construct
KIQNK

SEQ ID NO: 4634 - protein, 5 aa, synthetic construct
  REGION 1..5: note = Synthetic Construct
KIQQK

SEQ ID NO: 4635 - protein, 5 aa, synthetic construct
  REGION 1..5: note = Synthetic Construct
KIQRK

SEQ ID NO: 4636 - protein, 5 aa, synthetic construct
  REGION 1..5: note = Synthetic Construct
KIQSK

SEQ ID NO: 4637 - protein, 5 aa, synthetic construct
  REGION 1..5: note = Synthetic Construct
KIQTK

SEQ ID NO: 4638 - protein, 5 aa, synthetic construct
  REGION 1..5: note = Synthetic Construct
KIQYK

SEQ ID NO: 4639 - protein, 5 aa, synthetic construct
  REGION 1..5: note = Synthetic Construct
KIRAK

SEQ ID NO: 4640 - protein, 5 aa, synthetic construct
  REGION 1..5: note = Synthetic Construct
KIRDK

SEQ ID NO: 4641 - protein, 5 aa, synthetic construct
  REGION 1..5: note = Synthetic Construct
KIREK

SEQ ID NO: 4642 - protein, 5 aa, synthetic construct
  REGION 1..5: note = Synthetic Construct
KIRFK

SEQ ID NO: 4643 - protein, 5 aa, synthetic construct
  REGION 1..5: note = Synthetic Construct
KIRGK

SEQ ID NO: 4644 - protein, 5 aa, synthetic construct
  REGION 1..5: note = Synthetic Construct
KIRHK

SEQ ID NO: 4645 - protein, 5 aa, synthetic construct
  REGION 1..5: note = Synthetic Construct
KIRIK

SEQ ID NO: 4646 - protein, 5 aa, synthetic construct
  REGION 1..5: note = Synthetic Construct
KIRLK

SEQ ID NO: 4647 - protein, 5 aa, synthetic construct
  REGION 1..5: note = Synthetic Construct
KIRNK

SEQ ID NO: 4648 - protein, 5 aa, synthetic construct
  REGION 1..5: note = Synthetic Construct
KIRQK

SEQ ID NO: 4649 - protein, 5 aa, synthetic construct
  REGION 1..5: note = Synthetic Construct
KIRRK

SEQ ID NO: 4650 - protein, 5 aa, synthetic construct
  REGION 1..5: note = Synthetic Construct
KIRSK

SEQ ID NO: 4651 - protein, 5 aa, synthetic construct
  REGION 1..5: note = Synthetic Construct
KIRTK

SEQ ID NO: 4652 - protein, 5 aa, synthetic construct
  REGION 1..5: note = Synthetic Construct
KIRYK

SEQ ID NO: 4653 - protein, 5 aa, synthetic construct
  REGION 1..5: note = Synthetic Construct
KISAK

SEQ ID NO: 4654 - protein, 5 aa, synthetic construct
  REGION 1..5: note = Synthetic Construct
KISDK

SEQ ID NO: 4655 - protein, 5 aa, synthetic construct
  REGION 1..5: note = Synthetic Construct
KISEK

SEQ ID NO: 4656 - protein, 5 aa, synthetic construct
  REGION 1..5: note = Synthetic Construct
KISFK

SEQ ID NO: 4657 - protein, 5 aa, synthetic construct
  REGION 1..5: note = Synthetic Construct
KISGK

SEQ ID NO: 4658 - protein, 5 aa, synthetic construct
  REGION 1..5: note = Synthetic Construct
KISHK

SEQ ID NO: 4659 - protein, 5 aa, synthetic construct
  REGION 1..5: note = Synthetic Construct
KISIK

SEQ ID NO: 4660 - protein, 5 aa, synthetic construct
  REGION 1..5: note = Synthetic Construct
KISLK

SEQ ID NO: 4661 - protein, 5 aa, synthetic construct
  REGION 1..5: note = Synthetic Construct
KISNK

SEQ ID NO: 4662 - protein, 5 aa, synthetic construct
  REGION 1..5: note = Synthetic Construct
KISQK

SEQ ID NO: 4663 - protein, 5 aa, synthetic construct
  REGION 1..5: note = Synthetic Construct
KISRK

SEQ ID NO: 4664 - protein, 5 aa, synthetic construct
  REGION 1..5: note = Synthetic Construct
KISSK

SEQ ID NO: 4665 - protein, 5 aa, synthetic construct
  REGION 1..5: note = Synthetic Construct
KISTK

SEQ ID NO: 4666 - protein, 5 aa, synthetic construct
  REGION 1..5: note = Synthetic Construct
KISYK

SEQ ID NO: 4667 - protein, 5 aa, synthetic construct
  REGION 1..5: note = Synthetic Construct
KITAK

SEQ ID NO: 4668 - protein, 5 aa, synthetic construct
  REGION 1..5: note = Synthetic Construct
KITDK

SEQ ID NO: 4669 - protein, 5 aa, synthetic construct
  REGION 1..5: note = Synthetic Construct
KITEK

SEQ ID NO: 4670 - protein, 5 aa, synthetic construct
  REGION 1..5: note = Synthetic Construct
KITFK

SEQ ID NO: 4671 - protein, 5 aa, synthetic construct
  REGION 1..5: note = Synthetic Construct
KITGK

SEQ ID NO: 4672 - protein, 5 aa, synthetic construct
  REGION 1..5: note = Synthetic Construct
KITHK

SEQ ID NO: 4673 - protein, 5 aa, synthetic construct
  REGION 1..5: note = Synthetic Construct
KITIK

SEQ ID NO: 4674 - protein, 5 aa, synthetic construct
  REGION 1..5: note = Synthetic Construct
KITLK

SEQ ID NO: 4675 - protein, 5 aa, synthetic construct
  REGION 1..5: note = Synthetic Construct
KITNK

SEQ ID NO: 4676 - protein, 5 aa, synthetic construct
  REGION 1..5: note = Synthetic Construct
KITQK

SEQ ID NO: 4677 - protein, 5 aa, synthetic construct
  REGION 1..5: note = Synthetic Construct
KITRK

SEQ ID NO: 4678 - protein, 5 aa, synthetic construct
  REGION 1..5: note = Synthetic Construct
KITSK

SEQ ID NO: 4679 - protein, 5 aa, synthetic construct
  REGION 1..5: note = Synthetic Construct
KITTK

SEQ ID NO: 4680 - protein, 5 aa, synthetic construct
  REGION 1..5: note = Synthetic Construct
KITYK

SEQ ID NO: 4681 - protein, 5 aa, synthetic construct
  REGION 1..5: note = Synthetic Construct
KIYAK

SEQ ID NO: 4682 - protein, 5 aa, synthetic construct
  REGION 1..5: note = Synthetic Construct
KIYDK

SEQ ID NO: 4683 - protein, 5 aa, synthetic construct
  REGION 1..5: note = Synthetic Construct
KIYEK

SEQ ID NO: 4684 - protein, 5 aa, synthetic construct
  REGION 1..5: note = Synthetic Construct
KIYFK

SEQ ID NO: 4685 - protein, 5 aa, synthetic construct
  REGION 1..5: note = Synthetic Construct
KIYGK

SEQ ID NO: 4686 - protein, 5 aa, synthetic construct
  REGION 1..5: note = Synthetic Construct
KIYHK

SEQ ID NO: 4687 - protein, 5 aa, synthetic construct
  REGION 1..5: note = Synthetic Construct
KIYIK

SEQ ID NO: 4688 - protein, 5 aa, synthetic construct
  REGION 1..5: note = Synthetic Construct
KIYLK

SEQ ID NO: 4689 - protein, 5 aa, synthetic construct
  REGION 1..5: note = Synthetic Construct
KIYNK

SEQ ID NO: 4690 - protein, 5 aa, synthetic construct
  REGION 1..5: note = Synthetic Construct
KIYQK

SEQ ID NO: 4691 - protein, 5 aa, synthetic construct
  REGION 1..5: note = Synthetic Construct
KIYRK

SEQ ID NO: 4692 - protein, 5 aa, synthetic construct
  REGION 1..5: note = Synthetic Construct
KIYSK

SEQ ID NO: 4693 - protein, 5 aa, synthetic construct
  REGION 1..5: note = Synthetic Construct
KIYTK

SEQ ID NO: 4694 - protein, 5 aa, synthetic construct
  REGION 1..5: note = Synthetic Construct
KIYYK

SEQ ID NO: 4695 - protein, 5 aa, synthetic construct
  REGION 1..5: note = Synthetic Construct
KLAAK

SEQ ID NO: 4696 - protein, 5 aa, synthetic construct
  REGION 1..5: note = Synthetic Construct
KLADK

SEQ ID NO: 4697 - protein, 5 aa, synthetic construct
  REGION 1..5: note = Synthetic Construct
KLAEK

SEQ ID NO: 4698 - protein, 5 aa, synthetic construct
  REGION 1..5: note = Synthetic Construct
KLAFK

SEQ ID NO: 4699 - protein, 5 aa, synthetic construct
  REGION 1..5: note = Synthetic Construct
KLAGK

SEQ ID NO: 4700 - protein, 5 aa, synthetic construct
  REGION 1..5: note = Synthetic Construct
KLAHK

SEQ ID NO: 4701 - protein, 5 aa, synthetic construct
  REGION 1..5: note = Synthetic Construct
KLAIK

SEQ ID NO: 4702 - protein, 5 aa, synthetic construct
  REGION 1..5: note = Synthetic Construct
KLALK

SEQ ID NO: 4703 - protein, 5 aa, synthetic construct
  REGION 1..5: note = Synthetic Construct
KLANK

SEQ ID NO: 4704 - protein, 5 aa, synthetic construct
  REGION 1..5: note = Synthetic Construct
KLAQK

SEQ ID NO: 4705 - protein, 5 aa, synthetic construct
  REGION 1..5: note = Synthetic Construct
KLARK

SEQ ID NO: 4706 - protein, 5 aa, synthetic construct
  REGION 1..5: note = Synthetic Construct
KLASK

SEQ ID NO: 4707 - protein, 5 aa, synthetic construct
  REGION 1..5: note = Synthetic Construct
KLATK

SEQ ID NO: 4708 - protein, 5 aa, synthetic construct
  REGION 1..5: note = Synthetic Construct
KLAYK

SEQ ID NO: 4709 - protein, 5 aa, synthetic construct
  REGION 1..5: note = Synthetic Construct
KLDAK

SEQ ID NO: 4710 - protein, 5 aa, synthetic construct
  REGION 1..5: note = Synthetic Construct
KLDDK

SEQ ID NO: 4711 - protein, 5 aa, synthetic construct
  REGION 1..5: note = Synthetic Construct
KLDEK

SEQ ID NO: 4712 - protein, 5 aa, synthetic construct
  REGION 1..5: note = Synthetic Construct
KLDFK

SEQ ID NO: 4713 - protein, 5 aa, synthetic construct
  REGION 1..5: note = Synthetic Construct
KLDGK

SEQ ID NO: 4714 - protein, 5 aa, synthetic construct
  REGION 1..5: note = Synthetic Construct
KLDHK

SEQ ID NO: 4715 - protein, 5 aa, synthetic construct
  REGION 1..5: note = Synthetic Construct
KLDIK

SEQ ID NO: 4716 - protein, 5 aa, synthetic construct
  REGION 1..5: note = Synthetic Construct
KLDLK

SEQ ID NO: 4717 - protein, 5 aa, synthetic construct
  REGION 1..5: note = Synthetic Construct
KLDNK

SEQ ID NO: 4718 - protein, 5 aa, synthetic construct
  REGION 1..5: note = Synthetic Construct
KLDQK

SEQ ID NO: 4719 - protein, 5 aa, synthetic construct
  REGION 1..5: note = Synthetic Construct
KLDRK

SEQ ID NO: 4720 - protein, 5 aa, synthetic construct
  REGION 1..5: note = Synthetic Construct
KLDSK

SEQ ID NO: 4721 - protein, 5 aa, synthetic construct
  REGION 1..5: note = Synthetic Construct
KLDTK

SEQ ID NO: 4722 - protein, 5 aa, synthetic construct
  REGION 1..5: note = Synthetic Construct
KLDYK

SEQ ID NO: 4723 - protein, 5 aa, synthetic construct
  REGION 1..5: note = Synthetic Construct
KLEAK

SEQ ID NO: 4724 - protein, 5 aa, synthetic construct
  REGION 1..5: note = Synthetic Construct
KLEDK

SEQ ID NO: 4725 - protein, 5 aa, synthetic construct
  REGION 1..5: note = Synthetic Construct
KLEEK

SEQ ID NO: 4726 - protein, 5 aa, synthetic construct
  REGION 1..5: note = Synthetic Construct
KLEFK

SEQ ID NO: 4727 - protein, 5 aa, synthetic construct
  REGION 1..5: note = Synthetic Construct
KLEGK

SEQ ID NO: 4728 - protein, 5 aa, synthetic construct
  REGION 1..5: note = Synthetic Construct
KLEHK

SEQ ID NO: 4729 - protein, 5 aa, synthetic construct
  REGION 1..5: note = Synthetic Construct
KLEIK

SEQ ID NO: 4730 - protein, 5 aa, synthetic construct
  REGION 1..5: note = Synthetic Construct
KLELK

SEQ ID NO: 4731 - protein, 5 aa, synthetic construct
  REGION 1..5: note = Synthetic Construct
KLENK

SEQ ID NO: 4732 - protein, 5 aa, synthetic construct
  REGION 1..5: note = Synthetic Construct
KLEQK

SEQ ID NO: 4733 - protein, 5 aa, synthetic construct
  REGION 1..5: note = Synthetic Construct
KLERK

SEQ ID NO: 4734 - protein, 5 aa, synthetic construct
  REGION 1..5: note = Synthetic Construct
KLESK

SEQ ID NO: 4735 - protein, 5 aa, synthetic construct
  REGION 1..5: note = Synthetic Construct
KLETK

SEQ ID NO: 4736 - protein, 5 aa, synthetic construct
  REGION 1..5: note = Synthetic Construct
KLEYK

SEQ ID NO: 4737 - protein, 5 aa, synthetic construct
  REGION 1..5: note = Synthetic Construct
KLFAK

SEQ ID NO: 4738 - protein, 5 aa, synthetic construct
  REGION 1..5: note = Synthetic Construct
KLFDK

SEQ ID NO: 4739 - protein, 5 aa, synthetic construct
  REGION 1..5: note = Synthetic Construct
KLFEK

SEQ ID NO: 4740 - protein, 5 aa, synthetic construct
  REGION 1..5: note = Synthetic Construct
KLFFK

SEQ ID NO: 4741 - protein, 5 aa, synthetic construct
  REGION 1..5: note = Synthetic Construct
KLFGK

SEQ ID NO: 4742 - protein, 5 aa, synthetic construct
  REGION 1..5: note = Synthetic Construct
KLFHK

SEQ ID NO: 4743 - protein, 5 aa, synthetic construct
  REGION 1..5: note = Synthetic Construct
KLFIK

SEQ ID NO: 4744 - protein, 5 aa, synthetic construct
  REGION 1..5: note = Synthetic Construct
KLFLK

SEQ ID NO: 4745 - protein, 5 aa, synthetic construct
  REGION 1..5: note = Synthetic Construct
KLFNK

SEQ ID NO: 4746 - protein, 5 aa, synthetic construct
  REGION 1..5: note = Synthetic Construct
KLFQK

SEQ ID NO: 4747 - protein, 5 aa, synthetic construct
  REGION 1..5: note = Synthetic Construct
KLFRK

SEQ ID NO: 4748 - protein, 5 aa, synthetic construct
  REGION 1..5: note = Synthetic Construct
KLFSK

SEQ ID NO: 4749 - protein, 5 aa, synthetic construct
  REGION 1..5: note = Synthetic Construct
KLFTK

SEQ ID NO: 4750 - protein, 5 aa, synthetic construct
  REGION 1..5: note = Synthetic Construct
KLFYK

SEQ ID NO: 4751 - protein, 5 aa, synthetic construct
  REGION 1..5: note = Synthetic Construct
KLGAK

SEQ ID NO: 4752 - protein, 5 aa, synthetic construct
  REGION 1..5: note = Synthetic Construct
KLGDK

SEQ ID NO: 4753 - protein, 5 aa, synthetic construct
  REGION 1..5: note = Synthetic Construct
KLGEK

SEQ ID NO: 4754 - protein, 5 aa, synthetic construct
  REGION 1..5: note = Synthetic Construct
KLGFK

SEQ ID NO: 4755 - protein, 5 aa, synthetic construct
  REGION 1..5: note = Synthetic Construct
KLGGK

SEQ ID NO: 4756 - protein, 5 aa, synthetic construct
  REGION 1..5: note = Synthetic Construct
KLGHK

SEQ ID NO: 4757 - protein, 5 aa, synthetic construct
  REGION 1..5: note = Synthetic Construct
KLGIK

SEQ ID NO: 4758 - protein, 5 aa, synthetic construct
  REGION 1..5: note = Synthetic Construct
KLGLK

SEQ ID NO: 4759 - protein, 5 aa, synthetic construct
  REGION 1..5: note = Synthetic Construct
KLGNK

SEQ ID NO: 4760 - protein, 5 aa, synthetic construct
  REGION 1..5: note = Synthetic Construct
KLGQK

SEQ ID NO: 4761 - protein, 5 aa, synthetic construct
  REGION 1..5: note = Synthetic Construct
KLGRK

SEQ ID NO: 4762 - protein, 5 aa, synthetic construct
  REGION 1..5: note = Synthetic Construct
KLGSK

SEQ ID NO: 4763 - protein, 5 aa, synthetic construct
  REGION 1..5: note = Synthetic Construct
KLGTK

SEQ ID NO: 4764 - protein, 5 aa, synthetic construct
  REGION 1..5: note = Synthetic Construct
KLGYK

SEQ ID NO: 4765 - protein, 5 aa, synthetic construct
  REGION 1..5: note = Synthetic Construct
KLHAK

SEQ ID NO: 4766 - protein, 5 aa, synthetic construct
  REGION 1..5: note = Synthetic Construct
KLHDK

SEQ ID NO: 4767 - protein, 5 aa, synthetic construct
  REGION 1..5: note = Synthetic Construct
KLHEK

SEQ ID NO: 4768 - protein, 5 aa, synthetic construct
  REGION 1..5: note = Synthetic Construct
KLHFK

SEQ ID NO: 4769 - protein, 5 aa, synthetic construct
  REGION 1..5: note = Synthetic Construct
KLHGK

SEQ ID NO: 4770 - protein, 5 aa, synthetic construct
  REGION 1..5: note = Synthetic Construct
KLHHK

SEQ ID NO: 4771 - protein, 5 aa, synthetic construct
  REGION 1..5: note = Synthetic Construct
KLHIK

SEQ ID NO: 4772 - protein, 5 aa, synthetic construct
  REGION 1..5: note = Synthetic Construct
KLHLK

SEQ ID NO: 4773 - protein, 5 aa, synthetic construct
  REGION 1..5: note = Synthetic Construct
KLHNK

SEQ ID NO: 4774 - protein, 5 aa, synthetic construct
  REGION 1..5: note = Synthetic Construct
KLHQK

SEQ ID NO: 4775 - protein, 5 aa, synthetic construct
  REGION 1..5: note = Synthetic Construct
KLHRK

SEQ ID NO: 4776 - protein, 5 aa, synthetic construct
  REGION 1..5: note = Synthetic Construct
KLHSK

SEQ ID NO: 4777 - protein, 5 aa, synthetic construct
  REGION 1..5: note = Synthetic Construct
KLHTK

SEQ ID NO: 4778 - protein, 5 aa, synthetic construct
  REGION 1..5: note = Synthetic Construct
KLHYK

SEQ ID NO: 4779 - protein, 5 aa, synthetic construct
  REGION 1..5: note = Synthetic Construct
KLIAK

SEQ ID NO: 4780 - protein, 5 aa, synthetic construct
  REGION 1..5: note = Synthetic Construct
KLIDK

SEQ ID NO: 4781 - protein, 5 aa, synthetic construct
  REGION 1..5: note = Synthetic Construct
KLIEK

SEQ ID NO: 4782 - protein, 5 aa, synthetic construct
  REGION 1..5: note = Synthetic Construct
KLIFK

SEQ ID NO: 4783 - protein, 5 aa, synthetic construct
  REGION 1..5: note = Synthetic Construct
KLIGK

SEQ ID NO: 4784 - protein, 5 aa, synthetic construct
  REGION 1..5: note = Synthetic Construct
KLIHK

SEQ ID NO: 4785 - protein, 5 aa, synthetic construct
  REGION 1..5: note = Synthetic Construct
KLIIK

SEQ ID NO: 4786 - protein, 5 aa, synthetic construct
  REGION 1..5: note = Synthetic Construct
KLILK

SEQ ID NO: 4787 - protein, 5 aa, synthetic construct
  REGION 1..5: note = Synthetic Construct
KLINK

SEQ ID NO: 4788 - protein, 5 aa, synthetic construct
  REGION 1..5: note = Synthetic Construct
KLIQK

SEQ ID NO: 4789 - protein, 5 aa, synthetic construct
  REGION 1..5: note = Synthetic Construct
KLIRK

SEQ ID NO: 4790 - protein, 5 aa, synthetic construct
  REGION 1..5: note = Synthetic Construct
KLISK

SEQ ID NO: 4791 - protein, 5 aa, synthetic construct
  REGION 1..5: note = Synthetic Construct
KLITK

SEQ ID NO: 4792 - protein, 5 aa, synthetic construct
  REGION 1..5: note = Synthetic Construct
KLIYK

SEQ ID NO: 4793 - protein, 5 aa, synthetic construct
  REGION 1..5: note = Synthetic Construct
KLLAK

SEQ ID NO: 4794 - protein, 5 aa, synthetic construct
  REGION 1..5: note = Synthetic Construct
KLLDK

SEQ ID NO: 4795 - protein, 5 aa, synthetic construct
  REGION 1..5: note = Synthetic Construct
KLLEK

SEQ ID NO: 4796 - protein, 5 aa, synthetic construct
  REGION 1..5: note = Synthetic Construct
KLLFK

SEQ ID NO: 4797 - protein, 5 aa, synthetic construct
  REGION 1..5: note = Synthetic Construct
KLLGK

SEQ ID NO: 4798 - protein, 5 aa, synthetic construct
  REGION 1..5: note = Synthetic Construct
KLLHK

SEQ ID NO: 4799 - protein, 5 aa, synthetic construct
  REGION 1..5: note = Synthetic Construct
KLLIK

SEQ ID NO: 4800 - protein, 5 aa, synthetic construct
  REGION 1..5: note = Synthetic Construct
KLLLK

SEQ ID NO: 4801 - protein, 5 aa, synthetic construct
  REGION 1..5: note = Synthetic Construct
KLLNK

SEQ ID NO: 4802 - protein, 5 aa, synthetic construct
  REGION 1..5: note = Synthetic Construct
KLLQK

SEQ ID NO: 4803 - protein, 5 aa, synthetic construct
  REGION 1..5: note = Synthetic Construct
KLLRK

SEQ ID NO: 4804 - protein, 5 aa, synthetic construct
  REGION 1..5: note = Synthetic Construct
KLLSK

SEQ ID NO: 4805 - protein, 5 aa, synthetic construct
  REGION 1..5: note = Synthetic Construct
KLLTK

SEQ ID NO: 4806 - protein, 5 aa, synthetic construct
  REGION 1..5: note = Synthetic Construct
KLLYK

SEQ ID NO: 4807 - protein, 5 aa, synthetic construct
  REGION 1..5: note = Synthetic Construct
KLNAK

SEQ ID NO: 4808 - protein, 5 aa, synthetic construct
  REGION 1..5: note = Synthetic Construct
KLNDK

SEQ ID NO: 4809 - protein, 5 aa, synthetic construct
  REGION 1..5: note = Synthetic Construct
KLNEK

SEQ ID NO: 4810 - protein, 5 aa, synthetic construct
  REGION 1..5: note = Synthetic Construct
KLNFK

SEQ ID NO: 4811 - protein, 5 aa, synthetic construct
  REGION 1..5: note = Synthetic Construct
KLNGK

SEQ ID NO: 4812 - protein, 5 aa, synthetic construct
  REGION 1..5: note = Synthetic Construct
KLNHK

SEQ ID NO: 4813 - protein, 5 aa, synthetic construct
  REGION 1..5: note = Synthetic Construct
KLNIK

SEQ ID NO: 4814 - protein, 5 aa, synthetic construct
  REGION 1..5: note = Synthetic Construct
KLNLK

SEQ ID NO: 4815 - protein, 5 aa, synthetic construct
  REGION 1..5: note = Synthetic Construct
KLNNK

SEQ ID NO: 4816 - protein, 5 aa, synthetic construct
  REGION 1..5: note = Synthetic Construct
KLNQK

SEQ ID NO: 4817 - protein, 5 aa, synthetic construct
  REGION 1..5: note = Synthetic Construct
KLNRK

SEQ ID NO: 4818 - protein, 5 aa, synthetic construct
  REGION 1..5: note = Synthetic Construct
KLNSK

SEQ ID NO: 4819 - protein, 5 aa, synthetic construct
  REGION 1..5: note = Synthetic Construct
KLNTK

SEQ ID NO: 4820 - protein, 5 aa, synthetic construct
  REGION 1..5: note = Synthetic Construct
KLNYK

SEQ ID NO: 4821 - protein, 5 aa, synthetic construct
  REGION 1..5: note = Synthetic Construct
KLPAK

SEQ ID NO: 4822 - protein, 5 aa, synthetic construct
  REGION 1..5: note = Synthetic Construct
KLPDK

SEQ ID NO: 4823 - protein, 5 aa, synthetic construct
  REGION 1..5: note = Synthetic Construct
KLPEK

SEQ ID NO: 4824 - protein, 5 aa, synthetic construct
  REGION 1..5: note = Synthetic Construct
KLPFK

SEQ ID NO: 4825 - protein, 5 aa, synthetic construct
  REGION 1..5: note = Synthetic Construct
KLPGK

SEQ ID NO: 4826 - protein, 5 aa, synthetic construct
  REGION 1..5: note = Synthetic Construct
KLPHK

SEQ ID NO: 4827 - protein, 5 aa, synthetic construct
  REGION 1..5: note = Synthetic Construct
KLPIK

SEQ ID NO: 4828 - protein, 5 aa, synthetic construct
  REGION 1..5: note = Synthetic Construct
KLPLK

SEQ ID NO: 4829 - protein, 5 aa, synthetic construct
  REGION 1..5: note = Synthetic Construct
KLPNK

SEQ ID NO: 4830 - protein, 5 aa, synthetic construct
  REGION 1..5: note = Synthetic Construct
KLPQK

SEQ ID NO: 4831 - protein, 5 aa, synthetic construct
  REGION 1..5: note = Synthetic Construct
KLPRK

SEQ ID NO: 4832 - protein, 5 aa, synthetic construct
  REGION 1..5: note = Synthetic Construct
KLPSK

SEQ ID NO: 4833 - protein, 5 aa, synthetic construct
  REGION 1..5: note = Synthetic Construct
KLPTK

SEQ ID NO: 4834 - protein, 5 aa, synthetic construct
  REGION 1..5: note = Synthetic Construct
KLPYK

SEQ ID NO: 4835 - protein, 5 aa, synthetic construct
  REGION 1..5: note = Synthetic Construct
KLQAK

SEQ ID NO: 4836 - protein, 5 aa, synthetic construct
  REGION 1..5: note = Synthetic Construct
KLQDK

SEQ ID NO: 4837 - protein, 5 aa, synthetic construct
  REGION 1..5: note = Synthetic Construct
KLQEK

SEQ ID NO: 4838 - protein, 5 aa, synthetic construct
  REGION 1..5: note = Synthetic Construct
KLQFK

SEQ ID NO: 4839 - protein, 5 aa, synthetic construct
  REGION 1..5: note = Synthetic Construct
KLQGK

SEQ ID NO: 4840 - protein, 5 aa, synthetic construct
  REGION 1..5: note = Synthetic Construct
KLQHK

SEQ ID NO: 4841 - protein, 5 aa, synthetic construct
  REGION 1..5: note = Synthetic Construct
KLQIK

SEQ ID NO: 4842 - protein, 5 aa, synthetic construct
  REGION 1..5: note = Synthetic Construct
KLQLK

SEQ ID NO: 4843 - protein, 5 aa, synthetic construct
  REGION 1..5: note = Synthetic Construct
KLQNK

SEQ ID NO: 4844 - protein, 5 aa, synthetic construct
  REGION 1..5: note = Synthetic Construct
KLQQK

SEQ ID NO: 4845 - protein, 5 aa, synthetic construct
  REGION 1..5: note = Synthetic Construct
KLQRK

SEQ ID NO: 4846 - protein, 5 aa, synthetic construct
  REGION 1..5: note = Synthetic Construct
KLQSK

SEQ ID NO: 4847 - protein, 5 aa, synthetic construct
  REGION 1..5: note = Synthetic Construct
KLQTK

SEQ ID NO: 4848 - protein, 5 aa, synthetic construct
  REGION 1..5: note = Synthetic Construct
KLQYK

SEQ ID NO: 4849 - protein, 5 aa, synthetic construct
  REGION 1..5: note = Synthetic Construct
KLRAK

SEQ ID NO: 4850 - protein, 5 aa, synthetic construct
  REGION 1..5: note = Synthetic Construct
KLRDK

SEQ ID NO: 4851 - protein, 5 aa, synthetic construct
  REGION 1..5: note = Synthetic Construct
KLREK

SEQ ID NO: 4852 - protein, 5 aa, synthetic construct
  REGION 1..5: note = Synthetic Construct
KLRFK

SEQ ID NO: 4853 - protein, 5 aa, synthetic construct
  REGION 1..5: note = Synthetic Construct
KLRGK

SEQ ID NO: 4854 - protein, 5 aa, synthetic construct
  REGION 1..5: note = Synthetic Construct
KLRHK

SEQ ID NO: 4855 - protein, 5 aa, synthetic construct
  REGION 1..5: note = Synthetic Construct
KLRIK

SEQ ID NO: 4856 - protein, 5 aa, synthetic construct
  REGION 1..5: note = Synthetic Construct
KLRLK

SEQ ID NO: 4857 - protein, 5 aa, synthetic construct
  REGION 1..5: note = Synthetic Construct
KLRNK

SEQ ID NO: 4858 - protein, 5 aa, synthetic construct
  REGION 1..5: note = Synthetic Construct
KLRQK

SEQ ID NO: 4859 - protein, 5 aa, synthetic construct
  REGION 1..5: note = Synthetic Construct
KLRRK

SEQ ID NO: 4860 - protein, 5 aa, synthetic construct
  REGION 1..5: note = Synthetic Construct
KLRSK

SEQ ID NO: 4861 - protein, 5 aa, synthetic construct
  REGION 1..5: note = Synthetic Construct
KLRTK

SEQ ID NO: 4862 - protein, 5 aa, synthetic construct
  REGION 1..5: note = Synthetic Construct
KLRYK

SEQ ID NO: 4863 - protein, 5 aa, synthetic construct
  REGION 1..5: note = Synthetic Construct
KLSAK

SEQ ID NO: 4864 - protein, 5 aa, synthetic construct
  REGION 1..5: note = Synthetic Construct
KLSDK

SEQ ID NO: 4865 - protein, 5 aa, synthetic construct
  REGION 1..5: note = Synthetic Construct
KLSEK

SEQ ID NO: 4866 - protein, 5 aa, synthetic construct
  REGION 1..5: note = Synthetic Construct
KLSFK

SEQ ID NO: 4867 - protein, 5 aa, synthetic construct
  REGION 1..5: note = Synthetic Construct
KLSGK

SEQ ID NO: 4868 - protein, 5 aa, synthetic construct
  REGION 1..5: note = Synthetic Construct
KLSHK

SEQ ID NO: 4869 - protein, 5 aa, synthetic construct
  REGION 1..5: note = Synthetic Construct
KLSIK

SEQ ID NO: 4870 - protein, 5 aa, synthetic construct
  REGION 1..5: note = Synthetic Construct
KLSLK

SEQ ID NO: 4871 - protein, 5 aa, synthetic construct
  REGION 1..5: note = Synthetic Construct
KLSNK

SEQ ID NO: 4872 - protein, 5 aa, synthetic construct
  REGION 1..5: note = Synthetic Construct
KLSQK

SEQ ID NO: 4873 - protein, 5 aa, synthetic construct
  REGION 1..5: note = Synthetic Construct
KLSRK

SEQ ID NO: 4874 - protein, 5 aa, synthetic construct
  REGION 1..5: note = Synthetic Construct
KLSSK

SEQ ID NO: 4875 - protein, 5 aa, synthetic construct
  REGION 1..5: note = Synthetic Construct
KLSTK

SEQ ID NO: 4876 - protein, 5 aa, synthetic construct
  REGION 1..5: note = Synthetic Construct
KLSYK

SEQ ID NO: 4877 - protein, 5 aa, synthetic construct
  REGION 1..5: note = Synthetic Construct
KLTAK

SEQ ID NO: 4878 - protein, 5 aa, synthetic construct
  REGION 1..5: note = Synthetic Construct
KLTDK

SEQ ID NO: 4879 - protein, 5 aa, synthetic construct
  REGION 1..5: note = Synthetic Construct
KLTEK

SEQ ID NO: 4880 - protein, 5 aa, synthetic construct
  REGION 1..5: note = Synthetic Construct
KLTFK

SEQ ID NO: 4881 - protein, 5 aa, synthetic construct
  REGION 1..5: note = Synthetic Construct
KLTGK

SEQ ID NO: 4882 - protein, 5 aa, synthetic construct
  REGION 1..5: note = Synthetic Construct
KLTHK

SEQ ID NO: 4883 - protein, 5 aa, synthetic construct
  REGION 1..5: note = Synthetic Construct
KLTIK

SEQ ID NO: 4884 - protein, 5 aa, synthetic construct
  REGION 1..5: note = Synthetic Construct
KLTLK

SEQ ID NO: 4885 - protein, 5 aa, synthetic construct
  REGION 1..5: note = Synthetic Construct
KLTNK

SEQ ID NO: 4886 - protein, 5 aa, synthetic construct
  REGION 1..5: note = Synthetic Construct
KLTQK

SEQ ID NO: 4887 - protein, 5 aa, synthetic construct
  REGION 1..5: note = Synthetic Construct
KLTRK

SEQ ID NO: 4888 - protein, 5 aa, synthetic construct
  REGION 1..5: note = Synthetic Construct
KLTSK

SEQ ID NO: 4889 - protein, 5 aa, synthetic construct
  REGION 1..5: note = Synthetic Construct
KLTTK

SEQ ID NO: 4890 - protein, 5 aa, synthetic construct
  REGION 1..5: note = Synthetic Construct
KLTYK

SEQ ID NO: 4891 - protein, 5 aa, synthetic construct
  REGION 1..5: note = Synthetic Construct
KLYAK

SEQ ID NO: 4892 - protein, 5 aa, synthetic construct
  REGION 1..5: note = Synthetic Construct
KLYDK

SEQ ID NO: 4893 - protein, 5 aa, synthetic construct
  REGION 1..5: note = Synthetic Construct
KLYEK

SEQ ID NO: 4894 - protein, 5 aa, synthetic construct
  REGION 1..5: note = Synthetic Construct
KLYFK

SEQ ID NO: 4895 - protein, 5 aa, synthetic construct
  REGION 1..5: note = Synthetic Construct
KLYGK

SEQ ID NO: 4896 - protein, 5 aa, synthetic construct
  REGION 1..5: note = Synthetic Construct
KLYHK

SEQ ID NO: 4897 - protein, 5 aa, synthetic construct
  REGION 1..5: note = Synthetic Construct
KLYIK

SEQ ID NO: 4898 - protein, 5 aa, synthetic construct
  REGION 1..5: note = Synthetic Construct
KLYLK

SEQ ID NO: 4899 - protein, 5 aa, synthetic construct
  REGION 1..5: note = Synthetic Construct
KLYNK

SEQ ID NO: 4900 - protein, 5 aa, synthetic construct
  REGION 1..5: note = Synthetic Construct
KLYQK

SEQ ID NO: 4901 - protein, 5 aa, synthetic construct
  REGION 1..5: note = Synthetic Construct
KLYRK

SEQ ID NO: 4902 - protein, 5 aa, synthetic construct
  REGION 1..5: note = Synthetic Construct
KLYSK

SEQ ID NO: 4903 - protein, 5 aa, synthetic construct
  REGION 1..5: note = Synthetic Construct
KLYTK

SEQ ID NO: 4904 - protein, 5 aa, synthetic construct
  REGION 1..5: note = Synthetic Construct
KLYYK

SEQ ID NO: 4905 - protein, 5 aa, synthetic construct
  REGION 1..5: note = Synthetic Construct
KNAAK

SEQ ID NO: 4906 - protein, 5 aa, synthetic construct
  REGION 1..5: note = Synthetic Construct
KNADK

SEQ ID NO: 4907 - protein, 5 aa, synthetic construct
  REGION 1..5: note = Synthetic Construct
KNAEK

SEQ ID NO: 4908 - protein, 5 aa, synthetic construct
  REGION 1..5: note = Synthetic Construct
KNAFK

SEQ ID NO: 4909 - protein, 5 aa, synthetic construct
  REGION 1..5: note = Synthetic Construct
KNAGK

SEQ ID NO: 4910 - protein, 5 aa, synthetic construct
  REGION 1..5: note = Synthetic Construct
KNAHK

SEQ ID NO: 4911 - protein, 5 aa, synthetic construct
  REGION 1..5: note = Synthetic Construct
KNAIK

SEQ ID NO: 4912 - protein, 5 aa, synthetic construct
  REGION 1..5: note = Synthetic Construct
KNALK

SEQ ID NO: 4913 - protein, 5 aa, synthetic construct
  REGION 1..5: note = Synthetic Construct
KNANK

SEQ ID NO: 4914 - protein, 5 aa, synthetic construct
  REGION 1..5: note = Synthetic Construct
KNAQK

SEQ ID NO: 4915 - protein, 5 aa, synthetic construct
  REGION 1..5: note = Synthetic Construct
KNARK

SEQ ID NO: 4916 - protein, 5 aa, synthetic construct
  REGION 1..5: note = Synthetic Construct
KNASK

SEQ ID NO: 4917 - protein, 5 aa, synthetic construct
  REGION 1..5: note = Synthetic Construct
KNATK

SEQ ID NO: 4918 - protein, 5 aa, synthetic construct
  REGION 1..5: note = Synthetic Construct
KNAYK

SEQ ID NO: 4919 - protein, 5 aa, synthetic construct
  REGION 1..5: note = Synthetic Construct
KNDAK

SEQ ID NO: 4920 - protein, 5 aa, synthetic construct
  REGION 1..5: note = Synthetic Construct
KNDDK

SEQ ID NO: 4921 - protein, 5 aa, synthetic construct
  REGION 1..5: note = Synthetic Construct
KNDEK

SEQ ID NO: 4922 - protein, 5 aa, synthetic construct
  REGION 1..5: note = Synthetic Construct
KNDFK

SEQ ID NO: 4923 - protein, 5 aa, synthetic construct
  REGION 1..5: note = Synthetic Construct
KNDGK

SEQ ID NO: 4924 - protein, 5 aa, synthetic construct
  REGION 1..5: note = Synthetic Construct
KNDHK

SEQ ID NO: 4925 - protein, 5 aa, synthetic construct
  REGION 1..5: note = Synthetic Construct
KNDIK

SEQ ID NO: 4926 - protein, 5 aa, synthetic construct
  REGION 1..5: note = Synthetic Construct
KNDLK

SEQ ID NO: 4927 - protein, 5 aa, synthetic construct
  REGION 1..5: note = Synthetic Construct
KNDNK

SEQ ID NO: 4928 - protein, 5 aa, synthetic construct
  REGION 1..5: note = Synthetic Construct
KNDQK

SEQ ID NO: 4929 - protein, 5 aa, synthetic construct
  REGION 1..5: note = Synthetic Construct
KNDRK

SEQ ID NO: 4930 - protein, 5 aa, synthetic construct
  REGION 1..5: note = Synthetic Construct
KNDSK

SEQ ID NO: 4931 - protein, 5 aa, synthetic construct
  REGION 1..5: note = Synthetic Construct
KNDTK

SEQ ID NO: 4932 - protein, 5 aa, synthetic construct
  REGION 1..5: note = Synthetic Construct
KNDYK

SEQ ID NO: 4933 - protein, 5 aa, synthetic construct
  REGION 1..5: note = Synthetic Construct
KNEAK

SEQ ID NO: 4934 - protein, 5 aa, synthetic construct
  REGION 1..5: note = Synthetic Construct
KNEDK

SEQ ID NO: 4935 - protein, 5 aa, synthetic construct
  REGION 1..5: note = Synthetic Construct
KNEEK

SEQ ID NO: 4936 - protein, 5 aa, synthetic construct
  REGION 1..5: note = Synthetic Construct
KNEFK

SEQ ID NO: 4937 - protein, 5 aa, synthetic construct
  REGION 1..5: note = Synthetic Construct
KNEGK

SEQ ID NO: 4938 - protein, 5 aa, synthetic construct
  REGION 1..5: note = Synthetic Construct
KNEHK

SEQ ID NO: 4939 - protein, 5 aa, synthetic construct
  REGION 1..5: note = Synthetic Construct
KNEIK

SEQ ID NO: 4940 - protein, 5 aa, synthetic construct
  REGION 1..5: note = Synthetic Construct
KNELK

SEQ ID NO: 4941 - protein, 5 aa, synthetic construct
  REGION 1..5: note = Synthetic Construct
KNENK

SEQ ID NO: 4942 - protein, 5 aa, synthetic construct
  REGION 1..5: note = Synthetic Construct
KNEQK

SEQ ID NO: 4943 - protein, 5 aa, synthetic construct
  REGION 1..5: note = Synthetic Construct
KNERK

SEQ ID NO: 4944 - protein, 5 aa, synthetic construct
  REGION 1..5: note = Synthetic Construct
KNESK

SEQ ID NO: 4945 - protein, 5 aa, synthetic construct
  REGION 1..5: note = Synthetic Construct
KNETK

SEQ ID NO: 4946 - protein, 5 aa, synthetic construct
  REGION 1..5: note = Synthetic Construct
KNEYK

SEQ ID NO: 4947 - protein, 5 aa, synthetic construct
  REGION 1..5: note = Synthetic Construct
KNFAK

SEQ ID NO: 4948 - protein, 5 aa, synthetic construct
  REGION 1..5: note = Synthetic Construct
KNFDK

SEQ ID NO: 4949 - protein, 5 aa, synthetic construct
  REGION 1..5: note = Synthetic Construct
KNFEK

SEQ ID NO: 4950 - protein, 5 aa, synthetic construct
  REGION 1..5: note = Synthetic Construct
KNFFK

SEQ ID NO: 4951 - protein, 5 aa, synthetic construct
  REGION 1..5: note = Synthetic Construct
KNFGK

SEQ ID NO: 4952 - protein, 5 aa, synthetic construct
  REGION 1..5: note = Synthetic Construct
KNFHK

SEQ ID NO: 4953 - protein, 5 aa, synthetic construct
  REGION 1..5: note = Synthetic Construct
KNFIK

SEQ ID NO: 4954 - protein, 5 aa, synthetic construct
  REGION 1..5: note = Synthetic Construct
KNFLK

SEQ ID NO: 4955 - protein, 5 aa, synthetic construct
  REGION 1..5: note = Synthetic Construct
KNFNK

SEQ ID NO: 4956 - protein, 5 aa, synthetic construct
  REGION 1..5: note = Synthetic Construct
KNFQK

SEQ ID NO: 4957 - protein, 5 aa, synthetic construct
  REGION 1..5: note = Synthetic Construct
KNFRK

SEQ ID NO: 4958 - protein, 5 aa, synthetic construct
  REGION 1..5: note = Synthetic Construct
KNFSK

SEQ ID NO: 4959 - protein, 5 aa, synthetic construct
  REGION 1..5: note = Synthetic Construct
KNFTK

SEQ ID NO: 4960 - protein, 5 aa, synthetic construct
  REGION 1..5: note = Synthetic Construct
KNFYK

SEQ ID NO: 4961 - protein, 5 aa, synthetic construct
  REGION 1..5: note = Synthetic Construct
KNGAK

SEQ ID NO: 4962 - protein, 5 aa, synthetic construct
  REGION 1..5: note = Synthetic Construct
KNGDK

SEQ ID NO: 4963 - protein, 5 aa, synthetic construct
  REGION 1..5: note = Synthetic Construct
KNGEK

SEQ ID NO: 4964 - protein, 5 aa, synthetic construct
  REGION 1..5: note = Synthetic Construct
KNGFK

SEQ ID NO: 4965 - protein, 5 aa, synthetic construct
  REGION 1..5: note = Synthetic Construct
KNGGK

SEQ ID NO: 4966 - protein, 5 aa, synthetic construct
  REGION 1..5: note = Synthetic Construct
KNGHK

SEQ ID NO: 4967 - protein, 5 aa, synthetic construct
  REGION 1..5: note = Synthetic Construct
KNGIK

SEQ ID NO: 4968 - protein, 5 aa, synthetic construct
  REGION 1..5: note = Synthetic Construct
KNGLK

SEQ ID NO: 4969 - protein, 5 aa, synthetic construct
  REGION 1..5: note = Synthetic Construct
KNGNK

SEQ ID NO: 4970 - protein, 5 aa, synthetic construct
  REGION 1..5: note = Synthetic Construct
KNGQK

SEQ ID NO: 4971 - protein, 5 aa, synthetic construct
  REGION 1..5: note = Synthetic Construct
KNGRK

SEQ ID NO: 4972 - protein, 5 aa, synthetic construct
  REGION 1..5: note = Synthetic Construct
KNGSK

SEQ ID NO: 4973 - protein, 5 aa, synthetic construct
  REGION 1..5: note = Synthetic Construct
KNGTK

SEQ ID NO: 4974 - protein, 5 aa, synthetic construct
  REGION 1..5: note = Synthetic Construct
KNGYK

SEQ ID NO: 4975 - protein, 5 aa, synthetic construct
  REGION 1..5: note = Synthetic Construct
KNHAK

SEQ ID NO: 4976 - protein, 5 aa, synthetic construct
  REGION 1..5: note = Synthetic Construct
KNHDK

SEQ ID NO: 4977 - protein, 5 aa, synthetic construct
  REGION 1..5: note = Synthetic Construct
KNHEK

SEQ ID NO: 4978 - protein, 5 aa, synthetic construct
  REGION 1..5: note = Synthetic Construct
KNHFK

SEQ ID NO: 4979 - protein, 5 aa, synthetic construct
  REGION 1..5: note = Synthetic Construct
KNHGK

SEQ ID NO: 4980 - protein, 5 aa, synthetic construct
  REGION 1..5: note = Synthetic Construct
KNHHK

SEQ ID NO: 4981 - protein, 5 aa, synthetic construct
  REGION 1..5: note = Synthetic Construct
KNHIK

SEQ ID NO: 4982 - protein, 5 aa, synthetic construct
  REGION 1..5: note = Synthetic Construct
KNHLK

SEQ ID NO: 4983 - protein, 5 aa, synthetic construct
  REGION 1..5: note = Synthetic Construct
KNHNK

SEQ ID NO: 4984 - protein, 5 aa, synthetic construct
  REGION 1..5: note = Synthetic Construct
KNHQK

SEQ ID NO: 4985 - protein, 5 aa, synthetic construct
  REGION 1..5: note = Synthetic Construct
KNHRK

SEQ ID NO: 4986 - protein, 5 aa, synthetic construct
  REGION 1..5: note = Synthetic Construct
KNHSK

SEQ ID NO: 4987 - protein, 5 aa, synthetic construct
  REGION 1..5: note = Synthetic Construct
KNHTK

SEQ ID NO: 4988 - protein, 5 aa, synthetic construct
  REGION 1..5: note = Synthetic Construct
KNHYK

SEQ ID NO: 4989 - protein, 5 aa, synthetic construct
  REGION 1..5: note = Synthetic Construct
KNIAK

SEQ ID NO: 4990 - protein, 5 aa, synthetic construct
  REGION 1..5: note = Synthetic Construct
KNIDK

SEQ ID NO: 4991 - protein, 5 aa, synthetic construct
  REGION 1..5: note = Synthetic Construct
KNIEK

SEQ ID NO: 4992 - protein, 5 aa, synthetic construct
  REGION 1..5: note = Synthetic Construct
KNIFK

SEQ ID NO: 4993 - protein, 5 aa, synthetic construct
  REGION 1..5: note = Synthetic Construct
KNIGK

SEQ ID NO: 4994 - protein, 5 aa, synthetic construct
  REGION 1..5: note = Synthetic Construct
KNIHK

SEQ ID NO: 4995 - protein, 5 aa, synthetic construct
  REGION 1..5: note = Synthetic Construct
KNIIK

SEQ ID NO: 4996 - protein, 5 aa, synthetic construct
  REGION 1..5: note = Synthetic Construct
KNILK

SEQ ID NO: 4997 - protein, 5 aa, synthetic construct
  REGION 1..5: note = Synthetic Construct
KNINK

SEQ ID NO: 4998 - protein, 5 aa, synthetic construct
  REGION 1..5: note = Synthetic Construct
KNIQK

SEQ ID NO: 4999 - protein, 5 aa, synthetic construct
  REGION 1..5: note = Synthetic Construct
KNIRK

SEQ ID NO: 5000 - protein, 5 aa, synthetic construct
  REGION 1..5: note = Synthetic Construct
KNISK

SEQ ID NO: 5001 - protein, 5 aa, synthetic construct
  REGION 1..5: note = Synthetic Construct
KNITK

SEQ ID NO: 5002 - protein, 5 aa, synthetic construct
  REGION 1..5: note = Synthetic Construct
KNIYK

SEQ ID NO: 5003 - protein, 5 aa, synthetic construct
  REGION 1..5: note = Synthetic Construct
KNLAK

SEQ ID NO: 5004 - protein, 5 aa, synthetic construct
  REGION 1..5: note = Synthetic Construct
KNLDK

SEQ ID NO: 5005 - protein, 5 aa, synthetic construct
  REGION 1..5: note = Synthetic Construct
KNLEK

SEQ ID NO: 5006 - protein, 5 aa, synthetic construct
  REGION 1..5: note = Synthetic Construct
KNLFK

SEQ ID NO: 5007 - protein, 5 aa, synthetic construct
  REGION 1..5: note = Synthetic Construct
KNLGK

SEQ ID NO: 5008 - protein, 5 aa, synthetic construct
  REGION 1..5: note = Synthetic Construct
KNLHK

SEQ ID NO: 5009 - protein, 5 aa, synthetic construct
  REGION 1..5: note = Synthetic Construct
KNLIK

SEQ ID NO: 5010 - protein, 5 aa, synthetic construct
  REGION 1..5: note = Synthetic Construct
KNLLK

SEQ ID NO: 5011 - protein, 5 aa, synthetic construct
  REGION 1..5: note = Synthetic Construct
KNLNK

SEQ ID NO: 5012 - protein, 5 aa, synthetic construct
  REGION 1..5: note = Synthetic Construct
KNLQK

SEQ ID NO: 5013 - protein, 5 aa, synthetic construct
  REGION 1..5: note = Synthetic Construct
KNLRK

SEQ ID NO: 5014 - protein, 5 aa, synthetic construct
  REGION 1..5: note = Synthetic Construct
KNLSK

SEQ ID NO: 5015 - protein, 5 aa, synthetic construct
  REGION 1..5: note = Synthetic Construct
KNLTK

SEQ ID NO: 5016 - protein, 5 aa, synthetic construct
  REGION 1..5: note = Synthetic Construct
KNLYK

SEQ ID NO: 5017 - protein, 5 aa, synthetic construct
  REGION 1..5: note = Synthetic Construct
KNNAK

SEQ ID NO: 5018 - protein, 5 aa, synthetic construct
  REGION 1..5: note = Synthetic Construct
KNNDK

SEQ ID NO: 5019 - protein, 5 aa, synthetic construct
  REGION 1..5: note = Synthetic Construct
KNNEK

SEQ ID NO: 5020 - protein, 5 aa, synthetic construct
  REGION 1..5: note = Synthetic Construct
KNNFK

SEQ ID NO: 5021 - protein, 5 aa, synthetic construct
  REGION 1..5: note = Synthetic Construct
KNNGK

SEQ ID NO: 5022 - protein, 5 aa, synthetic construct
  REGION 1..5: note = Synthetic Construct
KNNHK

SEQ ID NO: 5023 - protein, 5 aa, synthetic construct
  REGION 1..5: note = Synthetic Construct
KNNIK

SEQ ID NO: 5024 - protein, 5 aa, synthetic construct
  REGION 1..5: note = Synthetic Construct
KNNLK

SEQ ID NO: 5025 - protein, 5 aa, synthetic construct
  REGION 1..5: note = Synthetic Construct
KNNNK

SEQ ID NO: 5026 - protein, 5 aa, synthetic construct
  REGION 1..5: note = Synthetic Construct
KNNQK

SEQ ID NO: 5027 - protein, 5 aa, synthetic construct
  REGION 1..5: note = Synthetic Construct
KNNRK

SEQ ID NO: 5028 - protein, 5 aa, synthetic construct
  REGION 1..5: note = Synthetic Construct
KNNSK

SEQ ID NO: 5029 - protein, 5 aa, synthetic construct
  REGION 1..5: note = Synthetic Construct
KNNTK

SEQ ID NO: 5030 - protein, 5 aa, synthetic construct
  REGION 1..5: note = Synthetic Construct
KNNYK

SEQ ID NO: 5031 - protein, 5 aa, synthetic construct
  REGION 1..5: note = Synthetic Construct
KNPAK

SEQ ID NO: 5032 - protein, 5 aa, synthetic construct
  REGION 1..5: note = Synthetic Construct
KNPDK

SEQ ID NO: 5033 - protein, 5 aa, synthetic construct
  REGION 1..5: note = Synthetic Construct
KNPEK

SEQ ID NO: 5034 - protein, 5 aa, synthetic construct
  REGION 1..5: note = Synthetic Construct
KNPFK

SEQ ID NO: 5035 - protein, 5 aa, synthetic construct
  REGION 1..5: note = Synthetic Construct
KNPGK

SEQ ID NO: 5036 - protein, 5 aa, synthetic construct
  REGION 1..5: note = Synthetic Construct
KNPHK

SEQ ID NO: 5037 - protein, 5 aa, synthetic construct
  REGION 1..5: note = Synthetic Construct
KNPIK

SEQ ID NO: 5038 - protein, 5 aa, synthetic construct
  REGION 1..5: note = Synthetic Construct
KNPLK

SEQ ID NO: 5039 - protein, 5 aa, synthetic construct
  REGION 1..5: note = Synthetic Construct
KNPNK

SEQ ID NO: 5040 - protein, 5 aa, synthetic construct
  REGION 1..5: note = Synthetic Construct
KNPQK

SEQ ID NO: 5041 - protein, 5 aa, synthetic construct
  REGION 1..5: note = Synthetic Construct
KNPRK

SEQ ID NO: 5042 - protein, 5 aa, synthetic construct
  REGION 1..5: note = Synthetic Construct
KNPSK

SEQ ID NO: 5043 - protein, 5 aa, synthetic construct
  REGION 1..5: note = Synthetic Construct
KNPTK

SEQ ID NO: 5044 - protein, 5 aa, synthetic construct
  REGION 1..5: note = Synthetic Construct
KNPYK

SEQ ID NO: 5045 - protein, 5 aa, synthetic construct
  REGION 1..5: note = Synthetic Construct
KNQAK

SEQ ID NO: 5046 - protein, 5 aa, synthetic construct
  REGION 1..5: note = Synthetic Construct
KNQDK

SEQ ID NO: 5047 - protein, 5 aa, synthetic construct
  REGION 1..5: note = Synthetic Construct
KNQEK

SEQ ID NO: 5048 - protein, 5 aa, synthetic construct
  REGION 1..5: note = Synthetic Construct
KNQFK

SEQ ID NO: 5049 - protein, 5 aa, synthetic construct
  REGION 1..5: note = Synthetic Construct
KNQGK

SEQ ID NO: 5050 - protein, 5 aa, synthetic construct
  REGION 1..5: note = Synthetic Construct
KNQHK

SEQ ID NO: 5051 - protein, 5 aa, synthetic construct
  REGION 1..5: note = Synthetic Construct
KNQIK

SEQ ID NO: 5052 - protein, 5 aa, synthetic construct
  REGION 1..5: note = Synthetic Construct
KNQLK

SEQ ID NO: 5053 - protein, 5 aa, synthetic construct
  REGION 1..5: note = Synthetic Construct
KNQNK

SEQ ID NO: 5054 - protein, 5 aa, synthetic construct
  REGION 1..5: note = Synthetic Construct
KNQQK

SEQ ID NO: 5055 - protein, 5 aa, synthetic construct
  REGION 1..5: note = Synthetic Construct
KNQRK

SEQ ID NO: 5056 - protein, 5 aa, synthetic construct
  REGION 1..5: note = Synthetic Construct
KNQSK

SEQ ID NO: 5057 - protein, 5 aa, synthetic construct
  REGION 1..5: note = Synthetic Construct
KNQTK

SEQ ID NO: 5058 - protein, 5 aa, synthetic construct
  REGION 1..5: note = Synthetic Construct
KNQYK

SEQ ID NO: 5059 - protein, 5 aa, synthetic construct
  REGION 1..5: note = Synthetic Construct
KNRAK

SEQ ID NO: 5060 - protein, 5 aa, synthetic construct
  REGION 1..5: note = Synthetic Construct
KNRDK

SEQ ID NO: 5061 - protein, 5 aa, synthetic construct
  REGION 1..5: note = Synthetic Construct
KNREK

SEQ ID NO: 5062 - protein, 5 aa, synthetic construct
  REGION 1..5: note = Synthetic Construct
KNRFK

SEQ ID NO: 5063 - protein, 5 aa, synthetic construct
  REGION 1..5: note = Synthetic Construct
KNRGK

SEQ ID NO: 5064 - protein, 5 aa, synthetic construct
  REGION 1..5: note = Synthetic Construct
KNRHK

SEQ ID NO: 5065 - protein, 5 aa, synthetic construct
  REGION 1..5: note = Synthetic Construct
KNRIK

SEQ ID NO: 5066 - protein, 5 aa, synthetic construct
  REGION 1..5: note = Synthetic Construct
KNRLK

SEQ ID NO: 5067 - protein, 5 aa, synthetic construct
  REGION 1..5: note = Synthetic Construct
KNRNK

SEQ ID NO: 5068 - protein, 5 aa, synthetic construct
  REGION 1..5: note = Synthetic Construct
KNRQK

SEQ ID NO: 5069 - protein, 5 aa, synthetic construct
  REGION 1..5: note = Synthetic Construct
KNRRK

SEQ ID NO: 5070 - protein, 5 aa, synthetic construct
  REGION 1..5: note = Synthetic Construct
KNRSK

SEQ ID NO: 5071 - protein, 5 aa, synthetic construct
  REGION 1..5: note = Synthetic Construct
KNRTK

SEQ ID NO: 5072 - protein, 5 aa, synthetic construct
  REGION 1..5: note = Synthetic Construct
KNRYK

SEQ ID NO: 5073 - protein, 5 aa, synthetic construct
  REGION 1..5: note = Synthetic Construct
KNSAK

SEQ ID NO: 5074 - protein, 5 aa, synthetic construct
  REGION 1..5: note = Synthetic Construct
KNSDK

SEQ ID NO: 5075 - protein, 5 aa, synthetic construct
  REGION 1..5: note = Synthetic Construct
KNSEK

SEQ ID NO: 5076 - protein, 5 aa, synthetic construct
  REGION 1..5: note = Synthetic Construct
KNSFK

SEQ ID NO: 5077 - protein, 5 aa, synthetic construct
  REGION 1..5: note = Synthetic Construct
KNSGK

SEQ ID NO: 5078 - protein, 5 aa, synthetic construct
  REGION 1..5: note = Synthetic Construct
KNSHK

SEQ ID NO: 5079 - protein, 5 aa, synthetic construct
  REGION 1..5: note = Synthetic Construct
KNSIK

SEQ ID NO: 5080 - protein, 5 aa, synthetic construct
  REGION 1..5: note = Synthetic Construct
KNSLK

SEQ ID NO: 5081 - protein, 5 aa, synthetic construct
  REGION 1..5: note = Synthetic Construct
KNSNK

SEQ ID NO: 5082 - protein, 5 aa, synthetic construct
  REGION 1..5: note = Synthetic Construct
KNSQK

SEQ ID NO: 5083 - protein, 5 aa, synthetic construct
  REGION 1..5: note = Synthetic Construct
KNSRK

SEQ ID NO: 5084 - protein, 5 aa, synthetic construct
  REGION 1..5: note = Synthetic Construct
KNSSK

SEQ ID NO: 5085 - protein, 5 aa, synthetic construct
  REGION 1..5: note = Synthetic Construct
KNSTK

SEQ ID NO: 5086 - protein, 5 aa, synthetic construct
  REGION 1..5: note = Synthetic Construct
KNSYK

SEQ ID NO: 5087 - protein, 5 aa, synthetic construct
  REGION 1..5: note = Synthetic Construct
KNTAK

SEQ ID NO: 5088 - protein, 5 aa, synthetic construct
  REGION 1..5: note = Synthetic Construct
KNTDK

SEQ ID NO: 5089 - protein, 5 aa, synthetic construct
  REGION 1..5: note = Synthetic Construct
KNTEK

SEQ ID NO: 5090 - protein, 5 aa, synthetic construct
  REGION 1..5: note = Synthetic Construct
KNTFK

SEQ ID NO: 5091 - protein, 5 aa, synthetic construct
  REGION 1..5: note = Synthetic Construct
KNTGK

SEQ ID NO: 5092 - protein, 5 aa, synthetic construct
  REGION 1..5: note = Synthetic Construct
KNTHK

SEQ ID NO: 5093 - protein, 5 aa, synthetic construct
  REGION 1..5: note = Synthetic Construct
KNTIK

SEQ ID NO: 5094 - protein, 5 aa, synthetic construct
  REGION 1..5: note = Synthetic Construct
KNTLK

SEQ ID NO: 5095 - protein, 5 aa, synthetic construct
  REGION 1..5: note = Synthetic Construct
KNTNK

SEQ ID NO: 5096 - protein, 5 aa, synthetic construct
  REGION 1..5: note = Synthetic Construct
KNTQK

SEQ ID NO: 5097 - protein, 5 aa, synthetic construct
  REGION 1..5: note = Synthetic Construct
KNTRK

SEQ ID NO: 5098 - protein, 5 aa, synthetic construct
  REGION 1..5: note = Synthetic Construct
KNTSK

SEQ ID NO: 5099 - protein, 5 aa, synthetic construct
  REGION 1..5: note = Synthetic Construct
KNTTK

SEQ ID NO: 5100 - protein, 5 aa, synthetic construct
  REGION 1..5: note = Synthetic Construct
KNTYK

SEQ ID NO: 5101 - protein, 5 aa, synthetic construct
  REGION 1..5: note = Synthetic Construct
KNYAK

SEQ ID NO: 5102 - protein, 5 aa, synthetic construct
  REGION 1..5: note = Synthetic Construct
KNYDK

SEQ ID NO: 5103 - protein, 5 aa, synthetic construct
  REGION 1..5: note = Synthetic Construct
KNYEK

SEQ ID NO: 5104 - protein, 5 aa, synthetic construct
  REGION 1..5: note = Synthetic Construct
KNYFK

SEQ ID NO: 5105 - protein, 5 aa, synthetic construct
  REGION 1..5: note = Synthetic Construct
KNYGK

SEQ ID NO: 5106 - protein, 5 aa, synthetic construct
  REGION 1..5: note = Synthetic Construct
KNYHK

SEQ ID NO: 5107 - protein, 5 aa, synthetic construct
  REGION 1..5: note = Synthetic Construct
KNYIK

SEQ ID NO: 5108 - protein, 5 aa, synthetic construct
  REGION 1..5: note = Synthetic Construct
KNYLK

SEQ ID NO: 5109 - protein, 5 aa, synthetic construct
  REGION 1..5: note = Synthetic Construct
KNYNK

SEQ ID NO: 5110 - protein, 5 aa, synthetic construct
  REGION 1..5: note = Synthetic Construct
KNYQK

SEQ ID NO: 5111 - protein, 5 aa, synthetic construct
  REGION 1..5: note = Synthetic Construct
KNYRK

SEQ ID NO: 5112 - protein, 5 aa, synthetic construct
  REGION 1..5: note = Synthetic Construct
KNYSK

SEQ ID NO: 5113 - protein, 5 aa, synthetic construct
  REGION 1..5: note = Synthetic Construct
KNYTK

SEQ ID NO: 5114 - protein, 5 aa, synthetic construct
  REGION 1..5: note = Synthetic Construct
KNYYK

SEQ ID NO: 5115 - protein, 5 aa, synthetic construct
  REGION 1..5: note = Synthetic Construct
KPAAK

SEQ ID NO: 5116 - protein, 5 aa, synthetic construct
  REGION 1..5: note = Synthetic Construct
KPADK

SEQ ID NO: 5117 - protein, 5 aa, synthetic construct
  REGION 1..5: note = Synthetic Construct
KPAEK

SEQ ID NO: 5118 - protein, 5 aa, synthetic construct
  REGION 1..5: note = Synthetic Construct
KPAFK

SEQ ID NO: 5119 - protein, 5 aa, synthetic construct
  REGION 1..5: note = Synthetic Construct
KPAGK

SEQ ID NO: 5120 - protein, 5 aa, synthetic construct
  REGION 1..5: note = Synthetic Construct
KPAHK

SEQ ID NO: 5121 - protein, 5 aa, synthetic construct
  REGION 1..5: note = Synthetic Construct
KPAIK

SEQ ID NO: 5122 - protein, 5 aa, synthetic construct
  REGION 1..5: note = Synthetic Construct
KPALK

SEQ ID NO: 5123 - protein, 5 aa, synthetic construct
  REGION 1..5: note = Synthetic Construct
KPANK

SEQ ID NO: 5124 - protein, 5 aa, synthetic construct
  REGION 1..5: note = Synthetic Construct
KPAQK

SEQ ID NO: 5125 - protein, 5 aa, synthetic construct
  REGION 1..5: note = Synthetic Construct
KPARK

SEQ ID NO: 5126 - protein, 5 aa, synthetic construct
  REGION 1..5: note = Synthetic Construct
KPASK

SEQ ID NO: 5127 - protein, 5 aa, synthetic construct
  REGION 1..5: note = Synthetic Construct
KPATK

SEQ ID NO: 5128 - protein, 5 aa, synthetic construct
  REGION 1..5: note = Synthetic Construct
KPAYK

SEQ ID NO: 5129 - protein, 5 aa, synthetic construct
  REGION 1..5: note = Synthetic Construct
KPDAK

SEQ ID NO: 5130 - protein, 5 aa, synthetic construct
  REGION 1..5: note = Synthetic Construct
KPDDK

SEQ ID NO: 5131 - protein, 5 aa, synthetic construct
  REGION 1..5: note = Synthetic Construct
KPDEK

SEQ ID NO: 5132 - protein, 5 aa, synthetic construct
  REGION 1..5: note = Synthetic Construct
KPDFK

SEQ ID NO: 5133 - protein, 5 aa, synthetic construct
  REGION 1..5: note = Synthetic Construct
KPDGK

SEQ ID NO: 5134 - protein, 5 aa, synthetic construct
  REGION 1..5: note = Synthetic Construct
KPDHK

SEQ ID NO: 5135 - protein, 5 aa, synthetic construct
  REGION 1..5: note = Synthetic Construct
KPDIK

SEQ ID NO: 5136 - protein, 5 aa, synthetic construct
  REGION 1..5: note = Synthetic Construct
KPDLK

SEQ ID NO: 5137 - protein, 5 aa, synthetic construct
  REGION 1..5: note = Synthetic Construct
KPDNK

SEQ ID NO: 5138 - protein, 5 aa, synthetic construct
  REGION 1..5: note = Synthetic Construct
KPDQK

SEQ ID NO: 5139 - protein, 5 aa, synthetic construct
  REGION 1..5: note = Synthetic Construct
KPDRK

SEQ ID NO: 5140 - protein, 5 aa, synthetic construct
  REGION 1..5: note = Synthetic Construct
KPDSK

SEQ ID NO: 5141 - protein, 5 aa, synthetic construct
  REGION 1..5: note = Synthetic Construct
KPDTK

SEQ ID NO: 5142 - protein, 5 aa, synthetic construct
  REGION 1..5: note = Synthetic Construct
KPDYK

SEQ ID NO: 5143 - protein, 5 aa, synthetic construct
  REGION 1..5: note = Synthetic Construct
KPEAK

SEQ ID NO: 5144 - protein, 5 aa, synthetic construct
  REGION 1..5: note = Synthetic Construct
KPEDK

SEQ ID NO: 5145 - protein, 5 aa, synthetic construct
  REGION 1..5: note = Synthetic Construct
KPEEK

SEQ ID NO: 5146 - protein, 5 aa, synthetic construct
  REGION 1..5: note = Synthetic Construct
KPEFK

SEQ ID NO: 5147 - protein, 5 aa, synthetic construct
  REGION 1..5: note = Synthetic Construct
KPEGK

SEQ ID NO: 5148 - protein, 5 aa, synthetic construct
  REGION 1..5: note = Synthetic Construct
KPEHK

SEQ ID NO: 5149 - protein, 5 aa, synthetic construct
  REGION 1..5: note = Synthetic Construct
KPEIK

SEQ ID NO: 5150 - protein, 5 aa, synthetic construct
  REGION 1..5: note = Synthetic Construct
KPELK

SEQ ID NO: 5151 - protein, 5 aa, synthetic construct
  REGION 1..5: note = Synthetic Construct
KPENK

SEQ ID NO: 5152 - protein, 5 aa, synthetic construct
  REGION 1..5: note = Synthetic Construct
KPEQK

SEQ ID NO: 5153 - protein, 5 aa, synthetic construct
  REGION 1..5: note = Synthetic Construct
KPERK

SEQ ID NO: 5154 - protein, 5 aa, synthetic construct
  REGION 1..5: note = Synthetic Construct
KPESK

SEQ ID NO: 5155 - protein, 5 aa, synthetic construct
  REGION 1..5: note = Synthetic Construct
KPETK

SEQ ID NO: 5156 - protein, 5 aa, synthetic construct
  REGION 1..5: note = Synthetic Construct
KPEYK

SEQ ID NO: 5157 - protein, 5 aa, synthetic construct
  REGION 1..5: note = Synthetic Construct
KPFAK

SEQ ID NO: 5158 - protein, 5 aa, synthetic construct
  REGION 1..5: note = Synthetic Construct
KPFDK

SEQ ID NO: 5159 - protein, 5 aa, synthetic construct
  REGION 1..5: note = Synthetic Construct
KPFEK

SEQ ID NO: 5160 - protein, 5 aa, synthetic construct
  REGION 1..5: note = Synthetic Construct
KPFFK

SEQ ID NO: 5161 - protein, 5 aa, synthetic construct
  REGION 1..5: note = Synthetic Construct
KPFGK

SEQ ID NO: 5162 - protein, 5 aa, synthetic construct
  REGION 1..5: note = Synthetic Construct
KPFHK

SEQ ID NO: 5163 - protein, 5 aa, synthetic construct
  REGION 1..5: note = Synthetic Construct
KPFIK

SEQ ID NO: 5164 - protein, 5 aa, synthetic construct
  REGION 1..5: note = Synthetic Construct
KPFLK

SEQ ID NO: 5165 - protein, 5 aa, synthetic construct
  REGION 1..5: note = Synthetic Construct
KPFNK

SEQ ID NO: 5166 - protein, 5 aa, synthetic construct
  REGION 1..5: note = Synthetic Construct
KPFQK

SEQ ID NO: 5167 - protein, 5 aa, synthetic construct
  REGION 1..5: note = Synthetic Construct
KPFRK

SEQ ID NO: 5168 - protein, 5 aa, synthetic construct
  REGION 1..5: note = Synthetic Construct
KPFSK

SEQ ID NO: 5169 - protein, 5 aa, synthetic construct
  REGION 1..5: note = Synthetic Construct
KPFTK

SEQ ID NO: 5170 - protein, 5 aa, synthetic construct
  REGION 1..5: note = Synthetic Construct
KPFYK

SEQ ID NO: 5171 - protein, 5 aa, synthetic construct
  REGION 1..5: note = Synthetic Construct
KPGAK

SEQ ID NO: 5172 - protein, 5 aa, synthetic construct
  REGION 1..5: note = Synthetic Construct
KPGDK

SEQ ID NO: 5173 - protein, 5 aa, synthetic construct
  REGION 1..5: note = Synthetic Construct
KPGEK

SEQ ID NO: 5174 - protein, 5 aa, synthetic construct
  REGION 1..5: note = Synthetic Construct
KPGFK

SEQ ID NO: 5175 - protein, 5 aa, synthetic construct
  REGION 1..5: note = Synthetic Construct
KPGGK

SEQ ID NO: 5176 - protein, 5 aa, synthetic construct
  REGION 1..5: note = Synthetic Construct
KPGHK

SEQ ID NO: 5177 - protein, 5 aa, synthetic construct
  REGION 1..5: note = Synthetic Construct
KPGIK

SEQ ID NO: 5178 - protein, 5 aa, synthetic construct
  REGION 1..5: note = Synthetic Construct
KPGLK

SEQ ID NO: 5179 - protein, 5 aa, synthetic construct
  REGION 1..5: note = Synthetic Construct
KPGNK

SEQ ID NO: 5180 - protein, 5 aa, synthetic construct
  REGION 1..5: note = Synthetic Construct
KPGQK

SEQ ID NO: 5181 - protein, 5 aa, synthetic construct
  REGION 1..5: note = Synthetic Construct
KPGRK

SEQ ID NO: 5182 - protein, 5 aa, synthetic construct
  REGION 1..5: note = Synthetic Construct
KPGSK

SEQ ID NO: 5183 - protein, 5 aa, synthetic construct
  REGION 1..5: note = Synthetic Construct
KPGTK

SEQ ID NO: 5184 - protein, 5 aa, synthetic construct
  REGION 1..5: note = Synthetic Construct
KPGYK

SEQ ID NO: 5185 - protein, 5 aa, synthetic construct
  REGION 1..5: note = Synthetic Construct
KPHAK

SEQ ID NO: 5186 - protein, 5 aa, synthetic construct
  REGION 1..5: note = Synthetic Construct
KPHDK

SEQ ID NO: 5187 - protein, 5 aa, synthetic construct
  REGION 1..5: note = Synthetic Construct
KPHEK

SEQ ID NO: 5188 - protein, 5 aa, synthetic construct
  REGION 1..5: note = Synthetic Construct
KPHFK

SEQ ID NO: 5189 - protein, 5 aa, synthetic construct
  REGION 1..5: note = Synthetic Construct
KPHGK

SEQ ID NO: 5190 - protein, 5 aa, synthetic construct
  REGION 1..5: note = Synthetic Construct
KPHHK

SEQ ID NO: 5191 - protein, 5 aa, synthetic construct
  REGION 1..5: note = Synthetic Construct
KPHIK

SEQ ID NO: 5192 - protein, 5 aa, synthetic construct
  REGION 1..5: note = Synthetic Construct
KPHLK

SEQ ID NO: 5193 - protein, 5 aa, synthetic construct
  REGION 1..5: note = Synthetic Construct
KPHNK

SEQ ID NO: 5194 - protein, 5 aa, synthetic construct
  REGION 1..5: note = Synthetic Construct
KPHQK

SEQ ID NO: 5195 - protein, 5 aa, synthetic construct
  REGION 1..5: note = Synthetic Construct
KPHRK

SEQ ID NO: 5196 - protein, 5 aa, synthetic construct
  REGION 1..5: note = Synthetic Construct
KPHSK

SEQ ID NO: 5197 - protein, 5 aa, synthetic construct
  REGION 1..5: note = Synthetic Construct
KPHTK

SEQ ID NO: 5198 - protein, 5 aa, synthetic construct
  REGION 1..5: note = Synthetic Construct
KPHYK

SEQ ID NO: 5199 - protein, 5 aa, synthetic construct
  REGION 1..5: note = Synthetic Construct
KPIAK

SEQ ID NO: 5200 - protein, 5 aa, synthetic construct
  REGION 1..5: note = Synthetic Construct
KPIDK

SEQ ID NO: 5201 - protein, 5 aa, synthetic construct
  REGION 1..5: note = Synthetic Construct
KPIEK

SEQ ID NO: 5202 - protein, 5 aa, synthetic construct
  REGION 1..5: note = Synthetic Construct
KPIFK

SEQ ID NO: 5203 - protein, 5 aa, synthetic construct
  REGION 1..5: note = Synthetic Construct
KPIGK

SEQ ID NO: 5204 - protein, 5 aa, synthetic construct
  REGION 1..5: note = Synthetic Construct
KPIHK

SEQ ID NO: 5205 - protein, 5 aa, synthetic construct
  REGION 1..5: note = Synthetic Construct
KPIIK

SEQ ID NO: 5206 - protein, 5 aa, synthetic construct
  REGION 1..5: note = Synthetic Construct
KPILK

SEQ ID NO: 5207 - protein, 5 aa, synthetic construct
  REGION 1..5: note = Synthetic Construct
KPINK

SEQ ID NO: 5208 - protein, 5 aa, synthetic construct
  REGION 1..5: note = Synthetic Construct
KPIQK

SEQ ID NO: 5209 - protein, 5 aa, synthetic construct
  REGION 1..5: note = Synthetic Construct
KPIRK

SEQ ID NO: 5210 - protein, 5 aa, synthetic construct
  REGION 1..5: note = Synthetic Construct
KPISK

SEQ ID NO: 5211 - protein, 5 aa, synthetic construct
  REGION 1..5: note = Synthetic Construct
KPITK

SEQ ID NO: 5212 - protein, 5 aa, synthetic construct
  REGION 1..5: note = Synthetic Construct
KPIYK

SEQ ID NO: 5213 - protein, 5 aa, synthetic construct
  REGION 1..5: note = Synthetic Construct
KPLAK

SEQ ID NO: 5214 - protein, 5 aa, synthetic construct
  REGION 1..5: note = Synthetic Construct
KPLDK

SEQ ID NO: 5215 - protein, 5 aa, synthetic construct
  REGION 1..5: note = Synthetic Construct
KPLEK

SEQ ID NO: 5216 - protein, 5 aa, synthetic construct
  REGION 1..5: note = Synthetic Construct
KPLFK

SEQ ID NO: 5217 - protein, 5 aa, synthetic construct
  REGION 1..5: note = Synthetic Construct
KPLGK

SEQ ID NO: 5218 - protein, 5 aa, synthetic construct
  REGION 1..5: note = Synthetic Construct
KPLHK

SEQ ID NO: 5219 - protein, 5 aa, synthetic construct
  REGION 1..5: note = Synthetic Construct
KPLIK

SEQ ID NO: 5220 - protein, 5 aa, synthetic construct
  REGION 1..5: note = Synthetic Construct
KPLLK

SEQ ID NO: 5221 - protein, 5 aa, synthetic construct
  REGION 1..5: note = Synthetic Construct
KPLNK

SEQ ID NO: 5222 - protein, 5 aa, synthetic construct
  REGION 1..5: note = Synthetic Construct
KPLQK

SEQ ID NO: 5223 - protein, 5 aa, synthetic construct
  REGION 1..5: note = Synthetic Construct
KPLRK

SEQ ID NO: 5224 - protein, 5 aa, synthetic construct
  REGION 1..5: note = Synthetic Construct
KPLSK

SEQ ID NO: 5225 - protein, 5 aa, synthetic construct
  REGION 1..5: note = Synthetic Construct
KPLTK

SEQ ID NO: 5226 - protein, 5 aa, synthetic construct
  REGION 1..5: note = Synthetic Construct
KPLYK

SEQ ID NO: 5227 - protein, 5 aa, synthetic construct
  REGION 1..5: note = Synthetic Construct
KPNAK

SEQ ID NO: 5228 - protein, 5 aa, synthetic construct
  REGION 1..5: note = Synthetic Construct
KPNDK

SEQ ID NO: 5229 - protein, 5 aa, synthetic construct
  REGION 1..5: note = Synthetic Construct
KPNEK

SEQ ID NO: 5230 - protein, 5 aa, synthetic construct
  REGION 1..5: note = Synthetic Construct
KPNFK

SEQ ID NO: 5231 - protein, 5 aa, synthetic construct
  REGION 1..5: note = Synthetic Construct
KPNGK

SEQ ID NO: 5232 - protein, 5 aa, synthetic construct
  REGION 1..5: note = Synthetic Construct
KPNHK

SEQ ID NO: 5233 - protein, 5 aa, synthetic construct
  REGION 1..5: note = Synthetic Construct
KPNIK

SEQ ID NO: 5234 - protein, 5 aa, synthetic construct
  REGION 1..5: note = Synthetic Construct
KPNLK

SEQ ID NO: 5235 - protein, 5 aa, synthetic construct
  REGION 1..5: note = Synthetic Construct
KPNNK

SEQ ID NO: 5236 - protein, 5 aa, synthetic construct
  REGION 1..5: note = Synthetic Construct
KPNQK

SEQ ID NO: 5237 - protein, 5 aa, synthetic construct
  REGION 1..5: note = Synthetic Construct
KPNRK

SEQ ID NO: 5238 - protein, 5 aa, synthetic construct
  REGION 1..5: note = Synthetic Construct
KPNSK

SEQ ID NO: 5239 - protein, 5 aa, synthetic construct
  REGION 1..5: note = Synthetic Construct
KPNTK

SEQ ID NO: 5240 - protein, 5 aa, synthetic construct
  REGION 1..5: note = Synthetic Construct
KPNYK

SEQ ID NO: 5241 - protein, 5 aa, synthetic construct
  REGION 1..5: note = Synthetic Construct
KPPAK

SEQ ID NO: 5242 - protein, 5 aa, synthetic construct
  REGION 1..5: note = Synthetic Construct
KPPDK

SEQ ID NO: 5243 - protein, 5 aa, synthetic construct
  REGION 1..5: note = Synthetic Construct
KPPEK

SEQ ID NO: 5244 - protein, 5 aa, synthetic construct
  REGION 1..5: note = Synthetic Construct
KPPFK

SEQ ID NO: 5245 - protein, 5 aa, synthetic construct
  REGION 1..5: note = Synthetic Construct
KPPGK

SEQ ID NO: 5246 - protein, 5 aa, synthetic construct
  REGION 1..5: note = Synthetic Construct
KPPHK

SEQ ID NO: 5247 - protein, 5 aa, synthetic construct
  REGION 1..5: note = Synthetic Construct
KPPIK

SEQ ID NO: 5248 - protein, 5 aa, synthetic construct
  REGION 1..5: note = Synthetic Construct
KPPLK

SEQ ID NO: 5249 - protein, 5 aa, synthetic construct
  REGION 1..5: note = Synthetic Construct
KPPNK

SEQ ID NO: 5250 - protein, 5 aa, synthetic construct
  REGION 1..5: note = Synthetic Construct
KPPQK

SEQ ID NO: 5251 - protein, 5 aa, synthetic construct
  REGION 1..5: note = Synthetic Construct
KPPRK

SEQ ID NO: 5252 - protein, 5 aa, synthetic construct
  REGION 1..5: note = Synthetic Construct
KPPSK

SEQ ID NO: 5253 - protein, 5 aa, synthetic construct
  REGION 1..5: note = Synthetic Construct
KPPTK

SEQ ID NO: 5254 - protein, 5 aa, synthetic construct
  REGION 1..5: note = Synthetic Construct
KPPYK

SEQ ID NO: 5255 - protein, 5 aa, synthetic construct
  REGION 1..5: note = Synthetic Construct
KPQAK

SEQ ID NO: 5256 - protein, 5 aa, synthetic construct
  REGION 1..5: note = Synthetic Construct
KPQDK

SEQ ID NO: 5257 - protein, 5 aa, synthetic construct
  REGION 1..5: note = Synthetic Construct
KPQEK

SEQ ID NO: 5258 - protein, 5 aa, synthetic construct
  REGION 1..5: note = Synthetic Construct
KPQFK

SEQ ID NO: 5259 - protein, 5 aa, synthetic construct
  REGION 1..5: note = Synthetic Construct
KPQGK

SEQ ID NO: 5260 - protein, 5 aa, synthetic construct
  REGION 1..5: note = Synthetic Construct
KPQHK

SEQ ID NO: 5261 - protein, 5 aa, synthetic construct
  REGION 1..5: note = Synthetic Construct
KPQIK

SEQ ID NO: 5262 - protein, 5 aa, synthetic construct
  REGION 1..5: note = Synthetic Construct
KPQLK

SEQ ID NO: 5263 - protein, 5 aa, synthetic construct
  REGION 1..5: note = Synthetic Construct
KPQNK

SEQ ID NO: 5264 - protein, 5 aa, synthetic construct
  REGION 1..5: note = Synthetic Construct
KPQQK

SEQ ID NO: 5265 - protein, 5 aa, synthetic construct
  REGION 1..5: note = Synthetic Construct
KPQRK

SEQ ID NO: 5266 - protein, 5 aa, synthetic construct
  REGION 1..5: note = Synthetic Construct
KPQSK

SEQ ID NO: 5267 - protein, 5 aa, synthetic construct
  REGION 1..5: note = Synthetic Construct
KPQTK

SEQ ID NO: 5268 - protein, 5 aa, synthetic construct
  REGION 1..5: note = Synthetic Construct
KPQYK

SEQ ID NO: 5269 - protein, 5 aa, synthetic construct
  REGION 1..5: note = Synthetic Construct
KPRAK

SEQ ID NO: 5270 - protein, 5 aa, synthetic construct
  REGION 1..5: note = Synthetic Construct
KPRDK

SEQ ID NO: 5271 - protein, 5 aa, synthetic construct
  REGION 1..5: note = Synthetic Construct
KPREK

SEQ ID NO: 5272 - protein, 5 aa, synthetic construct
  REGION 1..5: note = Synthetic Construct
KPRFK

SEQ ID NO: 5273 - protein, 5 aa, synthetic construct
  REGION 1..5: note = Synthetic Construct
KPRGK

SEQ ID NO: 5274 - protein, 5 aa, synthetic construct
  REGION 1..5: note = Synthetic Construct
KPRHK

SEQ ID NO: 5275 - protein, 5 aa, synthetic construct
  REGION 1..5: note = Synthetic Construct
KPRIK

SEQ ID NO: 5276 - protein, 5 aa, synthetic construct
  REGION 1..5: note = Synthetic Construct
KPRLK

SEQ ID NO: 5277 - protein, 5 aa, synthetic construct
  REGION 1..5: note = Synthetic Construct
KPRNK

SEQ ID NO: 5278 - protein, 5 aa, synthetic construct
  REGION 1..5: note = Synthetic Construct
KPRQK

SEQ ID NO: 5279 - protein, 5 aa, synthetic construct
  REGION 1..5: note = Synthetic Construct
KPRRK

SEQ ID NO: 5280 - protein, 5 aa, synthetic construct
  REGION 1..5: note = Synthetic Construct
KPRSK

SEQ ID NO: 5281 - protein, 5 aa, synthetic construct
  REGION 1..5: note = Synthetic Construct
KPRTK

SEQ ID NO: 5282 - protein, 5 aa, synthetic construct
  REGION 1..5: note = Synthetic Construct
KPRYK

SEQ ID NO: 5283 - protein, 5 aa, synthetic construct
  REGION 1..5: note = Synthetic Construct
KPSAK

SEQ ID NO: 5284 - protein, 5 aa, synthetic construct
  REGION 1..5: note = Synthetic Construct
KPSDK

SEQ ID NO: 5285 - protein, 5 aa, synthetic construct
  REGION 1..5: note = Synthetic Construct
KPSEK

SEQ ID NO: 5286 - protein, 5 aa, synthetic construct
  REGION 1..5: note = Synthetic Construct
KPSFK

SEQ ID NO: 5287 - protein, 5 aa, synthetic construct
  REGION 1..5: note = Synthetic Construct
KPSGK

SEQ ID NO: 5288 - protein, 5 aa, synthetic construct
  REGION 1..5: note = Synthetic Construct
KPSHK

SEQ ID NO: 5289 - protein, 5 aa, synthetic construct
  REGION 1..5: note = Synthetic Construct
KPSIK

SEQ ID NO: 5290 - protein, 5 aa, synthetic construct
  REGION 1..5: note = Synthetic Construct
KPSLK

SEQ ID NO: 5291 - protein, 5 aa, synthetic construct
  REGION 1..5: note = Synthetic Construct
KPSNK

SEQ ID NO: 5292 - protein, 5 aa, synthetic construct
  REGION 1..5: note = Synthetic Construct
KPSQK

SEQ ID NO: 5293 - protein, 5 aa, synthetic construct
  REGION 1..5: note = Synthetic Construct
KPSRK

SEQ ID NO: 5294 - protein, 5 aa, synthetic construct
  REGION 1..5: note = Synthetic Construct
KPSSK

SEQ ID NO: 5295 - protein, 5 aa, synthetic construct
  REGION 1..5: note = Synthetic Construct
KPSTK

SEQ ID NO: 5296 - protein, 5 aa, synthetic construct
  REGION 1..5: note = Synthetic Construct
KPSYK

SEQ ID NO: 5297 - protein, 5 aa, synthetic construct
  REGION 1..5: note = Synthetic Construct
KPTAK

SEQ ID NO: 5298 - protein, 5 aa, synthetic construct
  REGION 1..5: note = Synthetic Construct
KPTDK

SEQ ID NO: 5299 - protein, 5 aa, synthetic construct
  REGION 1..5: note = Synthetic Construct
KPTEK

SEQ ID NO: 5300 - protein, 5 aa, synthetic construct
  REGION 1..5: note = Synthetic Construct
KPTFK

SEQ ID NO: 5301 - protein, 5 aa, synthetic construct
  REGION 1..5: note = Synthetic Construct
KPTGK

SEQ ID NO: 5302 - protein, 5 aa, synthetic construct
  REGION 1..5: note = Synthetic Construct
KPTHK

SEQ ID NO: 5303 - protein, 5 aa, synthetic construct
  REGION 1..5: note = Synthetic Construct
KPTIK

SEQ ID NO: 5304 - protein, 5 aa, synthetic construct
  REGION 1..5: note = Synthetic Construct
KPTLK

SEQ ID NO: 5305 - protein, 5 aa, synthetic construct
  REGION 1..5: note = Synthetic Construct
KPTNK

SEQ ID NO: 5306 - protein, 5 aa, synthetic construct
  REGION 1..5: note = Synthetic Construct
KPTQK

SEQ ID NO: 5307 - protein, 5 aa, synthetic construct
  REGION 1..5: note = Synthetic Construct
KPTRK

SEQ ID NO: 5308 - protein, 5 aa, synthetic construct
  REGION 1..5: note = Synthetic Construct
KPTSK

SEQ ID NO: 5309 - protein, 5 aa, synthetic construct
  REGION 1..5: note = Synthetic Construct
KPTTK

SEQ ID NO: 5310 - protein, 5 aa, synthetic construct
  REGION 1..5: note = Synthetic Construct
KPTYK

SEQ ID NO: 5311 - protein, 5 aa, synthetic construct
  REGION 1..5: note = Synthetic Construct
KPYAK

SEQ ID NO: 5312 - protein, 5 aa, synthetic construct
  REGION 1..5: note = Synthetic Construct
KPYDK

SEQ ID NO: 5313 - protein, 5 aa, synthetic construct
  REGION 1..5: note = Synthetic Construct
KPYEK

SEQ ID NO: 5314 - protein, 5 aa, synthetic construct
  REGION 1..5: note = Synthetic Construct
KPYFK

SEQ ID NO: 5315 - protein, 5 aa, synthetic construct
  REGION 1..5: note = Synthetic Construct
KPYGK

SEQ ID NO: 5316 - protein, 5 aa, synthetic construct
  REGION 1..5: note = Synthetic Construct
KPYHK

SEQ ID NO: 5317 - protein, 5 aa, synthetic construct
  REGION 1..5: note = Synthetic Construct
KPYIK

SEQ ID NO: 5318 - protein, 5 aa, synthetic construct
  REGION 1..5: note = Synthetic Construct
KPYLK

SEQ ID NO: 5319 - protein, 5 aa, synthetic construct
  REGION 1..5: note = Synthetic Construct
KPYNK

SEQ ID NO: 5320 - protein, 5 aa, synthetic construct
  REGION 1..5: note = Synthetic Construct
KPYQK

SEQ ID NO: 5321 - protein, 5 aa, synthetic construct
  REGION 1..5: note = Synthetic Construct
KPYRK

SEQ ID NO: 5322 - protein, 5 aa, synthetic construct
  REGION 1..5: note = Synthetic Construct
KPYSK

SEQ ID NO: 5323 - protein, 5 aa, synthetic construct
  REGION 1..5: note = Synthetic Construct
KPYTK

SEQ ID NO: 5324 - protein, 5 aa, synthetic construct
  REGION 1..5: note = Synthetic Construct
KPYYK

SEQ ID NO: 5325 - protein, 5 aa, synthetic construct
  REGION 1..5: note = Synthetic Construct
KQAAK

SEQ ID NO: 5326 - protein, 5 aa, synthetic construct
  REGION 1..5: note = Synthetic Construct
KQADK

SEQ ID NO: 5327 - protein, 5 aa, synthetic construct
  REGION 1..5: note = Synthetic Construct
KQAEK

SEQ ID NO: 5328 - protein, 5 aa, synthetic construct
  REGION 1..5: note = Synthetic Construct
KQAFK

SEQ ID NO: 5329 - protein, 5 aa, synthetic construct
  REGION 1..5: note = Synthetic Construct
KQAGK

SEQ ID NO: 5330 - protein, 5 aa, synthetic construct
  REGION 1..5: note = Synthetic Construct
KQAHK

SEQ ID NO: 5331 - protein, 5 aa, synthetic construct
  REGION 1..5: note = Synthetic Construct
KQAIK

SEQ ID NO: 5332 - protein, 5 aa, synthetic construct
  REGION 1..5: note = Synthetic Construct
KQALK

SEQ ID NO: 5333 - protein, 5 aa, synthetic construct
  REGION 1..5: note = Synthetic Construct
KQANK

SEQ ID NO: 5334 - protein, 5 aa, synthetic construct
  REGION 1..5: note = Synthetic Construct
KQAQK

SEQ ID NO: 5335 - protein, 5 aa, synthetic construct
  REGION 1..5: note = Synthetic Construct
KQARK

SEQ ID NO: 5336 - protein, 5 aa, synthetic construct
  REGION 1..5: note = Synthetic Construct
KQASK

SEQ ID NO: 5337 - protein, 5 aa, synthetic construct
  REGION 1..5: note = Synthetic Construct
KQATK

SEQ ID NO: 5338 - protein, 5 aa, synthetic construct
  REGION 1..5: note = Synthetic Construct
KQAYK

SEQ ID NO: 5339 - protein, 5 aa, synthetic construct
  REGION 1..5: note = Synthetic Construct
KQDAK

SEQ ID NO: 5340 - protein, 5 aa, synthetic construct
  REGION 1..5: note = Synthetic Construct
KQDDK

SEQ ID NO: 5341 - protein, 5 aa, synthetic construct
  REGION 1..5: note = Synthetic Construct
KQDEK

SEQ ID NO: 5342 - protein, 5 aa, synthetic construct
  REGION 1..5: note = Synthetic Construct
KQDFK

SEQ ID NO: 5343 - protein, 5 aa, synthetic construct
  REGION 1..5: note = Synthetic Construct
KQDGK

SEQ ID NO: 5344 - protein, 5 aa, synthetic construct
  REGION 1..5: note = Synthetic Construct
KQDHK

SEQ ID NO: 5345 - protein, 5 aa, synthetic construct
  REGION 1..5: note = Synthetic Construct
KQDIK

SEQ ID NO: 5346 - protein, 5 aa, synthetic construct
  REGION 1..5: note = Synthetic Construct
KQDLK

SEQ ID NO: 5347 - protein, 5 aa, synthetic construct
  REGION 1..5: note = Synthetic Construct
KQDNK

SEQ ID NO: 5348 - protein, 5 aa, synthetic construct
  REGION 1..5: note = Synthetic Construct
KQDQK

SEQ ID NO: 5349 - protein, 5 aa, synthetic construct
  REGION 1..5: note = Synthetic Construct
KQDRK

SEQ ID NO: 5350 - protein, 5 aa, synthetic construct
  REGION 1..5: note = Synthetic Construct
KQDSK

SEQ ID NO: 5351 - protein, 5 aa, synthetic construct
  REGION 1..5: note = Synthetic Construct
KQDTK

SEQ ID NO: 5352 - protein, 5 aa, synthetic construct
  REGION 1..5: note = Synthetic Construct
KQDYK

SEQ ID NO: 5353 - protein, 5 aa, synthetic construct
  REGION 1..5: note = Synthetic Construct
KQEAK

SEQ ID NO: 5354 - protein, 5 aa, synthetic construct
  REGION 1..5: note = Synthetic Construct
KQEDK

SEQ ID NO: 5355 - protein, 5 aa, synthetic construct
  REGION 1..5: note = Synthetic Construct
KQEEK

SEQ ID NO: 5356 - protein, 5 aa, synthetic construct
  REGION 1..5: note = Synthetic Construct
KQEFK

SEQ ID NO: 5357 - protein, 5 aa, synthetic construct
  REGION 1..5: note = Synthetic Construct
KQEGK

SEQ ID NO: 5358 - protein, 5 aa, synthetic construct
  REGION 1..5: note = Synthetic Construct
KQEHK

SEQ ID NO: 5359 - protein, 5 aa, synthetic construct
  REGION 1..5: note = Synthetic Construct
KQEIK

SEQ ID NO: 5360 - protein, 5 aa, synthetic construct
  REGION 1..5: note = Synthetic Construct
KQELK

SEQ ID NO: 5361 - protein, 5 aa, synthetic construct
  REGION 1..5: note = Synthetic Construct
KQENK

SEQ ID NO: 5362 - protein, 5 aa, synthetic construct
  REGION 1..5: note = Synthetic Construct
KQEQK

SEQ ID NO: 5363 - protein, 5 aa, synthetic construct
  REGION 1..5: note = Synthetic Construct
KQERK

SEQ ID NO: 5364 - protein, 5 aa, synthetic construct
  REGION 1..5: note = Synthetic Construct
KQESK

SEQ ID NO: 5365 - protein, 5 aa, synthetic construct
  REGION 1..5: note = Synthetic Construct
KQETK

SEQ ID NO: 5366 - protein, 5 aa, synthetic construct
  REGION 1..5: note = Synthetic Construct
KQEYK

SEQ ID NO: 5367 - protein, 5 aa, synthetic construct
  REGION 1..5: note = Synthetic Construct
KQFAK

SEQ ID NO: 5368 - protein, 5 aa, synthetic construct
  REGION 1..5: note = Synthetic Construct
KQFDK

SEQ ID NO: 5369 - protein, 5 aa, synthetic construct
  REGION 1..5: note = Synthetic Construct
KQFEK

SEQ ID NO: 5370 - protein, 5 aa, synthetic construct
  REGION 1..5: note = Synthetic Construct
KQFFK

SEQ ID NO: 5371 - protein, 5 aa, synthetic construct
  REGION 1..5: note = Synthetic Construct
KQFGK

SEQ ID NO: 5372 - protein, 5 aa, synthetic construct
  REGION 1..5: note = Synthetic Construct
KQFHK

SEQ ID NO: 5373 - protein, 5 aa, synthetic construct
  REGION 1..5: note = Synthetic Construct
KQFIK

SEQ ID NO: 5374 - protein, 5 aa, synthetic construct
  REGION 1..5: note = Synthetic Construct
KQFLK

SEQ ID NO: 5375 - protein, 5 aa, synthetic construct
  REGION 1..5: note = Synthetic Construct
KQFNK

SEQ ID NO: 5376 - protein, 5 aa, synthetic construct
  REGION 1..5: note = Synthetic Construct
KQFQK

SEQ ID NO: 5377 - protein, 5 aa, synthetic construct
  REGION 1..5: note = Synthetic Construct
KQFRK

SEQ ID NO: 5378 - protein, 5 aa, synthetic construct
  REGION 1..5: note = Synthetic Construct
KQFSK

SEQ ID NO: 5379 - protein, 5 aa, synthetic construct
  REGION 1..5: note = Synthetic Construct
KQFTK

SEQ ID NO: 5380 - protein, 5 aa, synthetic construct
  REGION 1..5: note = Synthetic Construct
KQFYK

SEQ ID NO: 5381 - protein, 5 aa, synthetic construct
  REGION 1..5: note = Synthetic Construct
KQGAK

SEQ ID NO: 5382 - protein, 5 aa, synthetic construct
  REGION 1..5: note = Synthetic Construct
KQGDK

SEQ ID NO: 5383 - protein, 5 aa, synthetic construct
  REGION 1..5: note = Synthetic Construct
KQGEK

SEQ ID NO: 5384 - protein, 5 aa, synthetic construct
  REGION 1..5: note = Synthetic Construct
KQGFK

SEQ ID NO: 5385 - protein, 5 aa, synthetic construct
  REGION 1..5: note = Synthetic Construct
KQGGK

SEQ ID NO: 5386 - protein, 5 aa, synthetic construct
  REGION 1..5: note = Synthetic Construct
KQGHK

SEQ ID NO: 5387 - protein, 5 aa, synthetic construct
  REGION 1..5: note = Synthetic Construct
KQGIK

SEQ ID NO: 5388 - protein, 5 aa, synthetic construct
  REGION 1..5: note = Synthetic Construct
KQGLK

SEQ ID NO: 5389 - protein, 5 aa, synthetic construct
  REGION 1..5: note = Synthetic Construct
KQGNK

SEQ ID NO: 5390 - protein, 5 aa, synthetic construct
  REGION 1..5: note = Synthetic Construct
KQGQK

SEQ ID NO: 5391 - protein, 5 aa, synthetic construct
  REGION 1..5: note = Synthetic Construct
KQGRK

SEQ ID NO: 5392 - protein, 5 aa, synthetic construct
  REGION 1..5: note = Synthetic Construct
KQGSK

SEQ ID NO: 5393 - protein, 5 aa, synthetic construct
  REGION 1..5: note = Synthetic Construct
KQGTK

SEQ ID NO: 5394 - protein, 5 aa, synthetic construct
  REGION 1..5: note = Synthetic Construct
KQGYK

SEQ ID NO: 5395 - protein, 5 aa, synthetic construct
  REGION 1..5: note = Synthetic Construct
KQHAK

SEQ ID NO: 5396 - protein, 5 aa, synthetic construct
  REGION 1..5: note = Synthetic Construct
KQHDK

SEQ ID NO: 5397 - protein, 5 aa, synthetic construct
  REGION 1..5: note = Synthetic Construct
KQHEK

SEQ ID NO: 5398 - protein, 5 aa, synthetic construct
  REGION 1..5: note = Synthetic Construct
KQHFK

SEQ ID NO: 5399 - protein, 5 aa, synthetic construct
  REGION 1..5: note = Synthetic Construct
KQHGK

SEQ ID NO: 5400 - protein, 5 aa, synthetic construct
  REGION 1..5: note = Synthetic Construct
KQHHK

SEQ ID NO: 5401 - protein, 5 aa, synthetic construct
  REGION 1..5: note = Synthetic Construct
KQHIK

SEQ ID NO: 5402 - protein, 5 aa, synthetic construct
  REGION 1..5: note = Synthetic Construct
KQHLK

SEQ ID NO: 5403 - protein, 5 aa, synthetic construct
  REGION 1..5: note = Synthetic Construct
KQHNK

SEQ ID NO: 5404 - protein, 5 aa, synthetic construct
  REGION 1..5: note = Synthetic Construct
KQHQK

SEQ ID NO: 5405 - protein, 5 aa, synthetic construct
  REGION 1..5: note = Synthetic Construct
KQHRK

SEQ ID NO: 5406 - protein, 5 aa, synthetic construct
  REGION 1..5: note = Synthetic Construct
KQHSK

SEQ ID NO: 5407 - protein, 5 aa, synthetic construct
  REGION 1..5: note = Synthetic Construct
KQHTK

SEQ ID NO: 5408 - protein, 5 aa, synthetic construct
  REGION 1..5: note = Synthetic Construct
KQHYK

SEQ ID NO: 5409 - protein, 5 aa, synthetic construct
  REGION 1..5: note = Synthetic Construct
KQIAK

SEQ ID NO: 5410 - protein, 5 aa, synthetic construct
  REGION 1..5: note = Synthetic Construct
KQIDK

SEQ ID NO: 5411 - protein, 5 aa, synthetic construct
  REGION 1..5: note = Synthetic Construct
KQIEK

SEQ ID NO: 5412 - protein, 5 aa, synthetic construct
  REGION 1..5: note = Synthetic Construct
KQIFK

SEQ ID NO: 5413 - protein, 5 aa, synthetic construct
  REGION 1..5: note = Synthetic Construct
KQIGK

SEQ ID NO: 5414 - protein, 5 aa, synthetic construct
  REGION 1..5: note = Synthetic Construct
KQIHK

SEQ ID NO: 5415 - protein, 5 aa, synthetic construct
  REGION 1..5: note = Synthetic Construct
KQIIK

SEQ ID NO: 5416 - protein, 5 aa, synthetic construct
  REGION 1..5: note = Synthetic Construct
KQILK

SEQ ID NO: 5417 - protein, 5 aa, synthetic construct
  REGION 1..5: note = Synthetic Construct
KQINK

SEQ ID NO: 5418 - protein, 5 aa, synthetic construct
  REGION 1..5: note = Synthetic Construct
KQIQK

SEQ ID NO: 5419 - protein, 5 aa, synthetic construct
  REGION 1..5: note = Synthetic Construct
KQIRK

SEQ ID NO: 5420 - protein, 5 aa, synthetic construct
  REGION 1..5: note = Synthetic Construct
KQISK

SEQ ID NO: 5421 - protein, 5 aa, synthetic construct
  REGION 1..5: note = Synthetic Construct
KQITK

SEQ ID NO: 5422 - protein, 5 aa, synthetic construct
  REGION 1..5: note = Synthetic Construct
KQIYK

SEQ ID NO: 5423 - protein, 5 aa, synthetic construct
  REGION 1..5: note = Synthetic Construct
KQLAK

SEQ ID NO: 5424 - protein, 5 aa, synthetic construct
  REGION 1..5: note = Synthetic Construct
KQLDK

SEQ ID NO: 5425 - protein, 5 aa, synthetic construct
  REGION 1..5: note = Synthetic Construct
KQLEK

SEQ ID NO: 5426 - protein, 5 aa, synthetic construct
  REGION 1..5: note = Synthetic Construct
KQLFK

SEQ ID NO: 5427 - protein, 5 aa, synthetic construct
  REGION 1..5: note = Synthetic Construct
KQLGK

SEQ ID NO: 5428 - protein, 5 aa, synthetic construct
  REGION 1..5: note = Synthetic Construct
KQLHK

SEQ ID NO: 5429 - protein, 5 aa, synthetic construct
  REGION 1..5: note = Synthetic Construct
KQLIK

SEQ ID NO: 5430 - protein, 5 aa, synthetic construct
  REGION 1..5: note = Synthetic Construct
KQLLK

SEQ ID NO: 5431 - protein, 5 aa, synthetic construct
  REGION 1..5: note = Synthetic Construct
KQLNK

SEQ ID NO: 5432 - protein, 5 aa, synthetic construct
  REGION 1..5: note = Synthetic Construct
KQLQK

SEQ ID NO: 5433 - protein, 5 aa, synthetic construct
  REGION 1..5: note = Synthetic Construct
KQLRK

SEQ ID NO: 5434 - protein, 5 aa, synthetic construct
  REGION 1..5: note = Synthetic Construct
KQLSK

SEQ ID NO: 5435 - protein, 5 aa, synthetic construct
  REGION 1..5: note = Synthetic Construct
KQLTK

SEQ ID NO: 5436 - protein, 5 aa, synthetic construct
  REGION 1..5: note = Synthetic Construct
KQLYK

SEQ ID NO: 5437 - protein, 5 aa, synthetic construct
  REGION 1..5: note = Synthetic Construct
KQNAK

SEQ ID NO: 5438 - protein, 5 aa, synthetic construct
  REGION 1..5: note = Synthetic Construct
KQNDK

SEQ ID NO: 5439 - protein, 5 aa, synthetic construct
  REGION 1..5: note = Synthetic Construct
KQNEK

SEQ ID NO: 5440 - protein, 5 aa, synthetic construct
  REGION 1..5: note = Synthetic Construct
KQNFK

SEQ ID NO: 5441 - protein, 5 aa, synthetic construct
  REGION 1..5: note = Synthetic Construct
KQNGK

SEQ ID NO: 5442 - protein, 5 aa, synthetic construct
  REGION 1..5: note = Synthetic Construct
KQNHK

SEQ ID NO: 5443 - protein, 5 aa, synthetic construct
  REGION 1..5: note = Synthetic Construct
KQNIK

SEQ ID NO: 5444 - protein, 5 aa, synthetic construct
  REGION 1..5: note = Synthetic Construct
KQNLK

SEQ ID NO: 5445 - protein, 5 aa, synthetic construct
  REGION 1..5: note = Synthetic Construct
KQNNK

SEQ ID NO: 5446 - protein, 5 aa, synthetic construct
  REGION 1..5: note = Synthetic Construct
KQNQK

SEQ ID NO: 5447 - protein, 5 aa, synthetic construct
  REGION 1..5: note = Synthetic Construct
KQNRK

SEQ ID NO: 5448 - protein, 5 aa, synthetic construct
  REGION 1..5: note = Synthetic Construct
KQNSK

SEQ ID NO: 5449 - protein, 5 aa, synthetic construct
  REGION 1..5: note = Synthetic Construct
KQNTK

SEQ ID NO: 5450 - protein, 5 aa, synthetic construct
  REGION 1..5: note = Synthetic Construct
KQNYK

SEQ ID NO: 5451 - protein, 5 aa, synthetic construct
  REGION 1..5: note = Synthetic Construct
KQPAK

SEQ ID NO: 5452 - protein, 5 aa, synthetic construct
  REGION 1..5: note = Synthetic Construct
KQPDK

SEQ ID NO: 5453 - protein, 5 aa, synthetic construct
  REGION 1..5: note = Synthetic Construct
KQPEK

SEQ ID NO: 5454 - protein, 5 aa, synthetic construct
  REGION 1..5: note = Synthetic Construct
KQPFK

SEQ ID NO: 5455 - protein, 5 aa, synthetic construct
  REGION 1..5: note = Synthetic Construct
KQPGK

SEQ ID NO: 5456 - protein, 5 aa, synthetic construct
  REGION 1..5: note = Synthetic Construct
KQPHK

SEQ ID NO: 5457 - protein, 5 aa, synthetic construct
  REGION 1..5: note = Synthetic Construct
KQPIK

SEQ ID NO: 5458 - protein, 5 aa, synthetic construct
  REGION 1..5: note = Synthetic Construct
KQPLK

SEQ ID NO: 5459 - protein, 5 aa, synthetic construct
  REGION 1..5: note = Synthetic Construct
KQPNK

SEQ ID NO: 5460 - protein, 5 aa, synthetic construct
  REGION 1..5: note = Synthetic Construct
KQPQK

SEQ ID NO: 5461 - protein, 5 aa, synthetic construct
  REGION 1..5: note = Synthetic Construct
KQPRK

SEQ ID NO: 5462 - protein, 5 aa, synthetic construct
  REGION 1..5: note = Synthetic Construct
KQPSK

SEQ ID NO: 5463 - protein, 5 aa, synthetic construct
  REGION 1..5: note = Synthetic Construct
KQPTK

SEQ ID NO: 5464 - protein, 5 aa, synthetic construct
  REGION 1..5: note = Synthetic Construct
KQPYK

SEQ ID NO: 5465 - protein, 5 aa, synthetic construct
  REGION 1..5: note = Synthetic Construct
KQQAK

SEQ ID NO: 5466 - protein, 5 aa, synthetic construct
  REGION 1..5: note = Synthetic Construct
KQQDK

SEQ ID NO: 5467 - protein, 5 aa, synthetic construct
  REGION 1..5: note = Synthetic Construct
KQQEK

SEQ ID NO: 5468 - protein, 5 aa, synthetic construct
  REGION 1..5: note = Synthetic Construct
KQQFK

SEQ ID NO: 5469 - protein, 5 aa, synthetic construct
  REGION 1..5: note = Synthetic Construct
KQQGK

SEQ ID NO: 5470 - protein, 5 aa, synthetic construct
  REGION 1..5: note = Synthetic Construct
KQQHK

SEQ ID NO: 5471 - protein, 5 aa, synthetic construct
  REGION 1..5: note = Synthetic Construct
KQQIK

SEQ ID NO: 5472 - protein, 5 aa, synthetic construct
  REGION 1..5: note = Synthetic Construct
KQQLK

SEQ ID NO: 5473 - protein, 5 aa, synthetic construct
  REGION 1..5: note = Synthetic Construct
KQQNK

SEQ ID NO: 5474 - protein, 5 aa, synthetic construct
  REGION 1..5: note = Synthetic Construct
KQQQK

SEQ ID NO: 5475 - protein, 5 aa, synthetic construct
  REGION 1..5: note = Synthetic Construct
KQQRK

SEQ ID NO: 5476 - protein, 5 aa, synthetic construct
  REGION 1..5: note = Synthetic Construct
KQQSK

SEQ ID NO: 5477 - protein, 5 aa, synthetic construct
  REGION 1..5: note = Synthetic Construct
KQQTK

SEQ ID NO: 5478 - protein, 5 aa, synthetic construct
  REGION 1..5: note = Synthetic Construct
KQQYK

SEQ ID NO: 5479 - protein, 5 aa, synthetic construct
  REGION 1..5: note = Synthetic Construct
KQRAK

SEQ ID NO: 5480 - protein, 5 aa, synthetic construct
  REGION 1..5: note = Synthetic Construct
KQRDK

SEQ ID NO: 5481 - protein, 5 aa, synthetic construct
  REGION 1..5: note = Synthetic Construct
KQREK

SEQ ID NO: 5482 - protein, 5 aa, synthetic construct
  REGION 1..5: note = Synthetic Construct
KQRFK

SEQ ID NO: 5483 - protein, 5 aa, synthetic construct
  REGION 1..5: note = Synthetic Construct
KQRGK

SEQ ID NO: 5484 - protein, 5 aa, synthetic construct
  REGION 1..5: note = Synthetic Construct
KQRHK

SEQ ID NO: 5485 - protein, 5 aa, synthetic construct
  REGION 1..5: note = Synthetic Construct
KQRIK

SEQ ID NO: 5486 - protein, 5 aa, synthetic construct
  REGION 1..5: note = Synthetic Construct
KQRLK

SEQ ID NO: 5487 - protein, 5 aa, synthetic construct
  REGION 1..5: note = Synthetic Construct
KQRNK

SEQ ID NO: 5488 - protein, 5 aa, synthetic construct
  REGION 1..5: note = Synthetic Construct
KQRQK

SEQ ID NO: 5489 - protein, 5 aa, synthetic construct
  REGION 1..5: note = Synthetic Construct
KQRRK

SEQ ID NO: 5490 - protein, 5 aa, synthetic construct
  REGION 1..5: note = Synthetic Construct
KQRSK

SEQ ID NO: 5491 - protein, 5 aa, synthetic construct
  REGION 1..5: note = Synthetic Construct
KQRTK

SEQ ID NO: 5492 - protein, 5 aa, synthetic construct
  REGION 1..5: note = Synthetic Construct
KQRYK

SEQ ID NO: 5493 - protein, 5 aa, synthetic construct
  REGION 1..5: note = Synthetic Construct
KQSAK

SEQ ID NO: 5494 - protein, 5 aa, synthetic construct
  REGION 1..5: note = Synthetic Construct
KQSDK

SEQ ID NO: 5495 - protein, 5 aa, synthetic construct
  REGION 1..5: note = Synthetic Construct
KQSEK

SEQ ID NO: 5496 - protein, 5 aa, synthetic construct
  REGION 1..5: note = Synthetic Construct
KQSFK

SEQ ID NO: 5497 - protein, 5 aa, synthetic construct
  REGION 1..5: note = Synthetic Construct
KQSGK

SEQ ID NO: 5498 - protein, 5 aa, synthetic construct
  REGION 1..5: note = Synthetic Construct
KQSHK

SEQ ID NO: 5499 - protein, 5 aa, synthetic construct
  REGION 1..5: note = Synthetic Construct
KQSIK

SEQ ID NO: 5500 - protein, 5 aa, synthetic construct
  REGION 1..5: note = Synthetic Construct
KQSLK

SEQ ID NO: 5501 - protein, 5 aa, synthetic construct
  REGION 1..5: note = Synthetic Construct
KQSNK

SEQ ID NO: 5502 - protein, 5 aa, synthetic construct
  REGION 1..5: note = Synthetic Construct
KQSQK

SEQ ID NO: 5503 - protein, 5 aa, synthetic construct
  REGION 1..5: note = Synthetic Construct
KQSRK

SEQ ID NO: 5504 - protein, 5 aa, synthetic construct
  REGION 1..5: note = Synthetic Construct
KQSSK

SEQ ID NO: 5505 - protein, 5 aa, synthetic construct
  REGION 1..5: note = Synthetic Construct
KQSTK

SEQ ID NO: 5506 - protein, 5 aa, synthetic construct
  REGION 1..5: note = Synthetic Construct
KQSYK

SEQ ID NO: 5507 - protein, 5 aa, synthetic construct
  REGION 1..5: note = Synthetic Construct
KQTAK

SEQ ID NO: 5508 - protein, 5 aa, synthetic construct
  REGION 1..5: note = Synthetic Construct
KQTDK

SEQ ID NO: 5509 - protein, 5 aa, synthetic construct
  REGION 1..5: note = Synthetic Construct
KQTEK

SEQ ID NO: 5510 - protein, 5 aa, synthetic construct
  REGION 1..5: note = Synthetic Construct
KQTFK

SEQ ID NO: 5511 - protein, 5 aa, synthetic construct
  REGION 1..5: note = Synthetic Construct
KQTGK

SEQ ID NO: 5512 - protein, 5 aa, synthetic construct
  REGION 1..5: note = Synthetic Construct
KQTHK

SEQ ID NO: 5513 - protein, 5 aa, synthetic construct
  REGION 1..5: note = Synthetic Construct
KQTIK

SEQ ID NO: 5514 - protein, 5 aa, synthetic construct
  REGION 1..5: note = Synthetic Construct
KQTLK

SEQ ID NO: 5515 - protein, 5 aa, synthetic construct
  REGION 1..5: note = Synthetic Construct
KQTNK

SEQ ID NO: 5516 - protein, 5 aa, synthetic construct
  REGION 1..5: note = Synthetic Construct
KQTQK

SEQ ID NO: 5517 - protein, 5 aa, synthetic construct
  REGION 1..5: note = Synthetic Construct
KQTRK

SEQ ID NO: 5518 - protein, 5 aa, synthetic construct
  REGION 1..5: note = Synthetic Construct
KQTSK

SEQ ID NO: 5519 - protein, 5 aa, synthetic construct
  REGION 1..5: note = Synthetic Construct
KQTTK

SEQ ID NO: 5520 - protein, 5 aa, synthetic construct
  REGION 1..5: note = Synthetic Construct
KQTYK

SEQ ID NO: 5521 - protein, 5 aa, synthetic construct
  REGION 1..5: note = Synthetic Construct
KQYAK

SEQ ID NO: 5522 - protein, 5 aa, synthetic construct
  REGION 1..5: note = Synthetic Construct
KQYDK

SEQ ID NO: 5523 - protein, 5 aa, synthetic construct
  REGION 1..5: note = Synthetic Construct
KQYEK

SEQ ID NO: 5524 - protein, 5 aa, synthetic construct
  REGION 1..5: note = Synthetic Construct
KQYFK

SEQ ID NO: 5525 - protein, 5 aa, synthetic construct
  REGION 1..5: note = Synthetic Construct
KQYGK

SEQ ID NO: 5526 - protein, 5 aa, synthetic construct
  REGION 1..5: note = Synthetic Construct
KQYHK

SEQ ID NO: 5527 - protein, 5 aa, synthetic construct
  REGION 1..5: note = Synthetic Construct
KQYIK

SEQ ID NO: 5528 - protein, 5 aa, synthetic construct
  REGION 1..5: note = Synthetic Construct
KQYLK

SEQ ID NO: 5529 - protein, 5 aa, synthetic construct
  REGION 1..5: note = Synthetic Construct
KQYNK

SEQ ID NO: 5530 - protein, 5 aa, synthetic construct
  REGION 1..5: note = Synthetic Construct
KQYQK

SEQ ID NO: 5531 - protein, 5 aa, synthetic construct
  REGION 1..5: note = Synthetic Construct
KQYRK

SEQ ID NO: 5532 - protein, 5 aa, synthetic construct
  REGION 1..5: note = Synthetic Construct
KQYSK

SEQ ID NO: 5533 - protein, 5 aa, synthetic construct
  REGION 1..5: note = Synthetic Construct
KQYTK

SEQ ID NO: 5534 - protein, 5 aa, synthetic construct
  REGION 1..5: note = Synthetic Construct
KQYYK

SEQ ID NO: 5535 - protein, 5 aa, synthetic construct
  REGION 1..5: note = Synthetic Construct
KRAAK

SEQ ID NO: 5536 - protein, 5 aa, synthetic construct
  REGION 1..5: note = Synthetic Construct
KRADK

SEQ ID NO: 5537 - protein, 5 aa, synthetic construct
  REGION 1..5: note = Synthetic Construct
KRAEK

SEQ ID NO: 5538 - protein, 5 aa, synthetic construct
  REGION 1..5: note = Synthetic Construct
KRAFK

SEQ ID NO: 5539 - protein, 5 aa, synthetic construct
  REGION 1..5: note = Synthetic Construct
KRAGK

SEQ ID NO: 5540 - protein, 5 aa, synthetic construct
  REGION 1..5: note = Synthetic Construct
KRAHK

SEQ ID NO: 5541 - protein, 5 aa, synthetic construct
  REGION 1..5: note = Synthetic Construct
KRAIK

SEQ ID NO: 5542 - protein, 5 aa, synthetic construct
  REGION 1..5: note = Synthetic Construct
KRALK

SEQ ID NO: 5543 - protein, 5 aa, synthetic construct
  REGION 1..5: note = Synthetic Construct
KRANK

SEQ ID NO: 5544 - protein, 5 aa, synthetic construct
  REGION 1..5: note = Synthetic Construct
KRAQK

SEQ ID NO: 5545 - protein, 5 aa, synthetic construct
  REGION 1..5: note = Synthetic Construct
KRARK

SEQ ID NO: 5546 - protein, 5 aa, synthetic construct
  REGION 1..5: note = Synthetic Construct
KRASK

SEQ ID NO: 5547 - protein, 5 aa, synthetic construct
  REGION 1..5: note = Synthetic Construct
KRATK

SEQ ID NO: 5548 - protein, 5 aa, synthetic construct
  REGION 1..5: note = Synthetic Construct
KRAYK

SEQ ID NO: 5549 - protein, 5 aa, synthetic construct
  REGION 1..5: note = Synthetic Construct
KRDAK

SEQ ID NO: 5550 - protein, 5 aa, synthetic construct
  REGION 1..5: note = Synthetic Construct
KRDDK

SEQ ID NO: 5551 - protein, 5 aa, synthetic construct
  REGION 1..5: note = Synthetic Construct
KRDEK

SEQ ID NO: 5552 - protein, 5 aa, synthetic construct
  REGION 1..5: note = Synthetic Construct
KRDFK

SEQ ID NO: 5553 - protein, 5 aa, synthetic construct
  REGION 1..5: note = Synthetic Construct
KRDGK

SEQ ID NO: 5554 - protein, 5 aa, synthetic construct
  REGION 1..5: note = Synthetic Construct
KRDHK

SEQ ID NO: 5555 - protein, 5 aa, synthetic construct
  REGION 1..5: note = Synthetic Construct
KRDIK

SEQ ID NO: 5556 - protein, 5 aa, synthetic construct
  REGION 1..5: note = Synthetic Construct
KRDLK

SEQ ID NO: 5557 - protein, 5 aa, synthetic construct
  REGION 1..5: note = Synthetic Construct
KRDNK

SEQ ID NO: 5558 - protein, 5 aa, synthetic construct
  REGION 1..5: note = Synthetic Construct
KRDQK

SEQ ID NO: 5559 - protein, 5 aa, synthetic construct
  REGION 1..5: note = Synthetic Construct
KRDRK

SEQ ID NO: 5560 - protein, 5 aa, synthetic construct
  REGION 1..5: note = Synthetic Construct
KRDSK

SEQ ID NO: 5561 - protein, 5 aa, synthetic construct
  REGION 1..5: note = Synthetic Construct
KRDTK

SEQ ID NO: 5562 - protein, 5 aa, synthetic construct
  REGION 1..5: note = Synthetic Construct
KRDYK

SEQ ID NO: 5563 - protein, 5 aa, synthetic construct
  REGION 1..5: note = Synthetic Construct
KREAK

SEQ ID NO: 5564 - protein, 5 aa, synthetic construct
  REGION 1..5: note = Synthetic Construct
KREDK

SEQ ID NO: 5565 - protein, 5 aa, synthetic construct
  REGION 1..5: note = Synthetic Construct
KREEK

SEQ ID NO: 5566 - protein, 5 aa, synthetic construct
  REGION 1..5: note = Synthetic Construct
KREFK

SEQ ID NO: 5567 - protein, 5 aa, synthetic construct
  REGION 1..5: note = Synthetic Construct
KREGK

SEQ ID NO: 5568 - protein, 5 aa, synthetic construct
  REGION 1..5: note = Synthetic Construct
KREHK

SEQ ID NO: 5569 - protein, 5 aa, synthetic construct
  REGION 1..5: note = Synthetic Construct
KREIK

SEQ ID NO: 5570 - protein, 5 aa, synthetic construct
  REGION 1..5: note = Synthetic Construct
KRELK

SEQ ID NO: 5571 - protein, 5 aa, synthetic construct
  REGION 1..5: note = Synthetic Construct
KRENK

SEQ ID NO: 5572 - protein, 5 aa, synthetic construct
  REGION 1..5: note = Synthetic Construct
KREQK

SEQ ID NO: 5573 - protein, 5 aa, synthetic construct
  REGION 1..5: note = Synthetic Construct
KRERK

SEQ ID NO: 5574 - protein, 5 aa, synthetic construct
  REGION 1..5: note = Synthetic Construct
KRESK

SEQ ID NO: 5575 - protein, 5 aa, synthetic construct
  REGION 1..5: note = Synthetic Construct
KRETK

SEQ ID NO: 5576 - protein, 5 aa, synthetic construct
  REGION 1..5: note = Synthetic Construct
KREYK

SEQ ID NO: 5577 - protein, 5 aa, synthetic construct
  REGION 1..5: note = Synthetic Construct
KRFAK

SEQ ID NO: 5578 - protein, 5 aa, synthetic construct
  REGION 1..5: note = Synthetic Construct
KRFDK

SEQ ID NO: 5579 - protein, 5 aa, synthetic construct
  REGION 1..5: note = Synthetic Construct
KRFEK

SEQ ID NO: 5580 - protein, 5 aa, synthetic construct
  REGION 1..5: note = Synthetic Construct
KRFFK

SEQ ID NO: 5581 - protein, 5 aa, synthetic construct
  REGION 1..5: note = Synthetic Construct
KRFGK

SEQ ID NO: 5582 - protein, 5 aa, synthetic construct
  REGION 1..5: note = Synthetic Construct
KRFHK

SEQ ID NO: 5583 - protein, 5 aa, synthetic construct
  REGION 1..5: note = Synthetic Construct
KRFIK

SEQ ID NO: 5584 - protein, 5 aa, synthetic construct
  REGION 1..5: note = Synthetic Construct
KRFLK

SEQ ID NO: 5585 - protein, 5 aa, synthetic construct
  REGION 1..5: note = Synthetic Construct
KRFNK

SEQ ID NO: 5586 - protein, 5 aa, synthetic construct
  REGION 1..5: note = Synthetic Construct
KRFQK

SEQ ID NO: 5587 - protein, 5 aa, synthetic construct
  REGION 1..5: note = Synthetic Construct
KRFRK

SEQ ID NO: 5588 - protein, 5 aa, synthetic construct
  REGION 1..5: note = Synthetic Construct
KRFSK

SEQ ID NO: 5589 - protein, 5 aa, synthetic construct
  REGION 1..5: note = Synthetic Construct
KRFTK

SEQ ID NO: 5590 - protein, 5 aa, synthetic construct
  REGION 1..5: note = Synthetic Construct
KRFYK

SEQ ID NO: 5591 - protein, 5 aa, synthetic construct
  REGION 1..5: note = Synthetic Construct
KRGAK

SEQ ID NO: 5592 - protein, 5 aa, synthetic construct
  REGION 1..5: note = Synthetic Construct
KRGDK

SEQ ID NO: 5593 - protein, 5 aa, synthetic construct
  REGION 1..5: note = Synthetic Construct
KRGEK

SEQ ID NO: 5594 - protein, 5 aa, synthetic construct
  REGION 1..5: note = Synthetic Construct
KRGFK

SEQ ID NO: 5595 - protein, 5 aa, synthetic construct
  REGION 1..5: note = Synthetic Construct
KRGGK

SEQ ID NO: 5596 - protein, 5 aa, synthetic construct
  REGION 1..5: note = Synthetic Construct
KRGHK

SEQ ID NO: 5597 - protein, 5 aa, synthetic construct
  REGION 1..5: note = Synthetic Construct
KRGIK

SEQ ID NO: 5598 - protein, 5 aa, synthetic construct
  REGION 1..5: note = Synthetic Construct
KRGLK

SEQ ID NO: 5599 - protein, 5 aa, synthetic construct
  REGION 1..5: note = Synthetic Construct
KRGNK

SEQ ID NO: 5600 - protein, 5 aa, synthetic construct
  REGION 1..5: note = Synthetic Construct
KRGQK

SEQ ID NO: 5601 - protein, 5 aa, synthetic construct
  REGION 1..5: note = Synthetic Construct
KRGRK

SEQ ID NO: 5602 - protein, 5 aa, synthetic construct
  REGION 1..5: note = Synthetic Construct
KRGSK

SEQ ID NO: 5603 - protein, 5 aa, synthetic construct
  REGION 1..5: note = Synthetic Construct
KRGTK

SEQ ID NO: 5604 - protein, 5 aa, synthetic construct
  REGION 1..5: note = Synthetic Construct
KRGYK

SEQ ID NO: 5605 - protein, 5 aa, synthetic construct
  REGION 1..5: note = Synthetic Construct
KRHAK

SEQ ID NO: 5606 - protein, 5 aa, synthetic construct
  REGION 1..5: note = Synthetic Construct
KRHDK

SEQ ID NO: 5607 - protein, 5 aa, synthetic construct
  REGION 1..5: note = Synthetic Construct
KRHEK

SEQ ID NO: 5608 - protein, 5 aa, synthetic construct
  REGION 1..5: note = Synthetic Construct
KRHFK

SEQ ID NO: 5609 - protein, 5 aa, synthetic construct
  REGION 1..5: note = Synthetic Construct
KRHGK

SEQ ID NO: 5610 - protein, 5 aa, synthetic construct
  REGION 1..5: note = Synthetic Construct
KRHHK

SEQ ID NO: 5611 - protein, 5 aa, synthetic construct
  REGION 1..5: note = Synthetic Construct
KRHIK

SEQ ID NO: 5612 - protein, 5 aa, synthetic construct
  REGION 1..5: note = Synthetic Construct
KRHLK

SEQ ID NO: 5613 - protein, 5 aa, synthetic construct
  REGION 1..5: note = Synthetic Construct
KRHNK

SEQ ID NO: 5614 - protein, 5 aa, synthetic construct
  REGION 1..5: note = Synthetic Construct
KRHQK

SEQ ID NO: 5615 - protein, 5 aa, synthetic construct
  REGION 1..5: note = Synthetic Construct
KRHRK

SEQ ID NO: 5616 - protein, 5 aa, synthetic construct
  REGION 1..5: note = Synthetic Construct
KRHSK

SEQ ID NO: 5617 - protein, 5 aa, synthetic construct
  REGION 1..5: note = Synthetic Construct
KRHTK

SEQ ID NO: 5618 - protein, 5 aa, synthetic construct
  REGION 1..5: note = Synthetic Construct
KRHYK

SEQ ID NO: 5619 - protein, 5 aa, synthetic construct
  REGION 1..5: note = Synthetic Construct
KRIAK

SEQ ID NO: 5620 - protein, 5 aa, synthetic construct
  REGION 1..5: note = Synthetic Construct
KRIDK

SEQ ID NO: 5621 - protein, 5 aa, synthetic construct
  REGION 1..5: note = Synthetic Construct
KRIEK

SEQ ID NO: 5622 - protein, 5 aa, synthetic construct
  REGION 1..5: note = Synthetic Construct
KRIFK

SEQ ID NO: 5623 - protein, 5 aa, synthetic construct
  REGION 1..5: note = Synthetic Construct
KRIGK

SEQ ID NO: 5624 - protein, 5 aa, synthetic construct
  REGION 1..5: note = Synthetic Construct
KRIHK

SEQ ID NO: 5625 - protein, 5 aa, synthetic construct
  REGION 1..5: note = Synthetic Construct
KRIIK

SEQ ID NO: 5626 - protein, 5 aa, synthetic construct
  REGION 1..5: note = Synthetic Construct
KRILK

SEQ ID NO: 5627 - protein, 5 aa, synthetic construct
  REGION 1..5: note = Synthetic Construct
KRINK

SEQ ID NO: 5628 - protein, 5 aa, synthetic construct
  REGION 1..5: note = Synthetic Construct
KRIQK

SEQ ID NO: 5629 - protein, 5 aa, synthetic construct
  REGION 1..5: note = Synthetic Construct
KRIRK

SEQ ID NO: 5630 - protein, 5 aa, synthetic construct
  REGION 1..5: note = Synthetic Construct
KRISK

SEQ ID NO: 5631 - protein, 5 aa, synthetic construct
  REGION 1..5: note = Synthetic Construct
KRITK

SEQ ID NO: 5632 - protein, 5 aa, synthetic construct
  REGION 1..5: note = Synthetic Construct
KRIYK

SEQ ID NO: 5633 - protein, 5 aa, synthetic construct
  REGION 1..5: note = Synthetic Construct
KRLAK

SEQ ID NO: 5634 - protein, 5 aa, synthetic construct
  REGION 1..5: note = Synthetic Construct
KRLDK

SEQ ID NO: 5635 - protein, 5 aa, synthetic construct
  REGION 1..5: note = Synthetic Construct
KRLEK

SEQ ID NO: 5636 - protein, 5 aa, synthetic construct
  REGION 1..5: note = Synthetic Construct
KRLFK

SEQ ID NO: 5637 - protein, 5 aa, synthetic construct
  REGION 1..5: note = Synthetic Construct
KRLGK

SEQ ID NO: 5638 - protein, 5 aa, synthetic construct
  REGION 1..5: note = Synthetic Construct
KRLHK

SEQ ID NO: 5639 - protein, 5 aa, synthetic construct
  REGION 1..5: note = Synthetic Construct
KRLIK

SEQ ID NO: 5640 - protein, 5 aa, synthetic construct
  REGION 1..5: note = Synthetic Construct
KRLLK

SEQ ID NO: 5641 - protein, 5 aa, synthetic construct
  REGION 1..5: note = Synthetic Construct
KRLNK

SEQ ID NO: 5642 - protein, 5 aa, synthetic construct
  REGION 1..5: note = Synthetic Construct
KRLQK

SEQ ID NO: 5643 - protein, 5 aa, synthetic construct
  REGION 1..5: note = Synthetic Construct
KRLRK

SEQ ID NO: 5644 - protein, 5 aa, synthetic construct
  REGION 1..5: note = Synthetic Construct
KRLSK

SEQ ID NO: 5645 - protein, 5 aa, synthetic construct
  REGION 1..5: note = Synthetic Construct
KRLTK

SEQ ID NO: 5646 - protein, 5 aa, synthetic construct
  REGION 1..5: note = Synthetic Construct
KRLYK

SEQ ID NO: 5647 - protein, 5 aa, synthetic construct
  REGION 1..5: note = Synthetic Construct
KRNAK

SEQ ID NO: 5648 - protein, 5 aa, synthetic construct
  REGION 1..5: note = Synthetic Construct
KRNDK

SEQ ID NO: 5649 - protein, 5 aa, synthetic construct
  REGION 1..5: note = Synthetic Construct
KRNEK

SEQ ID NO: 5650 - protein, 5 aa, synthetic construct
  REGION 1..5: note = Synthetic Construct
KRNFK

SEQ ID NO: 5651 - protein, 5 aa, synthetic construct
  REGION 1..5: note = Synthetic Construct
KRNGK

SEQ ID NO: 5652 - protein, 5 aa, synthetic construct
  REGION 1..5: note = Synthetic Construct
KRNHK

SEQ ID NO: 5653 - protein, 5 aa, synthetic construct
  REGION 1..5: note = Synthetic Construct
KRNIK

SEQ ID NO: 5654 - protein, 5 aa, synthetic construct
  REGION 1..5: note = Synthetic Construct
KRNLK

SEQ ID NO: 5655 - protein, 5 aa, synthetic construct
  REGION 1..5: note = Synthetic Construct
KRNNK

SEQ ID NO: 5656 - protein, 5 aa, synthetic construct
  REGION 1..5: note = Synthetic Construct
KRNQK

SEQ ID NO: 5657 - protein, 5 aa, synthetic construct
  REGION 1..5: note = Synthetic Construct
KRNRK

SEQ ID NO: 5658 - protein, 5 aa, synthetic construct
  REGION 1..5: note = Synthetic Construct
KRNSK

SEQ ID NO: 5659 - protein, 5 aa, synthetic construct
  REGION 1..5: note = Synthetic Construct
KRNTK

SEQ ID NO: 5660 - protein, 5 aa, synthetic construct
  REGION 1..5: note = Synthetic Construct
KRNYK

SEQ ID NO: 5661 - protein, 5 aa, synthetic construct
  REGION 1..5: note = Synthetic Construct
KRPAK

SEQ ID NO: 5662 - protein, 5 aa, synthetic construct
  REGION 1..5: note = Synthetic Construct
KRPDK

SEQ ID NO: 5663 - protein, 5 aa, synthetic construct
  REGION 1..5: note = Synthetic Construct
KRPEK

SEQ ID NO: 5664 - protein, 5 aa, synthetic construct
  REGION 1..5: note = Synthetic Construct
KRPFK

SEQ ID NO: 5665 - protein, 5 aa, synthetic construct
  REGION 1..5: note = Synthetic Construct
KRPGK

SEQ ID NO: 5666 - protein, 5 aa, synthetic construct
  REGION 1..5: note = Synthetic Construct
KRPHK

SEQ ID NO: 5667 - protein, 5 aa, synthetic construct
  REGION 1..5: note = Synthetic Construct
KRPIK

SEQ ID NO: 5668 - protein, 5 aa, synthetic construct
  REGION 1..5: note = Synthetic Construct
KRPLK

SEQ ID NO: 5669 - protein, 5 aa, synthetic construct
  REGION 1..5: note = Synthetic Construct
KRPNK

SEQ ID NO: 5670 - protein, 5 aa, synthetic construct
  REGION 1..5: note = Synthetic Construct
KRPQK

SEQ ID NO: 5671 - protein, 5 aa, synthetic construct
  REGION 1..5: note = Synthetic Construct
KRPRK

SEQ ID NO: 5672 - protein, 5 aa, synthetic construct
  REGION 1..5: note = Synthetic Construct
KRPSK

SEQ ID NO: 5673 - protein, 5 aa, synthetic construct
  REGION 1..5: note = Synthetic Construct
KRPTK

SEQ ID NO: 5674 - protein, 5 aa, synthetic construct
  REGION 1..5: note = Synthetic Construct
KRPYK

SEQ ID NO: 5675 - protein, 5 aa, synthetic construct
  REGION 1..5: note = Synthetic Construct
KRQAK

SEQ ID NO: 5676 - protein, 5 aa, synthetic construct
  REGION 1..5: note = Synthetic Construct
KRQDK

SEQ ID NO: 5677 - protein, 5 aa, synthetic construct
  REGION 1..5: note = Synthetic Construct
KRQEK

SEQ ID NO: 5678 - protein, 5 aa, synthetic construct
  REGION 1..5: note = Synthetic Construct
KRQFK

SEQ ID NO: 5679 - protein, 5 aa, synthetic construct
  REGION 1..5: note = Synthetic Construct
KRQGK

SEQ ID NO: 5680 - protein, 5 aa, synthetic construct
  REGION 1..5: note = Synthetic Construct
KRQHK

SEQ ID NO: 5681 - protein, 5 aa, synthetic construct
  REGION 1..5: note = Synthetic Construct
KRQIK

SEQ ID NO: 5682 - protein, 5 aa, synthetic construct
  REGION 1..5: note = Synthetic Construct
KRQLK

SEQ ID NO: 5683 - protein, 5 aa, synthetic construct
  REGION 1..5: note = Synthetic Construct
KRQNK

SEQ ID NO: 5684 - protein, 5 aa, synthetic construct
  REGION 1..5: note = Synthetic Construct
KRQQK

SEQ ID NO: 5685 - protein, 5 aa, synthetic construct
  REGION 1..5: note = Synthetic Construct
KRQRK

SEQ ID NO: 5686 - protein, 5 aa, synthetic construct
  REGION 1..5: note = Synthetic Construct
KRQSK

SEQ ID NO: 5687 - protein, 5 aa, synthetic construct
  REGION 1..5: note = Synthetic Construct
KRQTK

SEQ ID NO: 5688 - protein, 5 aa, synthetic construct
  REGION 1..5: note = Synthetic Construct
KRQYK

SEQ ID NO: 5689 - protein, 5 aa, synthetic construct
  REGION 1..5: note = Synthetic Construct
KRRAK

SEQ ID NO: 5690 - protein, 5 aa, synthetic construct
  REGION 1..5: note = Synthetic Construct
KRRDK

SEQ ID NO: 5691 - protein, 5 aa, synthetic construct
  REGION 1..5: note = Synthetic Construct
KRREK

SEQ ID NO: 5692 - protein, 5 aa, synthetic construct
  REGION 1..5: note = Synthetic Construct
KRRFK

SEQ ID NO: 5693 - protein, 5 aa, synthetic construct
  REGION 1..5: note = Synthetic Construct
KRRGK

SEQ ID NO: 5694 - protein, 5 aa, synthetic construct
  REGION 1..5: note = Synthetic Construct
KRRHK

SEQ ID NO: 5695 - protein, 5 aa, synthetic construct
  REGION 1..5: note = Synthetic Construct
KRRIK

SEQ ID NO: 5696 - protein, 5 aa, synthetic construct
  REGION 1..5: note = Synthetic Construct
KRRLK

SEQ ID NO: 5697 - protein, 5 aa, synthetic construct
  REGION 1..5: note = Synthetic Construct
KRRNK

SEQ ID NO: 5698 - protein, 5 aa, synthetic construct
  REGION 1..5: note = Synthetic Construct
KRRQK

SEQ ID NO: 5699 - protein, 5 aa, synthetic construct
  REGION 1..5: note = Synthetic Construct
KRRRK

SEQ ID NO: 5700 - protein, 5 aa, synthetic construct
  REGION 1..5: note = Synthetic Construct
KRRSK

SEQ ID NO: 5701 - protein, 5 aa, synthetic construct
  REGION 1..5: note = Synthetic Construct
KRRTK

SEQ ID NO: 5702 - protein, 5 aa, synthetic construct
  REGION 1..5: note = Synthetic Construct
KRRYK

SEQ ID NO: 5703 - protein, 5 aa, synthetic construct
  REGION 1..5: note = Synthetic Construct
KRSAK

SEQ ID NO: 5704 - protein, 5 aa, synthetic construct
  REGION 1..5: note = Synthetic Construct
KRSDK

SEQ ID NO: 5705 - protein, 5 aa, synthetic construct
  REGION 1..5: note = Synthetic Construct
KRSEK

SEQ ID NO: 5706 - protein, 5 aa, synthetic construct
  REGION 1..5: note = Synthetic Construct
KRSFK

SEQ ID NO: 5707 - protein, 5 aa, synthetic construct
  REGION 1..5: note = Synthetic Construct
KRSGK

SEQ ID NO: 5708 - protein, 5 aa, synthetic construct
  REGION 1..5: note = Synthetic Construct
KRSHK

SEQ ID NO: 5709 - protein, 5 aa, synthetic construct
  REGION 1..5: note = Synthetic Construct
KRSIK

SEQ ID NO: 5710 - protein, 5 aa, synthetic construct
  REGION 1..5: note = Synthetic Construct
KRSLK

SEQ ID NO: 5711 - protein, 5 aa, synthetic construct
  REGION 1..5: note = Synthetic Construct
KRSNK

SEQ ID NO: 5712 - protein, 5 aa, synthetic construct
  REGION 1..5: note = Synthetic Construct
KRSQK

SEQ ID NO: 5713 - protein, 5 aa, synthetic construct
  REGION 1..5: note = Synthetic Construct
KRSRK

SEQ ID NO: 5714 - protein, 5 aa, synthetic construct
  REGION 1..5: note = Synthetic Construct
KRSSK

SEQ ID NO: 5715 - protein, 5 aa, synthetic construct
  REGION 1..5: note = Synthetic Construct
KRSTK

SEQ ID NO: 5716 - protein, 5 aa, synthetic construct
  REGION 1..5: note = Synthetic Construct
KRSYK

SEQ ID NO: 5717 - protein, 5 aa, synthetic construct
  REGION 1..5: note = Synthetic Construct
KRTAK

SEQ ID NO: 5718 - protein, 5 aa, synthetic construct
  REGION 1..5: note = Synthetic Construct
KRTDK

SEQ ID NO: 5719 - protein, 5 aa, synthetic construct
  REGION 1..5: note = Synthetic Construct
KRTEK

SEQ ID NO: 5720 - protein, 5 aa, synthetic construct
  REGION 1..5: note = Synthetic Construct
KRTFK

SEQ ID NO: 5721 - protein, 5 aa, synthetic construct
  REGION 1..5: note = Synthetic Construct
KRTGK

SEQ ID NO: 5722 - protein, 5 aa, synthetic construct
  REGION 1..5: note = Synthetic Construct
KRTHK

SEQ ID NO: 5723 - protein, 5 aa, synthetic construct
  REGION 1..5: note = Synthetic Construct
KRTIK

SEQ ID NO: 5724 - protein, 5 aa, synthetic construct
  REGION 1..5: note = Synthetic Construct
KRTLK

SEQ ID NO: 5725 - protein, 5 aa, synthetic construct
  REGION 1..5: note = Synthetic Construct
KRTNK

SEQ ID NO: 5726 - protein, 5 aa, synthetic construct
  REGION 1..5: note = Synthetic Construct
KRTQK

SEQ ID NO: 5727 - protein, 5 aa, synthetic construct
  REGION 1..5: note = Synthetic Construct
KRTRK

SEQ ID NO: 5728 - protein, 5 aa, synthetic construct
  REGION 1..5: note = Synthetic Construct
KRTSK

SEQ ID NO: 5729 - protein, 5 aa, synthetic construct
  REGION 1..5: note = Synthetic Construct
KRTTK

SEQ ID NO: 5730 - protein, 5 aa, synthetic construct
  REGION 1..5: note = Synthetic Construct
KRTYK

SEQ ID NO: 5731 - protein, 5 aa, synthetic construct
  REGION 1..5: note = Synthetic Construct
KRYAK

SEQ ID NO: 5732 - protein, 5 aa, synthetic construct
  REGION 1..5: note = Synthetic Construct
KRYDK

SEQ ID NO: 5733 - protein, 5 aa, synthetic construct
  REGION 1..5: note = Synthetic Construct
KRYEK

SEQ ID NO: 5734 - protein, 5 aa, synthetic construct
  REGION 1..5: note = Synthetic Construct
KRYFK

SEQ ID NO: 5735 - protein, 5 aa, synthetic construct
  REGION 1..5: note = Synthetic Construct
KRYGK

SEQ ID NO: 5736 - protein, 5 aa, synthetic construct
  REGION 1..5: note = Synthetic Construct
KRYHK

SEQ ID NO: 5737 - protein, 5 aa, synthetic construct
  REGION 1..5: note = Synthetic Construct
KRYIK

SEQ ID NO: 5738 - protein, 5 aa, synthetic construct
  REGION 1..5: note = Synthetic Construct
KRYLK

SEQ ID NO: 5739 - protein, 5 aa, synthetic construct
  REGION 1..5: note = Synthetic Construct
KRYNK

SEQ ID NO: 5740 - protein, 5 aa, synthetic construct
  REGION 1..5: note = Synthetic Construct
KRYQK

SEQ ID NO: 5741 - protein, 5 aa, synthetic construct
  REGION 1..5: note = Synthetic Construct
KRYRK

SEQ ID NO: 5742 - protein, 5 aa, synthetic construct
  REGION 1..5: note = Synthetic Construct
KRYSK

SEQ ID NO: 5743 - protein, 5 aa, synthetic construct
  REGION 1..5: note = Synthetic Construct
KRYTK

SEQ ID NO: 5744 - protein, 5 aa, synthetic construct
  REGION 1..5: note = Synthetic Construct
KRYYK

SEQ ID NO: 5745 - protein, 5 aa, synthetic construct
  REGION 1..5: note = Synthetic Construct
KSAAK

SEQ ID NO: 5746 - protein, 5 aa, synthetic construct
  REGION 1..5: note = Synthetic Construct
KSADK

SEQ ID NO: 5747 - protein, 5 aa, synthetic construct
  REGION 1..5: note = Synthetic Construct
KSAEK

SEQ ID NO: 5748 - protein, 5 aa, synthetic construct
  REGION 1..5: note = Synthetic Construct
KSAFK

SEQ ID NO: 5749 - protein, 5 aa, synthetic construct
  REGION 1..5: note = Synthetic Construct
KSAGK

SEQ ID NO: 5750 - protein, 5 aa, synthetic construct
  REGION 1..5: note = Synthetic Construct
KSAHK

SEQ ID NO: 5751 - protein, 5 aa, synthetic construct
  REGION 1..5: note = Synthetic Construct
KSAIK

SEQ ID NO: 5752 - protein, 5 aa, synthetic construct
  REGION 1..5: note = Synthetic Construct
KSALK

SEQ ID NO: 5753 - protein, 5 aa, synthetic construct
  REGION 1..5: note = Synthetic Construct
KSANK

SEQ ID NO: 5754 - protein, 5 aa, synthetic construct
  REGION 1..5: note = Synthetic Construct
KSAQK

SEQ ID NO: 5755 - protein, 5 aa, synthetic construct
  REGION 1..5: note = Synthetic Construct
KSARK

SEQ ID NO: 5756 - protein, 5 aa, synthetic construct
  REGION 1..5: note = Synthetic Construct
KSASK

SEQ ID NO: 5757 - protein, 5 aa, synthetic construct
  REGION 1..5: note = Synthetic Construct
KSATK

SEQ ID NO: 5758 - protein, 5 aa, synthetic construct
  REGION 1..5: note = Synthetic Construct
KSAYK

SEQ ID NO: 5759 - protein, 5 aa, synthetic construct
  REGION 1..5: note = Synthetic Construct
KSDAK

SEQ ID NO: 5760 - protein, 5 aa, synthetic construct
  REGION 1..5: note = Synthetic Construct
KSDDK

SEQ ID NO: 5761 - protein, 5 aa, synthetic construct
  REGION 1..5: note = Synthetic Construct
KSDEK

SEQ ID NO: 5762 - protein, 5 aa, synthetic construct
  REGION 1..5: note = Synthetic Construct
KSDFK

SEQ ID NO: 5763 - protein, 5 aa, synthetic construct
  REGION 1..5: note = Synthetic Construct
KSDGK

SEQ ID NO: 5764 - protein, 5 aa, synthetic construct
  REGION 1..5: note = Synthetic Construct
KSDHK

SEQ ID NO: 5765 - protein, 5 aa, synthetic construct
  REGION 1..5: note = Synthetic Construct
KSDIK

SEQ ID NO: 5766 - protein, 5 aa, synthetic construct
  REGION 1..5: note = Synthetic Construct
KSDLK

SEQ ID NO: 5767 - protein, 5 aa, synthetic construct
  REGION 1..5: note = Synthetic Construct
KSDNK

SEQ ID NO: 5768 - protein, 5 aa, synthetic construct
  REGION 1..5: note = Synthetic Construct
KSDQK

SEQ ID NO: 5769 - protein, 5 aa, synthetic construct
  REGION 1..5: note = Synthetic Construct
KSDRK

SEQ ID NO: 5770 - protein, 5 aa, synthetic construct
  REGION 1..5: note = Synthetic Construct
KSDSK

SEQ ID NO: 5771 - protein, 5 aa, synthetic construct
  REGION 1..5: note = Synthetic Construct
KSDTK

SEQ ID NO: 5772 - protein, 5 aa, synthetic construct
  REGION 1..5: note = Synthetic Construct
KSDYK

SEQ ID NO: 5773 - protein, 5 aa, synthetic construct
  REGION 1..5: note = Synthetic Construct
KSEAK

SEQ ID NO: 5774 - protein, 5 aa, synthetic construct
  REGION 1..5: note = Synthetic Construct
KSEDK

SEQ ID NO: 5775 - protein, 5 aa, synthetic construct
  REGION 1..5: note = Synthetic Construct
KSEEK

SEQ ID NO: 5776 - protein, 5 aa, synthetic construct
  REGION 1..5: note = Synthetic Construct
KSEFK

SEQ ID NO: 5777 - protein, 5 aa, synthetic construct
  REGION 1..5: note = Synthetic Construct
KSEGK

SEQ ID NO: 5778 - protein, 5 aa, synthetic construct
  REGION 1..5: note = Synthetic Construct
KSEHK

SEQ ID NO: 5779 - protein, 5 aa, synthetic construct
  REGION 1..5: note = Synthetic Construct
KSEIK

SEQ ID NO: 5780 - protein, 5 aa, synthetic construct
  REGION 1..5: note = Synthetic Construct
KSELK

SEQ ID NO: 5781 - protein, 5 aa, synthetic construct
  REGION 1..5: note = Synthetic Construct
KSENK

SEQ ID NO: 5782 - protein, 5 aa, synthetic construct
  REGION 1..5: note = Synthetic Construct
KSEQK

SEQ ID NO: 5783 - protein, 5 aa, synthetic construct
  REGION 1..5: note = Synthetic Construct
KSERK

SEQ ID NO: 5784 - protein, 5 aa, synthetic construct
  REGION 1..5: note = Synthetic Construct
KSESK

SEQ ID NO: 5785 - protein, 5 aa, synthetic construct
  REGION 1..5: note = Synthetic Construct
KSETK

SEQ ID NO: 5786 - protein, 5 aa, synthetic construct
  REGION 1..5: note = Synthetic Construct
KSEYK

SEQ ID NO: 5787 - protein, 5 aa, synthetic construct
  REGION 1..5: note = Synthetic Construct
KSFAK

SEQ ID NO: 5788 - protein, 5 aa, synthetic construct
  REGION 1..5: note = Synthetic Construct
KSFDK

SEQ ID NO: 5789 - protein, 5 aa, synthetic construct
  REGION 1..5: note = Synthetic Construct
KSFEK

SEQ ID NO: 5790 - protein, 5 aa, synthetic construct
  REGION 1..5: note = Synthetic Construct
KSFFK

SEQ ID NO: 5791 - protein, 5 aa, synthetic construct
  REGION 1..5: note = Synthetic Construct
KSFGK

SEQ ID NO: 5792 - protein, 5 aa, synthetic construct
  REGION 1..5: note = Synthetic Construct
KSFHK

SEQ ID NO: 5793 - protein, 5 aa, synthetic construct
  REGION 1..5: note = Synthetic Construct
KSFIK

SEQ ID NO: 5794 - protein, 5 aa, synthetic construct
  REGION 1..5: note = Synthetic Construct
KSFLK

SEQ ID NO: 5795 - protein, 5 aa, synthetic construct
  REGION 1..5: note = Synthetic Construct
KSFNK

SEQ ID NO: 5796 - protein, 5 aa, synthetic construct
  REGION 1..5: note = Synthetic Construct
KSFQK

SEQ ID NO: 5797 - protein, 5 aa, synthetic construct
  REGION 1..5: note = Synthetic Construct
KSFRK

SEQ ID NO: 5798 - protein, 5 aa, synthetic construct
  REGION 1..5: note = Synthetic Construct
KSFSK

SEQ ID NO: 5799 - protein, 5 aa, synthetic construct
  REGION 1..5: note = Synthetic Construct
KSFTK

SEQ ID NO: 5800 - protein, 5 aa, synthetic construct
  REGION 1..5: note = Synthetic Construct
KSFYK

SEQ ID NO: 5801 - protein, 5 aa, synthetic construct
  REGION 1..5: note = Synthetic Construct
KSGAK

SEQ ID NO: 5802 - protein, 5 aa, synthetic construct
  REGION 1..5: note = Synthetic Construct
KSGDK

SEQ ID NO: 5803 - protein, 5 aa, synthetic construct
  REGION 1..5: note = Synthetic Construct
KSGEK

SEQ ID NO: 5804 - protein, 5 aa, synthetic construct
  REGION 1..5: note = Synthetic Construct
KSGFK

SEQ ID NO: 5805 - protein, 5 aa, synthetic construct
  REGION 1..5: note = Synthetic Construct
KSGGK

SEQ ID NO: 5806 - protein, 5 aa, synthetic construct
  REGION 1..5: note = Synthetic Construct
KSGHK

SEQ ID NO: 5807 - protein, 5 aa, synthetic construct
  REGION 1..5: note = Synthetic Construct
KSGIK

SEQ ID NO: 5808 - protein, 5 aa, synthetic construct
  REGION 1..5: note = Synthetic Construct
KSGLK

SEQ ID NO: 5809 - protein, 5 aa, synthetic construct
  REGION 1..5: note = Synthetic Construct
KSGNK

SEQ ID NO: 5810 - protein, 5 aa, synthetic construct
  REGION 1..5: note = Synthetic Construct
KSGQK

SEQ ID NO: 5811 - protein, 5 aa, synthetic construct
  REGION 1..5: note = Synthetic Construct
KSGRK

SEQ ID NO: 5812 - protein, 5 aa, synthetic construct
  REGION 1..5: note = Synthetic Construct
KSGSK

SEQ ID NO: 5813 - protein, 5 aa, synthetic construct
  REGION 1..5: note = Synthetic Construct
KSGTK

SEQ ID NO: 5814 - protein, 5 aa, synthetic construct
  REGION 1..5: note = Synthetic Construct
KSGYK

SEQ ID NO: 5815 - protein, 5 aa, synthetic construct
  REGION 1..5: note = Synthetic Construct
KSHAK

SEQ ID NO: 5816 - protein, 5 aa, synthetic construct
  REGION 1..5: note = Synthetic Construct
KSHDK

SEQ ID NO: 5817 - protein, 5 aa, synthetic construct
  REGION 1..5: note = Synthetic Construct
KSHEK

SEQ ID NO: 5818 - protein, 5 aa, synthetic construct
  REGION 1..5: note = Synthetic Construct
KSHFK

SEQ ID NO: 5819 - protein, 5 aa, synthetic construct
  REGION 1..5: note = Synthetic Construct
KSHGK

SEQ ID NO: 5820 - protein, 5 aa, synthetic construct
  REGION 1..5: note = Synthetic Construct
KSHHK

SEQ ID NO: 5821 - protein, 5 aa, synthetic construct
  REGION 1..5: note = Synthetic Construct
KSHIK

SEQ ID NO: 5822 - protein, 5 aa, synthetic construct
  REGION 1..5: note = Synthetic Construct
KSHLK

SEQ ID NO: 5823 - protein, 5 aa, synthetic construct
  REGION 1..5: note = Synthetic Construct
KSHNK

SEQ ID NO: 5824 - protein, 5 aa, synthetic construct
  REGION 1..5: note = Synthetic Construct
KSHQK

SEQ ID NO: 5825 - protein, 5 aa, synthetic construct
  REGION 1..5: note = Synthetic Construct
KSHRK

SEQ ID NO: 5826 - protein, 5 aa, synthetic construct
  REGION 1..5: note = Synthetic Construct
KSHSK

SEQ ID NO: 5827 - protein, 5 aa, synthetic construct
  REGION 1..5: note = Synthetic Construct
KSHTK

SEQ ID NO: 5828 - protein, 5 aa, synthetic construct
  REGION 1..5: note = Synthetic Construct
KSHYK

SEQ ID NO: 5829 - protein, 5 aa, synthetic construct
  REGION 1..5: note = Synthetic Construct
KSIAK

SEQ ID NO: 5830 - protein, 5 aa, synthetic construct
  REGION 1..5: note = Synthetic Construct
KSIDK

SEQ ID NO: 5831 - protein, 5 aa, synthetic construct
  REGION 1..5: note = Synthetic Construct
KSIEK

SEQ ID NO: 5832 - protein, 5 aa, synthetic construct
  REGION 1..5: note = Synthetic Construct
KSIFK

SEQ ID NO: 5833 - protein, 5 aa, synthetic construct
  REGION 1..5: note = Synthetic Construct
KSIGK

SEQ ID NO: 5834 - protein, 5 aa, synthetic construct
  REGION 1..5: note = Synthetic Construct
KSIHK

SEQ ID NO: 5835 - protein, 5 aa, synthetic construct
  REGION 1..5: note = Synthetic Construct
KSIIK

SEQ ID NO: 5836 - protein, 5 aa, synthetic construct
  REGION 1..5: note = Synthetic Construct
KSILK

SEQ ID NO: 5837 - protein, 5 aa, synthetic construct
  REGION 1..5: note = Synthetic Construct
KSINK

SEQ ID NO: 5838 - protein, 5 aa, synthetic construct
  REGION 1..5: note = Synthetic Construct
KSIQK

SEQ ID NO: 5839 - protein, 5 aa, synthetic construct
  REGION 1..5: note = Synthetic Construct
KSIRK

SEQ ID NO: 5840 - protein, 5 aa, synthetic construct
  REGION 1..5: note = Synthetic Construct
KSISK

SEQ ID NO: 5841 - protein, 5 aa, synthetic construct
  REGION 1..5: note = Synthetic Construct
KSITK

SEQ ID NO: 5842 - protein, 5 aa, synthetic construct
  REGION 1..5: note = Synthetic Construct
KSIYK

SEQ ID NO: 5843 - protein, 5 aa, synthetic construct
  REGION 1..5: note = Synthetic Construct
KSLAK

SEQ ID NO: 5844 - protein, 5 aa, synthetic construct
  REGION 1..5: note = Synthetic Construct
KSLDK

SEQ ID NO: 5845 - protein, 5 aa, synthetic construct
  REGION 1..5: note = Synthetic Construct
KSLEK

SEQ ID NO: 5846 - protein, 5 aa, synthetic construct
  REGION 1..5: note = Synthetic Construct
KSLFK

SEQ ID NO: 5847 - protein, 5 aa, synthetic construct
  REGION 1..5: note = Synthetic Construct
KSLGK

SEQ ID NO: 5848 - protein, 5 aa, synthetic construct
  REGION 1..5: note = Synthetic Construct
KSLHK

SEQ ID NO: 5849 - protein, 5 aa, synthetic construct
  REGION 1..5: note = Synthetic Construct
KSLIK

SEQ ID NO: 5850 - protein, 5 aa, synthetic construct
  REGION 1..5: note = Synthetic Construct
KSLLK

SEQ ID NO: 5851 - protein, 5 aa, synthetic construct
  REGION 1..5: note = Synthetic Construct
KSLNK

SEQ ID NO: 5852 - protein, 5 aa, synthetic construct
  REGION 1..5: note = Synthetic Construct
KSLQK

SEQ ID NO: 5853 - protein, 5 aa, synthetic construct
  REGION 1..5: note = Synthetic Construct
KSLRK

SEQ ID NO: 5854 - protein, 5 aa, synthetic construct
  REGION 1..5: note = Synthetic Construct
KSLSK

SEQ ID NO: 5855 - protein, 5 aa, synthetic construct
  REGION 1..5: note = Synthetic Construct
KSLTK

SEQ ID NO: 5856 - protein, 5 aa, synthetic construct
  REGION 1..5: note = Synthetic Construct
KSLYK

SEQ ID NO: 5857 - protein, 5 aa, synthetic construct
  REGION 1..5: note = Synthetic Construct
KSNAK

SEQ ID NO: 5858 - protein, 5 aa, synthetic construct
  REGION 1..5: note = Synthetic Construct
KSNDK

SEQ ID NO: 5859 - protein, 5 aa, synthetic construct
  REGION 1..5: note = Synthetic Construct
KSNEK

SEQ ID NO: 5860 - protein, 5 aa, synthetic construct
  REGION 1..5: note = Synthetic Construct
KSNFK

SEQ ID NO: 5861 - protein, 5 aa, synthetic construct
  REGION 1..5: note = Synthetic Construct
KSNGK

SEQ ID NO: 5862 - protein, 5 aa, synthetic construct
  REGION 1..5: note = Synthetic Construct
KSNHK

SEQ ID NO: 5863 - protein, 5 aa, synthetic construct
  REGION 1..5: note = Synthetic Construct
KSNIK

SEQ ID NO: 5864 - protein, 5 aa, synthetic construct
  REGION 1..5: note = Synthetic Construct
KSNLK

SEQ ID NO: 5865 - protein, 5 aa, synthetic construct
  REGION 1..5: note = Synthetic Construct
KSNNK

SEQ ID NO: 5866 - protein, 5 aa, synthetic construct
  REGION 1..5: note = Synthetic Construct
KSNQK

SEQ ID NO: 5867 - protein, 5 aa, synthetic construct
  REGION 1..5: note = Synthetic Construct
KSNRK

SEQ ID NO: 5868 - protein, 5 aa, synthetic construct
  REGION 1..5: note = Synthetic Construct
KSNSK

SEQ ID NO: 5869 - protein, 5 aa, synthetic construct
  REGION 1..5: note = Synthetic Construct
KSNTK

SEQ ID NO: 5870 - protein, 5 aa, synthetic construct
  REGION 1..5: note = Synthetic Construct
KSNYK

SEQ ID NO: 5871 - protein, 5 aa, synthetic construct
  REGION 1..5: note = Synthetic Construct
KSPAK

SEQ ID NO: 5872 - protein, 5 aa, synthetic construct
  REGION 1..5: note = Synthetic Construct
KSPDK

SEQ ID NO: 5873 - protein, 5 aa, synthetic construct
  REGION 1..5: note = Synthetic Construct
KSPEK

SEQ ID NO: 5874 - protein, 5 aa, synthetic construct
  REGION 1..5: note = Synthetic Construct
KSPFK

SEQ ID NO: 5875 - protein, 5 aa, synthetic construct
  REGION 1..5: note = Synthetic Construct
KSPGK

SEQ ID NO: 5876 - protein, 5 aa, synthetic construct
  REGION 1..5: note = Synthetic Construct
KSPHK

SEQ ID NO: 5877 - protein, 5 aa, synthetic construct
  REGION 1..5: note = Synthetic Construct
KSPIK

SEQ ID NO: 5878 - protein, 5 aa, synthetic construct
  REGION 1..5: note = Synthetic Construct
KSPLK

SEQ ID NO: 5879 - protein, 5 aa, synthetic construct
  REGION 1..5: note = Synthetic Construct
KSPNK

SEQ ID NO: 5880 - protein, 5 aa, synthetic construct
  REGION 1..5: note = Synthetic Construct
KSPQK

SEQ ID NO: 5881 - protein, 5 aa, synthetic construct
  REGION 1..5: note = Synthetic Construct
KSPRK

SEQ ID NO: 5882 - protein, 5 aa, synthetic construct
  REGION 1..5: note = Synthetic Construct
KSPSK

SEQ ID NO: 5883 - protein, 5 aa, synthetic construct
  REGION 1..5: note = Synthetic Construct
KSPTK

SEQ ID NO: 5884 - protein, 5 aa, synthetic construct
  REGION 1..5: note = Synthetic Construct
KSPYK

SEQ ID NO: 5885 - protein, 5 aa, synthetic construct
  REGION 1..5: note = Synthetic Construct
KSQAK

SEQ ID NO: 5886 - protein, 5 aa, synthetic construct
  REGION 1..5: note = Synthetic Construct
KSQDK

SEQ ID NO: 5887 - protein, 5 aa, synthetic construct
  REGION 1..5: note = Synthetic Construct
KSQEK

SEQ ID NO: 5888 - protein, 5 aa, synthetic construct
  REGION 1..5: note = Synthetic Construct
KSQFK

SEQ ID NO: 5889 - protein, 5 aa, synthetic construct
  REGION 1..5: note = Synthetic Construct
KSQGK

SEQ ID NO: 5890 - protein, 5 aa, synthetic construct
  REGION 1..5: note = Synthetic Construct
KSQHK

SEQ ID NO: 5891 - protein, 5 aa, synthetic construct
  REGION 1..5: note = Synthetic Construct
KSQIK

SEQ ID NO: 5892 - protein, 5 aa, synthetic construct
  REGION 1..5: note = Synthetic Construct
KSQLK

SEQ ID NO: 5893 - protein, 5 aa, synthetic construct
  REGION 1..5: note = Synthetic Construct
KSQNK

SEQ ID NO: 5894 - protein, 5 aa, synthetic construct
  REGION 1..5: note = Synthetic Construct
KSQQK

SEQ ID NO: 5895 - protein, 5 aa, synthetic construct
  REGION 1..5: note = Synthetic Construct
KSQRK

SEQ ID NO: 5896 - protein, 5 aa, synthetic construct
  REGION 1..5: note = Synthetic Construct
KSQSK

SEQ ID NO: 5897 - protein, 5 aa, synthetic construct
  REGION 1..5: note = Synthetic Construct
KSQTK

SEQ ID NO: 5898 - protein, 5 aa, synthetic construct
  REGION 1..5: note = Synthetic Construct
KSQYK

SEQ ID NO: 5899 - protein, 5 aa, synthetic construct
  REGION 1..5: note = Synthetic Construct
KSRAK

SEQ ID NO: 5900 - protein, 5 aa, synthetic construct
  REGION 1..5: note = Synthetic Construct
KSRDK

SEQ ID NO: 5901 - protein, 5 aa, synthetic construct
  REGION 1..5: note = Synthetic Construct
KSREK

SEQ ID NO: 5902 - protein, 5 aa, synthetic construct
  REGION 1..5: note = Synthetic Construct
KSRFK

SEQ ID NO: 5903 - protein, 5 aa, synthetic construct
  REGION 1..5: note = Synthetic Construct
KSRGK

SEQ ID NO: 5904 - protein, 5 aa, synthetic construct
  REGION 1..5: note = Synthetic Construct
KSRHK

SEQ ID NO: 5905 - protein, 5 aa, synthetic construct
  REGION 1..5: note = Synthetic Construct
KSRIK

SEQ ID NO: 5906 - protein, 5 aa, synthetic construct
  REGION 1..5: note = Synthetic Construct
KSRLK

SEQ ID NO: 5907 - protein, 5 aa, synthetic construct
  REGION 1..5: note = Synthetic Construct
KSRNK

SEQ ID NO: 5908 - protein, 5 aa, synthetic construct
  REGION 1..5: note = Synthetic Construct
KSRQK

SEQ ID NO: 5909 - protein, 5 aa, synthetic construct
  REGION 1..5: note = Synthetic Construct
KSRRK

SEQ ID NO: 5910 - protein, 5 aa, synthetic construct
  REGION 1..5: note = Synthetic Construct
KSRSK

SEQ ID NO: 5911 - protein, 5 aa, synthetic construct
  REGION 1..5: note = Synthetic Construct
KSRTK

SEQ ID NO: 5912 - protein, 5 aa, synthetic construct
  REGION 1..5: note = Synthetic Construct
KSRYK

SEQ ID NO: 5913 - protein, 5 aa, synthetic construct
  REGION 1..5: note = Synthetic Construct
KSSAK

SEQ ID NO: 5914 - protein, 5 aa, synthetic construct
  REGION 1..5: note = Synthetic Construct
KSSDK

SEQ ID NO: 5915 - protein, 5 aa, synthetic construct
  REGION 1..5: note = Synthetic Construct
KSSEK

SEQ ID NO: 5916 - protein, 5 aa, synthetic construct
  REGION 1..5: note = Synthetic Construct
KSSFK

SEQ ID NO: 5917 - protein, 5 aa, synthetic construct
  REGION 1..5: note = Synthetic Construct
KSSGK

SEQ ID NO: 5918 - protein, 5 aa, synthetic construct
  REGION 1..5: note = Synthetic Construct
KSSHK

SEQ ID NO: 5919 - protein, 5 aa, synthetic construct
  REGION 1..5: note = Synthetic Construct
KSSIK

SEQ ID NO: 5920 - protein, 5 aa, synthetic construct
  REGION 1..5: note = Synthetic Construct
KSSLK

SEQ ID NO: 5921 - protein, 5 aa, synthetic construct
  REGION 1..5: note = Synthetic Construct
KSSNK

SEQ ID NO: 5922 - protein, 5 aa, synthetic construct
  REGION 1..5: note = Synthetic Construct
KSSQK

SEQ ID NO: 5923 - protein, 5 aa, synthetic construct
  REGION 1..5: note = Synthetic Construct
KSSRK

SEQ ID NO: 5924 - protein, 5 aa, synthetic construct
  REGION 1..5: note = Synthetic Construct
KSSSK

SEQ ID NO: 5925 - protein, 5 aa, synthetic construct
  REGION 1..5: note = Synthetic Construct
KSSTK

SEQ ID NO: 5926 - protein, 5 aa, synthetic construct
  REGION 1..5: note = Synthetic Construct
KSSYK

SEQ ID NO: 5927 - protein, 5 aa, synthetic construct
  REGION 1..5: note = Synthetic Construct
KSTAK

SEQ ID NO: 5928 - protein, 5 aa, synthetic construct
  REGION 1..5: note = Synthetic Construct
KSTDK

SEQ ID NO: 5929 - protein, 5 aa, synthetic construct
  REGION 1..5: note = Synthetic Construct
KSTEK

SEQ ID NO: 5930 - protein, 5 aa, synthetic construct
  REGION 1..5: note = Synthetic Construct
KSTFK

SEQ ID NO: 5931 - protein, 5 aa, synthetic construct
  REGION 1..5: note = Synthetic Construct
KSTGK

SEQ ID NO: 5932 - protein, 5 aa, synthetic construct
  REGION 1..5: note = Synthetic Construct
KSTHK

SEQ ID NO: 5933 - protein, 5 aa, synthetic construct
  REGION 1..5: note = Synthetic Construct
KSTIK

SEQ ID NO: 5934 - protein, 5 aa, synthetic construct
  REGION 1..5: note = Synthetic Construct
KSTLK

SEQ ID NO: 5935 - protein, 5 aa, synthetic construct
  REGION 1..5: note = Synthetic Construct
KSTNK

SEQ ID NO: 5936 - protein, 5 aa, synthetic construct
  REGION 1..5: note = Synthetic Construct
KSTQK

SEQ ID NO: 5937 - protein, 5 aa, synthetic construct
  REGION 1..5: note = Synthetic Construct
KSTRK

SEQ ID NO: 5938 - protein, 5 aa, synthetic construct
  REGION 1..5: note = Synthetic Construct
KSTSK

SEQ ID NO: 5939 - protein, 5 aa, synthetic construct
  REGION 1..5: note = Synthetic Construct
KSTTK

SEQ ID NO: 5940 - protein, 5 aa, synthetic construct
  REGION 1..5: note = Synthetic Construct
KSTYK

SEQ ID NO: 5941 - protein, 5 aa, synthetic construct
  REGION 1..5: note = Synthetic Construct
KSYAK

SEQ ID NO: 5942 - protein, 5 aa, synthetic construct
  REGION 1..5: note = Synthetic Construct
KSYDK

SEQ ID NO: 5943 - protein, 5 aa, synthetic construct
  REGION 1..5: note = Synthetic Construct
KSYEK

SEQ ID NO: 5944 - protein, 5 aa, synthetic construct
  REGION 1..5: note = Synthetic Construct
KSYFK

SEQ ID NO: 5945 - protein, 5 aa, synthetic construct
  REGION 1..5: note = Synthetic Construct
KSYGK

SEQ ID NO: 5946 - protein, 5 aa, synthetic construct
  REGION 1..5: note = Synthetic Construct
KSYHK

SEQ ID NO: 5947 - protein, 5 aa, synthetic construct
  REGION 1..5: note = Synthetic Construct
KSYIK

SEQ ID NO: 5948 - protein, 5 aa, synthetic construct
  REGION 1..5: note = Synthetic Construct
KSYLK

SEQ ID NO: 5949 - protein, 5 aa, synthetic construct
  REGION 1..5: note = Synthetic Construct
KSYNK

SEQ ID NO: 5950 - protein, 5 aa, synthetic construct
  REGION 1..5: note = Synthetic Construct
KSYQK

SEQ ID NO: 5951 - protein, 5 aa, synthetic construct
  REGION 1..5: note = Synthetic Construct
KSYRK

SEQ ID NO: 5952 - protein, 5 aa, synthetic construct
  REGION 1..5: note = Synthetic Construct
KSYSK

SEQ ID NO: 5953 - protein, 5 aa, synthetic construct
  REGION 1..5: note = Synthetic Construct
KSYTK

SEQ ID NO: 5954 - protein, 5 aa, synthetic construct
  REGION 1..5: note = Synthetic Construct
KSYYK

SEQ ID NO: 5955 - protein, 5 aa, synthetic construct
  REGION 1..5: note = Synthetic Construct
KTAAK

SEQ ID NO: 5956 - protein, 5 aa, synthetic construct
  REGION 1..5: note = Synthetic Construct
KTADK

SEQ ID NO: 5957 - protein, 5 aa, synthetic construct
  REGION 1..5: note = Synthetic Construct
KTAEK

SEQ ID NO: 5958 - protein, 5 aa, synthetic construct
  REGION 1..5: note = Synthetic Construct
KTAFK

SEQ ID NO: 5959 - protein, 5 aa, synthetic construct
  REGION 1..5: note = Synthetic Construct
KTAGK

SEQ ID NO: 5960 - protein, 5 aa, synthetic construct
  REGION 1..5: note = Synthetic Construct
KTAHK

SEQ ID NO: 5961 - protein, 5 aa, synthetic construct
  REGION 1..5: note = Synthetic Construct
KTAIK

SEQ ID NO: 5962 - protein, 5 aa, synthetic construct
  REGION 1..5: note = Synthetic Construct
KTALK

SEQ ID NO: 5963 - protein, 5 aa, synthetic construct
  REGION 1..5: note = Synthetic Construct
KTANK

SEQ ID NO: 5964 - protein, 5 aa, synthetic construct
  REGION 1..5: note = Synthetic Construct
KTAQK

SEQ ID NO: 5965 - protein, 5 aa, synthetic construct
  REGION 1..5: note = Synthetic Construct
KTARK

SEQ ID NO: 5966 - protein, 5 aa, synthetic construct
  REGION 1..5: note = Synthetic Construct
KTASK

SEQ ID NO: 5967 - protein, 5 aa, synthetic construct
  REGION 1..5: note = Synthetic Construct
KTATK

SEQ ID NO: 5968 - protein, 5 aa, synthetic construct
  REGION 1..5: note = Synthetic Construct
KTAYK

SEQ ID NO: 5969 - protein, 5 aa, synthetic construct
  REGION 1..5: note = Synthetic Construct
KTDAK

SEQ ID NO: 5970 - protein, 5 aa, synthetic construct
  REGION 1..5: note = Synthetic Construct
KTDDK

SEQ ID NO: 5971 - protein, 5 aa, synthetic construct
  REGION 1..5: note = Synthetic Construct
KTDEK

SEQ ID NO: 5972 - protein, 5 aa, synthetic construct
  REGION 1..5: note = Synthetic Construct
KTDFK

SEQ ID NO: 5973 - protein, 5 aa, synthetic construct
  REGION 1..5: note = Synthetic Construct
KTDGK

SEQ ID NO: 5974 - protein, 5 aa, synthetic construct
  REGION 1..5: note = Synthetic Construct
KTDHK

SEQ ID NO: 5975 - protein, 5 aa, synthetic construct
  REGION 1..5: note = Synthetic Construct
KTDIK

SEQ ID NO: 5976 - protein, 5 aa, synthetic construct
  REGION 1..5: note = Synthetic Construct
KTDLK

SEQ ID NO: 5977 - protein, 5 aa, synthetic construct
  REGION 1..5: note = Synthetic Construct
KTDNK

SEQ ID NO: 5978 - protein, 5 aa, synthetic construct
  REGION 1..5: note = Synthetic Construct
KTDQK

SEQ ID NO: 5979 - protein, 5 aa, synthetic construct
  REGION 1..5: note = Synthetic Construct
KTDRK

SEQ ID NO: 5980 - protein, 5 aa, synthetic construct
  REGION 1..5: note = Synthetic Construct
KTDSK

SEQ ID NO: 5981 - protein, 5 aa, synthetic construct
  REGION 1..5: note = Synthetic Construct
KTDTK

SEQ ID NO: 5982 - protein, 5 aa, synthetic construct
  REGION 1..5: note = Synthetic Construct
KTDYK

SEQ ID NO: 5983 - protein, 5 aa, synthetic construct
  REGION 1..5: note = Synthetic Construct
KTEAK

SEQ ID NO: 5984 - protein, 5 aa, synthetic construct
  REGION 1..5: note = Synthetic Construct
KTEDK

SEQ ID NO: 5985 - protein, 5 aa, synthetic construct
  REGION 1..5: note = Synthetic Construct
KTEEK

SEQ ID NO: 5986 - protein, 5 aa, synthetic construct
  REGION 1..5: note = Synthetic Construct
KTEFK

SEQ ID NO: 5987 - protein, 5 aa, synthetic construct
  REGION 1..5: note = Synthetic Construct
KTEGK

SEQ ID NO: 5988 - protein, 5 aa, synthetic construct
  REGION 1..5: note = Synthetic Construct
KTEHK

SEQ ID NO: 5989 - protein, 5 aa, synthetic construct
  REGION 1..5: note = Synthetic Construct
KTEIK

SEQ ID NO: 5990 - protein, 5 aa, synthetic construct
  REGION 1..5: note = Synthetic Construct
KTELK

SEQ ID NO: 5991 - protein, 5 aa, synthetic construct
  REGION 1..5: note = Synthetic Construct
KTENK

SEQ ID NO: 5992 - protein, 5 aa, synthetic construct
  REGION 1..5: note = Synthetic Construct
KTEQK

SEQ ID NO: 5993 - protein, 5 aa, synthetic construct
  REGION 1..5: note = Synthetic Construct
KTERK

SEQ ID NO: 5994 - protein, 5 aa, synthetic construct
  REGION 1..5: note = Synthetic Construct
KTESK

SEQ ID NO: 5995 - protein, 5 aa, synthetic construct
  REGION 1..5: note = Synthetic Construct
KTETK

SEQ ID NO: 5996 - protein, 5 aa, synthetic construct
  REGION 1..5: note = Synthetic Construct
KTEYK

SEQ ID NO: 5997 - protein, 5 aa, synthetic construct
  REGION 1..5: note = Synthetic Construct
KTFAK

SEQ ID NO: 5998 - protein, 5 aa, synthetic construct
  REGION 1..5: note = Synthetic Construct
KTFDK

SEQ ID NO: 5999 - protein, 5 aa, synthetic construct
  REGION 1..5: note = Synthetic Construct
KTFEK

SEQ ID NO: 6000 - protein, 5 aa, synthetic construct
  REGION 1..5: note = Synthetic Construct
KTFFK

SEQ ID NO: 6001 - protein, 5 aa, synthetic construct
  REGION 1..5: note = Synthetic Construct
KTFGK

SEQ ID NO: 6002 - protein, 5 aa, synthetic construct
  REGION 1..5: note = Synthetic Construct
KTFHK

SEQ ID NO: 6003 - protein, 5 aa, synthetic construct
  REGION 1..5: note = Synthetic Construct
KTFIK

SEQ ID NO: 6004 - protein, 5 aa, synthetic construct
  REGION 1..5: note = Synthetic Construct
KTFLK

SEQ ID NO: 6005 - protein, 5 aa, synthetic construct
  REGION 1..5: note = Synthetic Construct
KTFNK

SEQ ID NO: 6006 - protein, 5 aa, synthetic construct
  REGION 1..5: note = Synthetic Construct
KTFQK

SEQ ID NO: 6007 - protein, 5 aa, synthetic construct
  REGION 1..5: note = Synthetic Construct
KTFRK

SEQ ID NO: 6008 - protein, 5 aa, synthetic construct
  REGION 1..5: note = Synthetic Construct
KTFSK

SEQ ID NO: 6009 - protein, 5 aa, synthetic construct
  REGION 1..5: note = Synthetic Construct
KTFTK

SEQ ID NO: 6010 - protein, 5 aa, synthetic construct
  REGION 1..5: note = Synthetic Construct
KTFYK

SEQ ID NO: 6011 - protein, 5 aa, synthetic construct
  REGION 1..5: note = Synthetic Construct
KTGAK

SEQ ID NO: 6012 - protein, 5 aa, synthetic construct
  REGION 1..5: note = Synthetic Construct
KTGDK

SEQ ID NO: 6013 - protein, 5 aa, synthetic construct
  REGION 1..5: note = Synthetic Construct
KTGEK

SEQ ID NO: 6014 - protein, 5 aa, synthetic construct
  REGION 1..5: note = Synthetic Construct
KTGFK

SEQ ID NO: 6015 - protein, 5 aa, synthetic construct
  REGION 1..5: note = Synthetic Construct
KTGGK

SEQ ID NO: 6016 - protein, 5 aa, synthetic construct
  REGION 1..5: note = Synthetic Construct
KTGHK

SEQ ID NO: 6017 - protein, 5 aa, synthetic construct
  REGION 1..5: note = Synthetic Construct
KTGIK

SEQ ID NO: 6018 - protein, 5 aa, synthetic construct
  REGION 1..5: note = Synthetic Construct
KTGLK

SEQ ID NO: 6019 - protein, 5 aa, synthetic construct
  REGION 1..5: note = Synthetic Construct
KTGNK

SEQ ID NO: 6020 - protein, 5 aa, synthetic construct
  REGION 1..5: note = Synthetic Construct
KTGQK

SEQ ID NO: 6021 - protein, 5 aa, synthetic construct
  REGION 1..5: note = Synthetic Construct
KTGRK

SEQ ID NO: 6022 - protein, 5 aa, synthetic construct
  REGION 1..5: note = Synthetic Construct
KTGSK

SEQ ID NO: 6023 - protein, 5 aa, synthetic construct
  REGION 1..5: note = Synthetic Construct
KTGTK

SEQ ID NO: 6024 - protein, 5 aa, synthetic construct
  REGION 1..5: note = Synthetic Construct
KTGYK

SEQ ID NO: 6025 - protein, 5 aa, synthetic construct
  REGION 1..5: note = Synthetic Construct
KTHAK

SEQ ID NO: 6026 - protein, 5 aa, synthetic construct
  REGION 1..5: note = Synthetic Construct
KTHDK

SEQ ID NO: 6027 - protein, 5 aa, synthetic construct
  REGION 1..5: note = Synthetic Construct
KTHEK

SEQ ID NO: 6028 - protein, 5 aa, synthetic construct
  REGION 1..5: note = Synthetic Construct
KTHFK

SEQ ID NO: 6029 - protein, 5 aa, synthetic construct
  REGION 1..5: note = Synthetic Construct
KTHGK

SEQ ID NO: 6030 - protein, 5 aa, synthetic construct
  REGION 1..5: note = Synthetic Construct
KTHHK

SEQ ID NO: 6031 - protein, 5 aa, synthetic construct
  REGION 1..5: note = Synthetic Construct
KTHIK

SEQ ID NO: 6032 - protein, 5 aa, synthetic construct
  REGION 1..5: note = Synthetic Construct
KTHLK

SEQ ID NO: 6033 - protein, 5 aa, synthetic construct
  REGION 1..5: note = Synthetic Construct
KTHNK

SEQ ID NO: 6034 - protein, 5 aa, synthetic construct
  REGION 1..5: note = Synthetic Construct
KTHQK

SEQ ID NO: 6035 - protein, 5 aa, synthetic construct
  REGION 1..5: note = Synthetic Construct
KTHRK

SEQ ID NO: 6036 - protein, 5 aa, synthetic construct
  REGION 1..5: note = Synthetic Construct
KTHSK

SEQ ID NO: 6037 - protein, 5 aa, synthetic construct
  REGION 1..5: note = Synthetic Construct
KTHTK

SEQ ID NO: 6038 - protein, 5 aa, synthetic construct
  REGION 1..5: note = Synthetic Construct
KTHYK

SEQ ID NO: 6039 - protein, 5 aa, synthetic construct
  REGION 1..5: note = Synthetic Construct
KTIAK

SEQ ID NO: 6040 - protein, 5 aa, synthetic construct
  REGION 1..5: note = Synthetic Construct
KTIDK

SEQ ID NO: 6041 - protein, 5 aa, synthetic construct
  REGION 1..5: note = Synthetic Construct
KTIEK

SEQ ID NO: 6042 - protein, 5 aa, synthetic construct
  REGION 1..5: note = Synthetic Construct
KTIFK

SEQ ID NO: 6043 - protein, 5 aa, synthetic construct
  REGION 1..5: note = Synthetic Construct
KTIGK

SEQ ID NO: 6044 - protein, 5 aa, synthetic construct
  REGION 1..5: note = Synthetic Construct
KTIHK

SEQ ID NO: 6045 - protein, 5 aa, synthetic construct
  REGION 1..5: note = Synthetic Construct
KTIIK

SEQ ID NO: 6046 - protein, 5 aa, synthetic construct
  REGION 1..5: note = Synthetic Construct
KTILK

SEQ ID NO: 6047 - protein, 5 aa, synthetic construct
  REGION 1..5: note = Synthetic Construct
KTINK

SEQ ID NO: 6048 - protein, 5 aa, synthetic construct
  REGION 1..5: note = Synthetic Construct
KTIQK

SEQ ID NO: 6049 - protein, 5 aa, synthetic construct
  REGION 1..5: note = Synthetic Construct
KTIRK

SEQ ID NO: 6050 - protein, 5 aa, synthetic construct
  REGION 1..5: note = Synthetic Construct
KTISK

SEQ ID NO: 6051 - protein, 5 aa, synthetic construct
  REGION 1..5: note = Synthetic Construct
KTITK

SEQ ID NO: 6052 - protein, 5 aa, synthetic construct
  REGION 1..5: note = Synthetic Construct
KTIYK

SEQ ID NO: 6053 - protein, 5 aa, synthetic construct
  REGION 1..5: note = Synthetic Construct
KTLAK

SEQ ID NO: 6054 - protein, 5 aa, synthetic construct
  REGION 1..5: note = Synthetic Construct
KTLDK

SEQ ID NO: 6055 - protein, 5 aa, synthetic construct
  REGION 1..5: note = Synthetic Construct
KTLEK

SEQ ID NO: 6056 - protein, 5 aa, synthetic construct
  REGION 1..5: note = Synthetic Construct
KTLFK

SEQ ID NO: 6057 - protein, 5 aa, synthetic construct
  REGION 1..5: note = Synthetic Construct
KTLGK

SEQ ID NO: 6058 - protein, 5 aa, synthetic construct
  REGION 1..5: note = Synthetic Construct
KTLHK

SEQ ID NO: 6059 - protein, 5 aa, synthetic construct
  REGION 1..5: note = Synthetic Construct
KTLIK

SEQ ID NO: 6060 - protein, 5 aa, synthetic construct
  REGION 1..5: note = Synthetic Construct
KTLLK

SEQ ID NO: 6061 - protein, 5 aa, synthetic construct
  REGION 1..5: note = Synthetic Construct
KTLNK

SEQ ID NO: 6062 - protein, 5 aa, synthetic construct
  REGION 1..5: note = Synthetic Construct
KTLQK

SEQ ID NO: 6063 - protein, 5 aa, synthetic construct
  REGION 1..5: note = Synthetic Construct
KTLRK

SEQ ID NO: 6064 - protein, 5 aa, synthetic construct
  REGION 1..5: note = Synthetic Construct
KTLSK

SEQ ID NO: 6065 - protein, 5 aa, synthetic construct
  REGION 1..5: note = Synthetic Construct
KTLTK

SEQ ID NO: 6066 - protein, 5 aa, synthetic construct
  REGION 1..5: note = Synthetic Construct
KTLYK

SEQ ID NO: 6067 - protein, 5 aa, synthetic construct
  REGION 1..5: note = Synthetic Construct
KTNAK

SEQ ID NO: 6068 - protein, 5 aa, synthetic construct
  REGION 1..5: note = Synthetic Construct
KTNDK

SEQ ID NO: 6069 - protein, 5 aa, synthetic construct
  REGION 1..5: note = Synthetic Construct
KTNEK

SEQ ID NO: 6070 - protein, 5 aa, synthetic construct
  REGION 1..5: note = Synthetic Construct
KTNFK

SEQ ID NO: 6071 - protein, 5 aa, synthetic construct
  REGION 1..5: note = Synthetic Construct
KTNGK

SEQ ID NO: 6072 - protein, 5 aa, synthetic construct
  REGION 1..5: note = Synthetic Construct
KTNHK

SEQ ID NO: 6073 - protein, 5 aa, synthetic construct
  REGION 1..5: note = Synthetic Construct
KTNIK

SEQ ID NO: 6074 - protein, 5 aa, synthetic construct
  REGION 1..5: note = Synthetic Construct
KTNLK

SEQ ID NO: 6075 - protein, 5 aa, synthetic construct
  REGION 1..5: note = Synthetic Construct
KTNNK

SEQ ID NO: 6076 - protein, 5 aa, synthetic construct
  REGION 1..5: note = Synthetic Construct
KTNQK

SEQ ID NO: 6077 - protein, 5 aa, synthetic construct
  REGION 1..5: note = Synthetic Construct
KTNRK

SEQ ID NO: 6078 - protein, 5 aa, synthetic construct
  REGION 1..5: note = Synthetic Construct
KTNSK

SEQ ID NO: 6079 - protein, 5 aa, synthetic construct
  REGION 1..5: note = Synthetic Construct
KTNTK

SEQ ID NO: 6080 - protein, 5 aa, synthetic construct
  REGION 1..5: note = Synthetic Construct
KTNYK

SEQ ID NO: 6081 - protein, 5 aa, synthetic construct
  REGION 1..5: note = Synthetic Construct
KTPAK

SEQ ID NO: 6082 - protein, 5 aa, synthetic construct
  REGION 1..5: note = Synthetic Construct
KTPDK

SEQ ID NO: 6083 - protein, 5 aa, synthetic construct
  REGION 1..5: note = Synthetic Construct
KTPEK

SEQ ID NO: 6084 - protein, 5 aa, synthetic construct
  REGION 1..5: note = Synthetic Construct
KTPFK

SEQ ID NO: 6085 - protein, 5 aa, synthetic construct
  REGION 1..5: note = Synthetic Construct
KTPGK

SEQ ID NO: 6086 - protein, 5 aa, synthetic construct
  REGION 1..5: note = Synthetic Construct
KTPHK

SEQ ID NO: 6087 - protein, 5 aa, synthetic construct
  REGION 1..5: note = Synthetic Construct
KTPIK

SEQ ID NO: 6088 - protein, 5 aa, synthetic construct
  REGION 1..5: note = Synthetic Construct
KTPLK

SEQ ID NO: 6089 - protein, 5 aa, synthetic construct
  REGION 1..5: note = Synthetic Construct
KTPNK

SEQ ID NO: 6090 - protein, 5 aa, synthetic construct
  REGION 1..5: note = Synthetic Construct
KTPQK

SEQ ID NO: 6091 - protein, 5 aa, synthetic construct
  REGION 1..5: note = Synthetic Construct
KTPRK

SEQ ID NO: 6092 - protein, 5 aa, synthetic construct
  REGION 1..5: note = Synthetic Construct
KTPSK

SEQ ID NO: 6093 - protein, 5 aa, synthetic construct
  REGION 1..5: note = Synthetic Construct
KTPTK

SEQ ID NO: 6094 - protein, 5 aa, synthetic construct
  REGION 1..5: note = Synthetic Construct
KTPYK

SEQ ID NO: 6095 - protein, 5 aa, synthetic construct
  REGION 1..5: note = Synthetic Construct
KTQAK

SEQ ID NO: 6096 - protein, 5 aa, synthetic construct
  REGION 1..5: note = Synthetic Construct
KTQDK

SEQ ID NO: 6097 - protein, 5 aa, synthetic construct
  REGION 1..5: note = Synthetic Construct
KTQEK

SEQ ID NO: 6098 - protein, 5 aa, synthetic construct
  REGION 1..5: note = Synthetic Construct
KTQFK

SEQ ID NO: 6099 - protein, 5 aa, synthetic construct
  REGION 1..5: note = Synthetic Construct
KTQGK

SEQ ID NO: 6100 - protein, 5 aa, synthetic construct
  REGION 1..5: note = Synthetic Construct
KTQHK

SEQ ID NO: 6101 - protein, 5 aa, synthetic construct
  REGION 1..5: note = Synthetic Construct
KTQIK

SEQ ID NO: 6102 - protein, 5 aa, synthetic construct
  REGION 1..5: note = Synthetic Construct
KTQLK

SEQ ID NO: 6103 - protein, 5 aa, synthetic construct
  REGION 1..5: note = Synthetic Construct
KTQNK

SEQ ID NO: 6104 - protein, 5 aa, synthetic construct
  REGION 1..5: note = Synthetic Construct
KTQQK

SEQ ID NO: 6105 - protein, 5 aa, synthetic construct
  REGION 1..5: note = Synthetic Construct
KTQRK

SEQ ID NO: 6106 - protein, 5 aa, synthetic construct
  REGION 1..5: note = Synthetic Construct
KTQSK

SEQ ID NO: 6107 - protein, 5 aa, synthetic construct
  REGION 1..5: note = Synthetic Construct
KTQTK

SEQ ID NO: 6108 - protein, 5 aa, synthetic construct
  REGION 1..5: note = Synthetic Construct
KTQYK

SEQ ID NO: 6109 - protein, 5 aa, synthetic construct
  REGION 1..5: note = Synthetic Construct
KTRAK

SEQ ID NO: 6110 - protein, 5 aa, synthetic construct
  REGION 1..5: note = Synthetic Construct
KTRDK

SEQ ID NO: 6111 - protein, 5 aa, synthetic construct
  REGION 1..5: note = Synthetic Construct
KTREK

SEQ ID NO: 6112 - protein, 5 aa, synthetic construct
  REGION 1..5: note = Synthetic Construct
KTRFK

SEQ ID NO: 6113 - protein, 5 aa, synthetic construct
  REGION 1..5: note = Synthetic Construct
KTRGK

SEQ ID NO: 6114 - protein, 5 aa, synthetic construct
  REGION 1..5: note = Synthetic Construct
KTRHK

SEQ ID NO: 6115 - protein, 5 aa, synthetic construct
  REGION 1..5: note = Synthetic Construct
KTRIK

SEQ ID NO: 6116 - protein, 5 aa, synthetic construct
  REGION 1..5: note = Synthetic Construct
KTRLK

SEQ ID NO: 6117 - protein, 5 aa, synthetic construct
  REGION 1..5: note = Synthetic Construct
KTRNK

SEQ ID NO: 6118 - protein, 5 aa, synthetic construct
  REGION 1..5: note = Synthetic Construct
KTRQK

SEQ ID NO: 6119 - protein, 5 aa, synthetic construct
  REGION 1..5: note = Synthetic Construct
KTRRK

SEQ ID NO: 6120 - protein, 5 aa, synthetic construct
  REGION 1..5: note = Synthetic Construct
KTRSK

SEQ ID NO: 6121 - protein, 5 aa, synthetic construct
  REGION 1..5: note = Synthetic Construct
KTRTK

SEQ ID NO: 6122 - protein, 5 aa, synthetic construct
  REGION 1..5: note = Synthetic Construct
KTRYK

SEQ ID NO: 6123 - protein, 5 aa, synthetic construct
  REGION 1..5: note = Synthetic Construct
KTSAK

SEQ ID NO: 6124 - protein, 5 aa, synthetic construct
  REGION 1..5: note = Synthetic Construct
KTSDK

SEQ ID NO: 6125 - protein, 5 aa, synthetic construct
  REGION 1..5: note = Synthetic Construct
KTSEK

SEQ ID NO: 6126 - protein, 5 aa, synthetic construct
  REGION 1..5: note = Synthetic Construct
KTSFK

SEQ ID NO: 6127 - protein, 5 aa, synthetic construct
  REGION 1..5: note = Synthetic Construct
KTSGK

SEQ ID NO: 6128 - protein, 5 aa, synthetic construct
  REGION 1..5: note = Synthetic Construct
KTSHK

SEQ ID NO: 6129 - protein, 5 aa, synthetic construct
  REGION 1..5: note = Synthetic Construct
KTSIK

SEQ ID NO: 6130 - protein, 5 aa, synthetic construct
  REGION 1..5: note = Synthetic Construct
KTSLK

SEQ ID NO: 6131 - protein, 5 aa, synthetic construct
  REGION 1..5: note = Synthetic Construct
KTSNK

SEQ ID NO: 6132 - protein, 5 aa, synthetic construct
  REGION 1..5: note = Synthetic Construct
KTSQK

SEQ ID NO: 6133 - protein, 5 aa, synthetic construct
  REGION 1..5: note = Synthetic Construct
KTSRK

SEQ ID NO: 6134 - protein, 5 aa, synthetic construct
  REGION 1..5: note = Synthetic Construct
KTSSK

SEQ ID NO: 6135 - protein, 5 aa, synthetic construct
  REGION 1..5: note = Synthetic Construct
KTSTK

SEQ ID NO: 6136 - protein, 5 aa, synthetic construct
  REGION 1..5: note = Synthetic Construct
KTSYK

SEQ ID NO: 6137 - protein, 5 aa, synthetic construct
  REGION 1..5: note = Synthetic Construct
KTTAK

SEQ ID NO: 6138 - protein, 5 aa, synthetic construct
  REGION 1..5: note = Synthetic Construct
KTTDK

SEQ ID NO: 6139 - protein, 5 aa, synthetic construct
  REGION 1..5: note = Synthetic Construct
KTTEK

SEQ ID NO: 6140 - protein, 5 aa, synthetic construct
  REGION 1..5: note = Synthetic Construct
KTTFK

SEQ ID NO: 6141 - protein, 5 aa, synthetic construct
  REGION 1..5: note = Synthetic Construct
KTTGK

SEQ ID NO: 6142 - protein, 5 aa, synthetic construct
  REGION 1..5: note = Synthetic Construct
KTTHK

SEQ ID NO: 6143 - protein, 5 aa, synthetic construct
  REGION 1..5: note = Synthetic Construct
KTTIK

SEQ ID NO: 6144 - protein, 5 aa, synthetic construct
  REGION 1..5: note = Synthetic Construct
KTTLK

SEQ ID NO: 6145 - protein, 5 aa, synthetic construct
  REGION 1..5: note = Synthetic Construct
KTTNK

SEQ ID NO: 6146 - protein, 5 aa, synthetic construct
  REGION 1..5: note = Synthetic Construct
KTTQK

SEQ ID NO: 6147 - protein, 5 aa, synthetic construct
  REGION 1..5: note = Synthetic Construct
KTTRK

SEQ ID NO: 6148 - protein, 5 aa, synthetic construct
  REGION 1..5: note = Synthetic Construct
KTTSK

SEQ ID NO: 6149 - protein, 5 aa, synthetic construct
  REGION 1..5: note = Synthetic Construct
KTTTK

SEQ ID NO: 6150 - protein, 5 aa, synthetic construct
  REGION 1..5: note = Synthetic Construct
KTTYK

SEQ ID NO: 6151 - protein, 5 aa, synthetic construct
  REGION 1..5: note = Synthetic Construct
KTYAK

SEQ ID NO: 6152 - protein, 5 aa, synthetic construct
  REGION 1..5: note = Synthetic Construct
KTYDK

SEQ ID NO: 6153 - protein, 5 aa, synthetic construct
  REGION 1..5: note = Synthetic Construct
KTYEK

SEQ ID NO: 6154 - protein, 5 aa, synthetic construct
  REGION 1..5: note = Synthetic Construct
KTYFK

SEQ ID NO: 6155 - protein, 5 aa, synthetic construct
  REGION 1..5: note = Synthetic Construct
KTYGK

SEQ ID NO: 6156 - protein, 5 aa, synthetic construct
  REGION 1..5: note = Synthetic Construct
KTYHK

SEQ ID NO: 6157 - protein, 5 aa, synthetic construct
  REGION 1..5: note = Synthetic Construct
KTYIK

SEQ ID NO: 6158 - protein, 5 aa, synthetic construct
  REGION 1..5: note = Synthetic Construct
KTYLK

SEQ ID NO: 6159 - protein, 5 aa, synthetic construct
  REGION 1..5: note = Synthetic Construct
KTYNK

SEQ ID NO: 6160 - protein, 5 aa, synthetic construct
  REGION 1..5: note = Synthetic Construct
KTYQK

SEQ ID NO: 6161 - protein, 5 aa, synthetic construct
  REGION 1..5: note = Synthetic Construct
KTYRK

SEQ ID NO: 6162 - protein, 5 aa, synthetic construct
  REGION 1..5: note = Synthetic Construct
KTYSK

SEQ ID NO: 6163 - protein, 5 aa, synthetic construct
  REGION 1..5: note = Synthetic Construct
KTYTK

SEQ ID NO: 6164 - protein, 5 aa, synthetic construct
  REGION 1..5: note = Synthetic Construct
KTYYK

SEQ ID NO: 6165 - protein, 5 aa, synthetic construct
  REGION 1..5: note = Synthetic Construct
KYAAK

SEQ ID NO: 6166 - protein, 5 aa, synthetic construct
  REGION 1..5: note = Synthetic Construct
KYADK

SEQ ID NO: 6167 - protein, 5 aa, synthetic construct
  REGION 1..5: note = Synthetic Construct
KYAEK

SEQ ID NO: 6168 - protein, 5 aa, synthetic construct
  REGION 1..5: note = Synthetic Construct
KYAFK

SEQ ID NO: 6169 - protein, 5 aa, synthetic construct
  REGION 1..5: note = Synthetic Construct
KYAGK

SEQ ID NO: 6170 - protein, 5 aa, synthetic construct
  REGION 1..5: note = Synthetic Construct
KYAHK

SEQ ID NO: 6171 - protein, 5 aa, synthetic construct
  REGION 1..5: note = Synthetic Construct
KYAIK

SEQ ID NO: 6172 - protein, 5 aa, synthetic construct
  REGION 1..5: note = Synthetic Construct
KYALK

SEQ ID NO: 6173 - protein, 5 aa, synthetic construct
  REGION 1..5: note = Synthetic Construct
KYANK

SEQ ID NO: 6174 - protein, 5 aa, synthetic construct
  REGION 1..5: note = Synthetic Construct
KYAQK

SEQ ID NO: 6175 - protein, 5 aa, synthetic construct
  REGION 1..5: note = Synthetic Construct
KYARK

SEQ ID NO: 6176 - protein, 5 aa, synthetic construct
  REGION 1..5: note = Synthetic Construct
KYASK

SEQ ID NO: 6177 - protein, 5 aa, synthetic construct
  REGION 1..5: note = Synthetic Construct
KYATK

SEQ ID NO: 6178 - protein, 5 aa, synthetic construct
  REGION 1..5: note = Synthetic Construct
KYAYK

SEQ ID NO: 6179 - protein, 5 aa, synthetic construct
  REGION 1..5: note = Synthetic Construct
KYDAK

SEQ ID NO: 6180 - protein, 5 aa, synthetic construct
  REGION 1..5: note = Synthetic Construct
KYDDK

SEQ ID NO: 6181 - protein, 5 aa, synthetic construct
  REGION 1..5: note = Synthetic Construct
KYDEK

SEQ ID NO: 6182 - protein, 5 aa, synthetic construct
  REGION 1..5: note = Synthetic Construct
KYDFK

SEQ ID NO: 6183 - protein, 5 aa, synthetic construct
  REGION 1..5: note = Synthetic Construct
KYDGK

SEQ ID NO: 6184 - protein, 5 aa, synthetic construct
  REGION 1..5: note = Synthetic Construct
KYDHK

SEQ ID NO: 6185 - protein, 5 aa, synthetic construct
  REGION 1..5: note = Synthetic Construct
KYDIK

SEQ ID NO: 6186 - protein, 5 aa, synthetic construct
  REGION 1..5: note = Synthetic Construct
KYDLK

SEQ ID NO: 6187 - protein, 5 aa, synthetic construct
  REGION 1..5: note = Synthetic Construct
KYDNK

SEQ ID NO: 6188 - protein, 5 aa, synthetic construct
  REGION 1..5: note = Synthetic Construct
KYDQK

SEQ ID NO: 6189 - protein, 5 aa, synthetic construct
  REGION 1..5: note = Synthetic Construct
KYDRK

SEQ ID NO: 6190 - protein, 5 aa, synthetic construct
  REGION 1..5: note = Synthetic Construct
KYDSK

SEQ ID NO: 6191 - protein, 5 aa, synthetic construct
  REGION 1..5: note = Synthetic Construct
KYDTK

SEQ ID NO: 6192 - protein, 5 aa, synthetic construct
  REGION 1..5: note = Synthetic Construct
KYDYK

SEQ ID NO: 6193 - protein, 5 aa, synthetic construct
  REGION 1..5: note = Synthetic Construct
KYEAK

SEQ ID NO: 6194 - protein, 5 aa, synthetic construct
  REGION 1..5: note = Synthetic Construct
KYEDK

SEQ ID NO: 6195 - protein, 5 aa, synthetic construct
  REGION 1..5: note = Synthetic Construct
KYEEK

SEQ ID NO: 6196 - protein, 5 aa, synthetic construct
  REGION 1..5: note = Synthetic Construct
KYEFK

SEQ ID NO: 6197 - protein, 5 aa, synthetic construct
  REGION 1..5: note = Synthetic Construct
KYEGK

SEQ ID NO: 6198 - protein, 5 aa, synthetic construct
  REGION 1..5: note = Synthetic Construct
KYEHK

SEQ ID NO: 6199 - protein, 5 aa, synthetic construct
  REGION 1..5: note = Synthetic Construct
KYEIK

SEQ ID NO: 6200 - protein, 5 aa, synthetic construct
  REGION 1..5: note = Synthetic Construct
KYELK

SEQ ID NO: 6201 - protein, 5 aa, synthetic construct
  REGION 1..5: note = Synthetic Construct
KYENK

SEQ ID NO: 6202 - protein, 5 aa, synthetic construct
  REGION 1..5: note = Synthetic Construct
KYEQK

SEQ ID NO: 6203 - protein, 5 aa, synthetic construct
  REGION 1..5: note = Synthetic Construct
KYERK

SEQ ID NO: 6204 - protein, 5 aa, synthetic construct
  REGION 1..5: note = Synthetic Construct
KYESK

SEQ ID NO: 6205 - protein, 5 aa, synthetic construct
  REGION 1..5: note = Synthetic Construct
KYETK

SEQ ID NO: 6206 - protein, 5 aa, synthetic construct
  REGION 1..5: note = Synthetic Construct
KYEYK

SEQ ID NO: 6207 - protein, 5 aa, synthetic construct
  REGION 1..5: note = Synthetic Construct
KYFAK

SEQ ID NO: 6208 - protein, 5 aa, synthetic construct
  REGION 1..5: note = Synthetic Construct
KYFDK

SEQ ID NO: 6209 - protein, 5 aa, synthetic construct
  REGION 1..5: note = Synthetic Construct
KYFEK

SEQ ID NO: 6210 - protein, 5 aa, synthetic construct
  REGION 1..5: note = Synthetic Construct
KYFFK

SEQ ID NO: 6211 - protein, 5 aa, synthetic construct
  REGION 1..5: note = Synthetic Construct
KYFGK

SEQ ID NO: 6212 - protein, 5 aa, synthetic construct
  REGION 1..5: note = Synthetic Construct
KYFHK

SEQ ID NO: 6213 - protein, 5 aa, synthetic construct
  REGION 1..5: note = Synthetic Construct
KYFIK

SEQ ID NO: 6214 - protein, 5 aa, synthetic construct
  REGION 1..5: note = Synthetic Construct
KYFLK

SEQ ID NO: 6215 - protein, 5 aa, synthetic construct
  REGION 1..5: note = Synthetic Construct
KYFNK

SEQ ID NO: 6216 - protein, 5 aa, synthetic construct
  REGION 1..5: note = Synthetic Construct
KYFQK

SEQ ID NO: 6217 - protein, 5 aa, synthetic construct
  REGION 1..5: note = Synthetic Construct
KYFRK

SEQ ID NO: 6218 - protein, 5 aa, synthetic construct
  REGION 1..5: note = Synthetic Construct
KYFSK

SEQ ID NO: 6219 - protein, 5 aa, synthetic construct
  REGION 1..5: note = Synthetic Construct
KYFTK

SEQ ID NO: 6220 - protein, 5 aa, synthetic construct
  REGION 1..5: note = Synthetic Construct
KYFYK

SEQ ID NO: 6221 - protein, 5 aa, synthetic construct
  REGION 1..5: note = Synthetic Construct
KYGAK

SEQ ID NO: 6222 - protein, 5 aa, synthetic construct
  REGION 1..5: note = Synthetic Construct
KYGDK

SEQ ID NO: 6223 - protein, 5 aa, synthetic construct
  REGION 1..5: note = Synthetic Construct
KYGEK

SEQ ID NO: 6224 - protein, 5 aa, synthetic construct
  REGION 1..5: note = Synthetic Construct
KYGFK

SEQ ID NO: 6225 - protein, 5 aa, synthetic construct
  REGION 1..5: note = Synthetic Construct
KYGGK

SEQ ID NO: 6226 - protein, 5 aa, synthetic construct
  REGION 1..5: note = Synthetic Construct
KYGHK

SEQ ID NO: 6227 - protein, 5 aa, synthetic construct
  REGION 1..5: note = Synthetic Construct
KYGIK

SEQ ID NO: 6228 - protein, 5 aa, synthetic construct
  REGION 1..5: note = Synthetic Construct
KYGLK

SEQ ID NO: 6229 - protein, 5 aa, synthetic construct
  REGION 1..5: note = Synthetic Construct
KYGNK

SEQ ID NO: 6230 - protein, 5 aa, synthetic construct
  REGION 1..5: note = Synthetic Construct
KYGQK

SEQ ID NO: 6231 - protein, 5 aa, synthetic construct
  REGION 1..5: note = Synthetic Construct
KYGRK

SEQ ID NO: 6232 - protein, 5 aa, synthetic construct
  REGION 1..5: note = Synthetic Construct
KYGSK

SEQ ID NO: 6233 - protein, 5 aa, synthetic construct
  REGION 1..5: note = Synthetic Construct
KYGTK

SEQ ID NO: 6234 - protein, 5 aa, synthetic construct
  REGION 1..5: note = Synthetic Construct
KYGYK

SEQ ID NO: 6235 - protein, 5 aa, synthetic construct
  REGION 1..5: note = Synthetic Construct
KYHAK

SEQ ID NO: 6236 - protein, 5 aa, synthetic construct
  REGION 1..5: note = Synthetic Construct
KYHDK

SEQ ID NO: 6237 - protein, 5 aa, synthetic construct
  REGION 1..5: note = Synthetic Construct
KYHEK

SEQ ID NO: 6238 - protein, 5 aa, synthetic construct
  REGION 1..5: note = Synthetic Construct
KYHFK

SEQ ID NO: 6239 - protein, 5 aa, synthetic construct
  REGION 1..5: note = Synthetic Construct
KYHGK

SEQ ID NO: 6240 - protein, 5 aa, synthetic construct
  REGION 1..5: note = Synthetic Construct
KYHHK

SEQ ID NO: 6241 - protein, 5 aa, synthetic construct
  REGION 1..5: note = Synthetic Construct
KYHIK

SEQ ID NO: 6242 - protein, 5 aa, synthetic construct
  REGION 1..5: note = Synthetic Construct
KYHLK

SEQ ID NO: 6243 - protein, 5 aa, synthetic construct
  REGION 1..5: note = Synthetic Construct
KYHNK

SEQ ID NO: 6244 - protein, 5 aa, synthetic construct
  REGION 1..5: note = Synthetic Construct
KYHQK

SEQ ID NO: 6245 - protein, 5 aa, synthetic construct
  REGION 1..5: note = Synthetic Construct
KYHRK

SEQ ID NO: 6246 - protein, 5 aa, synthetic construct
  REGION 1..5: note = Synthetic Construct
KYHSK

SEQ ID NO: 6247 - protein, 5 aa, synthetic construct
  REGION 1..5: note = Synthetic Construct
KYHTK

SEQ ID NO: 6248 - protein, 5 aa, synthetic construct
  REGION 1..5: note = Synthetic Construct
KYHYK

SEQ ID NO: 6249 - protein, 5 aa, synthetic construct
  REGION 1..5: note = Synthetic Construct
KYIAK

SEQ ID NO: 6250 - protein, 5 aa, synthetic construct
  REGION 1..5: note = Synthetic Construct
KYIDK

SEQ ID NO: 6251 - protein, 5 aa, synthetic construct
  REGION 1..5: note = Synthetic Construct
KYIEK

SEQ ID NO: 6252 - protein, 5 aa, synthetic construct
  REGION 1..5: note = Synthetic Construct
KYIFK

SEQ ID NO: 6253 - protein, 5 aa, synthetic construct
  REGION 1..5: note = Synthetic Construct
KYIGK

SEQ ID NO: 6254 - protein, 5 aa, synthetic construct
  REGION 1..5: note = Synthetic Construct
KYIHK

SEQ ID NO: 6255 - protein, 5 aa, synthetic construct
  REGION 1..5: note = Synthetic Construct
KYIIK

SEQ ID NO: 6256 - protein, 5 aa, synthetic construct
  REGION 1..5: note = Synthetic Construct
KYILK

SEQ ID NO: 6257 - protein, 5 aa, synthetic construct
  REGION 1..5: note = Synthetic Construct
KYINK

SEQ ID NO: 6258 - protein, 5 aa, synthetic construct
  REGION 1..5: note = Synthetic Construct
KYIQK

SEQ ID NO: 6259 - protein, 5 aa, synthetic construct
  REGION 1..5: note = Synthetic Construct
KYIRK

SEQ ID NO: 6260 - protein, 5 aa, synthetic construct
  REGION 1..5: note = Synthetic Construct
KYISK

SEQ ID NO: 6261 - protein, 5 aa, synthetic construct
  REGION 1..5: note = Synthetic Construct
KYITK

SEQ ID NO: 6262 - protein, 5 aa, synthetic construct
  REGION 1..5: note = Synthetic Construct
KYIYK

SEQ ID NO: 6263 - protein, 5 aa, synthetic construct
  REGION 1..5: note = Synthetic Construct
KYLAK

SEQ ID NO: 6264 - protein, 5 aa, synthetic construct
  REGION 1..5: note = Synthetic Construct
KYLDK

SEQ ID NO: 6265 - protein, 5 aa, synthetic construct
  REGION 1..5: note = Synthetic Construct
KYLEK

SEQ ID NO: 6266 - protein, 5 aa, synthetic construct
  REGION 1..5: note = Synthetic Construct
KYLFK

SEQ ID NO: 6267 - protein, 5 aa, synthetic construct
  REGION 1..5: note = Synthetic Construct
KYLGK

SEQ ID NO: 6268 - protein, 5 aa, synthetic construct
  REGION 1..5: note = Synthetic Construct
KYLHK

SEQ ID NO: 6269 - protein, 5 aa, synthetic construct
  REGION 1..5: note = Synthetic Construct
KYLIK

SEQ ID NO: 6270 - protein, 5 aa, synthetic construct
  REGION 1..5: note = Synthetic Construct
KYLLK

SEQ ID NO: 6271 - protein, 5 aa, synthetic construct
  REGION 1..5: note = Synthetic Construct
KYLNK

SEQ ID NO: 6272 - protein, 5 aa, synthetic construct
  REGION 1..5: note = Synthetic Construct
KYLQK

SEQ ID NO: 6273 - protein, 5 aa, synthetic construct
  REGION 1..5: note = Synthetic Construct
KYLRK

SEQ ID NO: 6274 - protein, 5 aa, synthetic construct
  REGION 1..5: note = Synthetic Construct
KYLSK

SEQ ID NO: 6275 - protein, 5 aa, synthetic construct
  REGION 1..5: note = Synthetic Construct
KYLTK

SEQ ID NO: 6276 - protein, 5 aa, synthetic construct
  REGION 1..5: note = Synthetic Construct
KYLYK

SEQ ID NO: 6277 - protein, 5 aa, synthetic construct
  REGION 1..5: note = Synthetic Construct
KYNAK

SEQ ID NO: 6278 - protein, 5 aa, synthetic construct
  REGION 1..5: note = Synthetic Construct
KYNDK

SEQ ID NO: 6279 - protein, 5 aa, synthetic construct
  REGION 1..5: note = Synthetic Construct
KYNEK

SEQ ID NO: 6280 - protein, 5 aa, synthetic construct
  REGION 1..5: note = Synthetic Construct
KYNFK

SEQ ID NO: 6281 - protein, 5 aa, synthetic construct
  REGION 1..5: note = Synthetic Construct
KYNGK

SEQ ID NO: 6282 - protein, 5 aa, synthetic construct
  REGION 1..5: note = Synthetic Construct
KYNHK

SEQ ID NO: 6283 - protein, 5 aa, synthetic construct
  REGION 1..5: note = Synthetic Construct
KYNIK

SEQ ID NO: 6284 - protein, 5 aa, synthetic construct
  REGION 1..5: note = Synthetic Construct
KYNLK

SEQ ID NO: 6285 - protein, 5 aa, synthetic construct
  REGION 1..5: note = Synthetic Construct
KYNNK

SEQ ID NO: 6286 - protein, 5 aa, synthetic construct
  REGION 1..5: note = Synthetic Construct
KYNQK

SEQ ID NO: 6287 - protein, 5 aa, synthetic construct
  REGION 1..5: note = Synthetic Construct
KYNRK

SEQ ID NO: 6288 - protein, 5 aa, synthetic construct
  REGION 1..5: note = Synthetic Construct
KYNSK

SEQ ID NO: 6289 - protein, 5 aa, synthetic construct
  REGION 1..5: note = Synthetic Construct
KYNTK

SEQ ID NO: 6290 - protein, 5 aa, synthetic construct
  REGION 1..5: note = Synthetic Construct
KYNYK

SEQ ID NO: 6291 - protein, 5 aa, synthetic construct
  REGION 1..5: note = Synthetic Construct
KYPAK

SEQ ID NO: 6292 - protein, 5 aa, synthetic construct
  REGION 1..5: note = Synthetic Construct
KYPDK

SEQ ID NO: 6293 - protein, 5 aa, synthetic construct
  REGION 1..5: note = Synthetic Construct
KYPEK

SEQ ID NO: 6294 - protein, 5 aa, synthetic construct
  REGION 1..5: note = Synthetic Construct
KYPFK

SEQ ID NO: 6295 - protein, 5 aa, synthetic construct
  REGION 1..5: note = Synthetic Construct
KYPGK

SEQ ID NO: 6296 - protein, 5 aa, synthetic construct
  REGION 1..5: note = Synthetic Construct
KYPHK

SEQ ID NO: 6297 - protein, 5 aa, synthetic construct
  REGION 1..5: note = Synthetic Construct
KYPIK

SEQ ID NO: 6298 - protein, 5 aa, synthetic construct
  REGION 1..5: note = Synthetic Construct
KYPLK

SEQ ID NO: 6299 - protein, 5 aa, synthetic construct
  REGION 1..5: note = Synthetic Construct
KYPNK

SEQ ID NO: 6300 - protein, 5 aa, synthetic construct
  REGION 1..5: note = Synthetic Construct
KYPQK

SEQ ID NO: 6301 - protein, 5 aa, synthetic construct
  REGION 1..5: note = Synthetic Construct
KYPRK

SEQ ID NO: 6302 - protein, 5 aa, synthetic construct
  REGION 1..5: note = Synthetic Construct
KYPSK

SEQ ID NO: 6303 - protein, 5 aa, synthetic construct
  REGION 1..5: note = Synthetic Construct
KYPTK

SEQ ID NO: 6304 - protein, 5 aa, synthetic construct
  REGION 1..5: note = Synthetic Construct
KYPYK

SEQ ID NO: 6305 - protein, 5 aa, synthetic construct
  REGION 1..5: note = Synthetic Construct
KYQAK

SEQ ID NO: 6306 - protein, 5 aa, synthetic construct
  REGION 1..5: note = Synthetic Construct
KYQDK

SEQ ID NO: 6307 - protein, 5 aa, synthetic construct
  REGION 1..5: note = Synthetic Construct
KYQEK

SEQ ID NO: 6308 - protein, 5 aa, synthetic construct
  REGION 1..5: note = Synthetic Construct
KYQFK

SEQ ID NO: 6309 - protein, 5 aa, synthetic construct
  REGION 1..5: note = Synthetic Construct
KYQGK

SEQ ID NO: 6310 - protein, 5 aa, synthetic construct
  REGION 1..5: note = Synthetic Construct
KYQHK

SEQ ID NO: 6311 - protein, 5 aa, synthetic construct
  REGION 1..5: note = Synthetic Construct
KYQIK

SEQ ID NO: 6312 - protein, 5 aa, synthetic construct
  REGION 1..5: note = Synthetic Construct
KYQLK

SEQ ID NO: 6313 - protein, 5 aa, synthetic construct
  REGION 1..5: note = Synthetic Construct
KYQNK

SEQ ID NO: 6314 - protein, 5 aa, synthetic construct
  REGION 1..5: note = Synthetic Construct
KYQQK

SEQ ID NO: 6315 - protein, 5 aa, synthetic construct
  REGION 1..5: note = Synthetic Construct
KYQRK

SEQ ID NO: 6316 - protein, 5 aa, synthetic construct
  REGION 1..5: note = Synthetic Construct
KYQSK

SEQ ID NO: 6317 - protein, 5 aa, synthetic construct
  REGION 1..5: note = Synthetic Construct
KYQTK

SEQ ID NO: 6318 - protein, 5 aa, synthetic construct
  REGION 1..5: note = Synthetic Construct
KYQYK

SEQ ID NO: 6319 - protein, 5 aa, synthetic construct
  REGION 1..5: note = Synthetic Construct
KYRAK

SEQ ID NO: 6320 - protein, 5 aa, synthetic construct
  REGION 1..5: note = Synthetic Construct
KYRDK

SEQ ID NO: 6321 - protein, 5 aa, synthetic construct
  REGION 1..5: note = Synthetic Construct
KYREK

SEQ ID NO: 6322 - protein, 5 aa, synthetic construct
  REGION 1..5: note = Synthetic Construct
KYRFK

SEQ ID NO: 6323 - protein, 5 aa, synthetic construct
  REGION 1..5: note = Synthetic Construct
KYRGK

SEQ ID NO: 6324 - protein, 5 aa, synthetic construct
  REGION 1..5: note = Synthetic Construct
KYRHK

SEQ ID NO: 6325 - protein, 5 aa, synthetic construct
  REGION 1..5: note = Synthetic Construct
KYRIK

SEQ ID NO: 6326 - protein, 5 aa, synthetic construct
  REGION 1..5: note = Synthetic Construct
KYRLK

SEQ ID NO: 6327 - protein, 5 aa, synthetic construct
  REGION 1..5: note = Synthetic Construct
KYRNK

SEQ ID NO: 6328 - protein, 5 aa, synthetic construct
  REGION 1..5: note = Synthetic Construct
KYRQK

SEQ ID NO: 6329 - protein, 5 aa, synthetic construct
  REGION 1..5: note = Synthetic Construct
KYRRK

SEQ ID NO: 6330 - protein, 5 aa, synthetic construct
  REGION 1..5: note = Synthetic Construct
KYRSK

SEQ ID NO: 6331 - protein, 5 aa, synthetic construct
  REGION 1..5: note = Synthetic Construct
KYRTK

SEQ ID NO: 6332 - protein, 5 aa, synthetic construct
  REGION 1..5: note = Synthetic Construct
KYRYK

SEQ ID NO: 6333 - protein, 5 aa, synthetic construct
  REGION 1..5: note = Synthetic Construct
KYSAK

SEQ ID NO: 6334 - protein, 5 aa, synthetic construct
  REGION 1..5: note = Synthetic Construct
KYSDK

SEQ ID NO: 6335 - protein, 5 aa, synthetic construct
  REGION 1..5: note = Synthetic Construct
KYSEK

SEQ ID NO: 6336 - protein, 5 aa, synthetic construct
  REGION 1..5: note = Synthetic Construct
KYSFK

SEQ ID NO: 6337 - protein, 5 aa, synthetic construct
  REGION 1..5: note = Synthetic Construct
KYSGK

SEQ ID NO: 6338 - protein, 5 aa, synthetic construct
  REGION 1..5: note = Synthetic Construct
KYSHK

SEQ ID NO: 6339 - protein, 5 aa, synthetic construct
  REGION 1..5: note = Synthetic Construct
KYSIK

SEQ ID NO: 6340 - protein, 5 aa, synthetic construct
  REGION 1..5: note = Synthetic Construct
KYSLK

SEQ ID NO: 6341 - protein, 5 aa, synthetic construct
  REGION 1..5: note = Synthetic Construct
KYSNK

SEQ ID NO: 6342 - protein, 5 aa, synthetic construct
  REGION 1..5: note = Synthetic Construct
KYSQK

SEQ ID NO: 6343 - protein, 5 aa, synthetic construct
  REGION 1..5: note = Synthetic Construct
KYSRK

SEQ ID NO: 6344 - protein, 5 aa, synthetic construct
  REGION 1..5: note = Synthetic Construct
KYSSK

SEQ ID NO: 6345 - protein, 5 aa, synthetic construct
  REGION 1..5: note = Synthetic Construct
KYSTK

SEQ ID NO: 6346 - protein, 5 aa, synthetic construct
  REGION 1..5: note = Synthetic Construct
KYSYK

SEQ ID NO: 6347 - protein, 5 aa, synthetic construct
  REGION 1..5: note = Synthetic Construct
KYTAK

SEQ ID NO: 6348 - protein, 5 aa, synthetic construct
  REGION 1..5: note = Synthetic Construct
KYTDK

SEQ ID NO: 6349 - protein, 5 aa, synthetic construct
  REGION 1..5: note = Synthetic Construct
KYTEK

SEQ ID NO: 6350 - protein, 5 aa, synthetic construct
  REGION 1..5: note = Synthetic Construct
KYTFK

SEQ ID NO: 6351 - protein, 5 aa, synthetic construct
  REGION 1..5: note = Synthetic Construct
KYTGK

SEQ ID NO: 6352 - protein, 5 aa, synthetic construct
  REGION 1..5: note = Synthetic Construct
KYTHK

SEQ ID NO: 6353 - protein, 5 aa, synthetic construct
  REGION 1..5: note = Synthetic Construct
KYTIK

SEQ ID NO: 6354 - protein, 5 aa, synthetic construct
  REGION 1..5: note = Synthetic Construct
KYTLK

SEQ ID NO: 6355 - protein, 5 aa, synthetic construct
  REGION 1..5: note = Synthetic Construct
KYTNK

SEQ ID NO: 6356 - protein, 5 aa, synthetic construct
  REGION 1..5: note = Synthetic Construct
KYTQK

SEQ ID NO: 6357 - protein, 5 aa, synthetic construct
  REGION 1..5: note = Synthetic Construct
KYTRK

SEQ ID NO: 6358 - protein, 5 aa, synthetic construct
  REGION 1..5: note = Synthetic Construct
KYTSK

SEQ ID NO: 6359 - protein, 5 aa, synthetic construct
  REGION 1..5: note = Synthetic Construct
KYTTK

SEQ ID NO: 6360 - protein, 5 aa, synthetic construct
  REGION 1..5: note = Synthetic Construct
KYTYK

SEQ ID NO: 6361 - protein, 5 aa, synthetic construct
  REGION 1..5: note = Synthetic Construct
KYYAK

SEQ ID NO: 6362 - protein, 5 aa, synthetic construct
  REGION 1..5: note = Synthetic Construct
KYYDK

SEQ ID NO: 6363 - protein, 5 aa, synthetic construct
  REGION 1..5: note = Synthetic Construct
KYYEK

SEQ ID NO: 6364 - protein, 5 aa, synthetic construct
  REGION 1..5: note = Synthetic Construct
KYYFK

SEQ ID NO: 6365 - protein, 5 aa, synthetic construct
  REGION 1..5: note = Synthetic Construct
KYYGK

SEQ ID NO: 6366 - protein, 5 aa, synthetic construct
  REGION 1..5: note = Synthetic Construct
KYYHK

SEQ ID NO: 6367 - protein, 5 aa, synthetic construct
  REGION 1..5: note = Synthetic Construct
KYYIK

SEQ ID NO: 6368 - protein, 5 aa, synthetic construct
  REGION 1..5: note = Synthetic Construct
KYYLK

SEQ ID NO: 6369 - protein, 5 aa, synthetic construct
  REGION 1..5: note = Synthetic Construct
KYYNK

SEQ ID NO: 6370 - protein, 5 aa, synthetic construct
  REGION 1..5: note = Synthetic Construct
KYYQK

SEQ ID NO: 6371 - protein, 5 aa, synthetic construct
  REGION 1..5: note = Synthetic Construct
KYYRK

SEQ ID NO: 6372 - protein, 5 aa, synthetic construct
  REGION 1..5: note = Synthetic Construct
KYYSK

SEQ ID NO: 6373 - protein, 5 aa, synthetic construct
  REGION 1..5: note = Synthetic Construct
KYYTK

SEQ ID NO: 6374 - protein, 5 aa, synthetic construct
  REGION 1..5: note = Synthetic Construct
KYYYK

SEQ ID NO: 6375 - protein, 6 aa, synthetic construct
  REGION 1..6: note = Synthetic Construct
AKAAAK

SEQ ID NO: 6376 - protein, 6 aa, synthetic construct
  REGION 1..6: note = Synthetic Construct
AKAADK

SEQ ID NO: 6377 - protein, 6 aa, synthetic construct
  REGION 1..6: note = Synthetic Construct
AKAAEK

SEQ ID NO: 6378 - protein, 6 aa, synthetic construct
  REGION 1..6: note = Synthetic Construct
AKAAFK

SEQ ID NO: 6379 - protein, 6 aa, synthetic construct
  REGION 1..6: note = Synthetic Construct
AKAAGK

SEQ ID NO: 6380 - protein, 6 aa, synthetic construct
  REGION 1..6: note = Synthetic Construct
AKAAHK

SEQ ID NO: 6381 - protein, 6 aa, synthetic construct
  REGION 1..6: note = Synthetic Construct
AKAAIK

SEQ ID NO: 6382 - protein, 6 aa, synthetic construct
  REGION 1..6: note = Synthetic Construct
AKAALK

SEQ ID NO: 6383 - protein, 6 aa, synthetic construct
  REGION 1..6: note = Synthetic Construct
AKAANK

SEQ ID NO: 6384 - protein, 6 aa, synthetic construct
  REGION 1..6: note = Synthetic Construct
AKAAQK

SEQ ID NO: 6385 - protein, 6 aa, synthetic construct
  REGION 1..6: note = Synthetic Construct
AKAARK

SEQ ID NO: 6386 - protein, 6 aa, synthetic construct
  REGION 1..6: note = Synthetic Construct
AKAASK

SEQ ID NO: 6387 - protein, 6 aa, synthetic construct
  REGION 1..6: note = Synthetic Construct
AKAATK

SEQ ID NO: 6388 - protein, 6 aa, synthetic construct
  REGION 1..6: note = Synthetic Construct
AKAAYK

SEQ ID NO: 6389 - protein, 6 aa, synthetic construct
  REGION 1..6: note = Synthetic Construct
AKADAK

SEQ ID NO: 6390 - protein, 6 aa, synthetic construct
  REGION 1..6: note = Synthetic Construct
AKADDK

SEQ ID NO: 6391 - protein, 6 aa, synthetic construct
  REGION 1..6: note = Synthetic Construct
AKADEK

SEQ ID NO: 6392 - protein, 6 aa, synthetic construct
  REGION 1..6: note = Synthetic Construct
AKADFK

SEQ ID NO: 6393 - protein, 6 aa, synthetic construct
  REGION 1..6: note = Synthetic Construct
AKADGK

SEQ ID NO: 6394 - protein, 6 aa, synthetic construct
  REGION 1..6: note = Synthetic Construct
AKADHK

SEQ ID NO: 6395 - protein, 6 aa, synthetic construct
  REGION 1..6: note = Synthetic Construct
AKADIK

SEQ ID NO: 6396 - protein, 6 aa, synthetic construct
  REGION 1..6: note = Synthetic Construct
AKADLK

SEQ ID NO: 6397 - protein, 6 aa, synthetic construct
  REGION 1..6: note = Synthetic Construct
AKADNK

SEQ ID NO: 6398 - protein, 6 aa, synthetic construct
  REGION 1..6: note = Synthetic Construct
AKADQK

SEQ ID NO: 6399 - protein, 6 aa, synthetic construct
  REGION 1..6: note = Synthetic Construct
AKADRK

SEQ ID NO: 6400 - protein, 6 aa, synthetic construct
  REGION 1..6: note = Synthetic Construct
AKADSK

SEQ ID NO: 6401 - protein, 6 aa, synthetic construct
  REGION 1..6: note = Synthetic Construct
AKADTK

SEQ ID NO: 6402 - protein, 6 aa, synthetic construct
  REGION 1..6: note = Synthetic Construct
AKADYK

SEQ ID NO: 6403 - protein, 6 aa, synthetic construct
  REGION 1..6: note = Synthetic Construct
AKAEAK

SEQ ID NO: 6404 - protein, 6 aa, synthetic construct
  REGION 1..6: note = Synthetic Construct
AKAEDK

SEQ ID NO: 6405 - protein, 6 aa, synthetic construct
  REGION 1..6: note = Synthetic Construct
AKAEEK

SEQ ID NO: 6406 - protein, 6 aa, synthetic construct
  REGION 1..6: note = Synthetic Construct
AKAEFK

SEQ ID NO: 6407 - protein, 6 aa, synthetic construct
  REGION 1..6: note = Synthetic Construct
AKAEGK

SEQ ID NO: 6408 - protein, 6 aa, synthetic construct
  REGION 1..6: note = Synthetic Construct
AKAEHK

SEQ ID NO: 6409 - protein, 6 aa, synthetic construct
  REGION 1..6: note = Synthetic Construct
AKAEIK

SEQ ID NO: 6410 - protein, 6 aa, synthetic construct
  REGION 1..6: note = Synthetic Construct
AKAELK

SEQ ID NO: 6411 - protein, 6 aa, synthetic construct
  REGION 1..6: note = Synthetic Construct
AKAENK

SEQ ID NO: 6412 - protein, 6 aa, synthetic construct
  REGION 1..6: note = Synthetic Construct
AKAEQK

SEQ ID NO: 6413 - protein, 6 aa, synthetic construct
  REGION 1..6: note = Synthetic Construct
AKAERK

SEQ ID NO: 6414 - protein, 6 aa, synthetic construct
  REGION 1..6: note = Synthetic Construct
AKAESK

SEQ ID NO: 6415 - protein, 6 aa, synthetic construct
  REGION 1..6: note = Synthetic Construct
AKAETK

SEQ ID NO: 6416 - protein, 6 aa, synthetic construct
  REGION 1..6: note = Synthetic Construct
AKAEYK

SEQ ID NO: 6417 - protein, 6 aa, synthetic construct
  REGION 1..6: note = Synthetic Construct
AKAFAK

SEQ ID NO: 6418 - protein, 6 aa, synthetic construct
  REGION 1..6: note = Synthetic Construct
AKAFDK

SEQ ID NO: 6419 - protein, 6 aa, synthetic construct
  REGION 1..6: note = Synthetic Construct
AKAFEK

SEQ ID NO: 6420 - protein, 6 aa, synthetic construct
  REGION 1..6: note = Synthetic Construct
AKAFFK

SEQ ID NO: 6421 - protein, 6 aa, synthetic construct
  REGION 1..6: note = Synthetic Construct
AKAFGK

SEQ ID NO: 6422 - protein, 6 aa, synthetic construct
  REGION 1..6: note = Synthetic Construct
AKAFHK

SEQ ID NO: 6423 - protein, 6 aa, synthetic construct
  REGION 1..6: note = Synthetic Construct
AKAFIK

SEQ ID NO: 6424 - protein, 6 aa, synthetic construct
  REGION 1..6: note = Synthetic Construct
AKAFLK

SEQ ID NO: 6425 - protein, 6 aa, synthetic construct
  REGION 1..6: note = Synthetic Construct
AKAFNK

SEQ ID NO: 6426 - protein, 6 aa, synthetic construct
  REGION 1..6: note = Synthetic Construct
AKAFQK

SEQ ID NO: 6427 - protein, 6 aa, synthetic construct
  REGION 1..6: note = Synthetic Construct
AKAFRK

SEQ ID NO: 6428 - protein, 6 aa, synthetic construct
  REGION 1..6: note = Synthetic Construct
AKAFSK

SEQ ID NO: 6429 - protein, 6 aa, synthetic construct
  REGION 1..6: note = Synthetic Construct
AKAFTK

SEQ ID NO: 6430 - protein, 6 aa, synthetic construct
  REGION 1..6: note = Synthetic Construct
AKAFYK

SEQ ID NO: 6431 - protein, 6 aa, synthetic construct
  REGION 1..6: note = Synthetic Construct
AKAGAK

SEQ ID NO: 6432 - protein, 6 aa, synthetic construct
  REGION 1..6: note = Synthetic Construct
AKAGDK

SEQ ID NO: 6433 - protein, 6 aa, synthetic construct
  REGION 1..6: note = Synthetic Construct
AKAGEK

SEQ ID NO: 6434 - protein, 6 aa, synthetic construct
  REGION 1..6: note = Synthetic Construct
AKAGFK

SEQ ID NO: 6435 - protein, 6 aa, synthetic construct
  REGION 1..6: note = Synthetic Construct
AKAGGK

SEQ ID NO: 6436 - protein, 6 aa, synthetic construct
  REGION 1..6: note = Synthetic Construct
AKAGHK

SEQ ID NO: 6437 - protein, 6 aa, synthetic construct
  REGION 1..6: note = Synthetic Construct
AKAGIK

SEQ ID NO: 6438 - protein, 6 aa, synthetic construct
  REGION 1..6: note = Synthetic Construct
AKAGLK

SEQ ID NO: 6439 - protein, 6 aa, synthetic construct
  REGION 1..6: note = Synthetic Construct
AKAGNK

SEQ ID NO: 6440 - protein, 6 aa, synthetic construct
  REGION 1..6: note = Synthetic Construct
AKAGQK

SEQ ID NO: 6441 - protein, 6 aa, synthetic construct
  REGION 1..6: note = Synthetic Construct
AKAGRK

SEQ ID NO: 6442 - protein, 6 aa, synthetic construct
  REGION 1..6: note = Synthetic Construct
AKAGSK

SEQ ID NO: 6443 - protein, 6 aa, synthetic construct
  REGION 1..6: note = Synthetic Construct
AKAGTK

SEQ ID NO: 6444 - protein, 6 aa, synthetic construct
  REGION 1..6: note = Synthetic Construct
AKAGYK

SEQ ID NO: 6445 - protein, 6 aa, synthetic construct
  REGION 1..6: note = Synthetic Construct
AKAHAK

SEQ ID NO: 6446 - protein, 6 aa, synthetic construct
  REGION 1..6: note = Synthetic Construct
AKAHDK

SEQ ID NO: 6447 - protein, 6 aa, synthetic construct
  REGION 1..6: note = Synthetic Construct
AKAHEK

SEQ ID NO: 6448 - protein, 6 aa, synthetic construct
  REGION 1..6: note = Synthetic Construct
AKAHFK

SEQ ID NO: 6449 - protein, 6 aa, synthetic construct
  REGION 1..6: note = Synthetic Construct
AKAHGK

SEQ ID NO: 6450 - protein, 6 aa, synthetic construct
  REGION 1..6: note = Synthetic Construct
AKAHHK

SEQ ID NO: 6451 - protein, 6 aa, synthetic construct
  REGION 1..6: note = Synthetic Construct
AKAHIK

SEQ ID NO: 6452 - protein, 6 aa, synthetic construct
  REGION 1..6: note = Synthetic Construct
AKAHLK

SEQ ID NO: 6453 - protein, 6 aa, synthetic construct
  REGION 1..6: note = Synthetic Construct
AKAHNK

SEQ ID NO: 6454 - protein, 6 aa, synthetic construct
  REGION 1..6: note = Synthetic Construct
AKAHQK

SEQ ID NO: 6455 - protein, 6 aa, synthetic construct
  REGION 1..6: note = Synthetic Construct
AKAHRK

SEQ ID NO: 6456 - protein, 6 aa, synthetic construct
  REGION 1..6: note = Synthetic Construct
AKAHSK

SEQ ID NO: 6457 - protein, 6 aa, synthetic construct
  REGION 1..6: note = Synthetic Construct
AKAHTK

SEQ ID NO: 6458 - protein, 6 aa, synthetic construct
  REGION 1..6: note = Synthetic Construct
AKAHYK

SEQ ID NO: 6459 - protein, 6 aa, synthetic construct
  REGION 1..6: note = Synthetic Construct
AKAIAK

SEQ ID NO: 6460 - protein, 6 aa, synthetic construct
  REGION 1..6: note = Synthetic Construct
AKAIDK

SEQ ID NO: 6461 - protein, 6 aa, synthetic construct
  REGION 1..6: note = Synthetic Construct
AKAIEK

SEQ ID NO: 6462 - protein, 6 aa, synthetic construct
  REGION 1..6: note = Synthetic Construct
AKAIFK

SEQ ID NO: 6463 - protein, 6 aa, synthetic construct
  REGION 1..6: note = Synthetic Construct
AKAIGK

SEQ ID NO: 6464 - protein, 6 aa, synthetic construct
  REGION 1..6: note = Synthetic Construct
AKAIHK

SEQ ID NO: 6465 - protein, 6 aa, synthetic construct
  REGION 1..6: note = Synthetic Construct
AKAIIK

SEQ ID NO: 6466 - protein, 6 aa, synthetic construct
  REGION 1..6: note = Synthetic Construct
AKAILK

SEQ ID NO: 6467 - protein, 6 aa, synthetic construct
  REGION 1..6: note = Synthetic Construct
AKAINK

SEQ ID NO: 6468 - protein, 6 aa, synthetic construct
  REGION 1..6: note = Synthetic Construct
AKAIQK

SEQ ID NO: 6469 - protein, 6 aa, synthetic construct
  REGION 1..6: note = Synthetic Construct
AKAIRK

SEQ ID NO: 6470 - protein, 6 aa, synthetic construct
  REGION 1..6: note = Synthetic Construct
AKAISK

SEQ ID NO: 6471 - protein, 6 aa, synthetic construct
  REGION 1..6: note = Synthetic Construct
AKAITK

SEQ ID NO: 6472 - protein, 6 aa, synthetic construct
  REGION 1..6: note = Synthetic Construct
AKAIYK

SEQ ID NO: 6473 - protein, 6 aa, synthetic construct
  REGION 1..6: note = Synthetic Construct
AKALAK

SEQ ID NO: 6474 - protein, 6 aa, synthetic construct
  REGION 1..6: note = Synthetic Construct
AKALDK

SEQ ID NO: 6475 - protein, 6 aa, synthetic construct
  REGION 1..6: note = Synthetic Construct
AKALEK

SEQ ID NO: 6476 - protein, 6 aa, synthetic construct
  REGION 1..6: note = Synthetic Construct
AKALFK

SEQ ID NO: 6477 - protein, 6 aa, synthetic construct
  REGION 1..6: note = Synthetic Construct
AKALGK

SEQ ID NO: 6478 - protein, 6 aa, synthetic construct
  REGION 1..6: note = Synthetic Construct
AKALHK

SEQ ID NO: 6479 - protein, 6 aa, synthetic construct
  REGION 1..6: note = Synthetic Construct
AKALIK

SEQ ID NO: 6480 - protein, 6 aa, synthetic construct
  REGION 1..6: note = Synthetic Construct
AKALLK

SEQ ID NO: 6481 - protein, 6 aa, synthetic construct
  REGION 1..6: note = Synthetic Construct
AKALNK

SEQ ID NO: 6482 - protein, 6 aa, synthetic construct
  REGION 1..6: note = Synthetic Construct
AKALQK

SEQ ID NO: 6483 - protein, 6 aa, synthetic construct
  REGION 1..6: note = Synthetic Construct
AKALRK

SEQ ID NO: 6484 - protein, 6 aa, synthetic construct
  REGION 1..6: note = Synthetic Construct
AKALSK

SEQ ID NO: 6485 - protein, 6 aa, synthetic construct
  REGION 1..6: note = Synthetic Construct
AKALTK

SEQ ID NO: 6486 - protein, 6 aa, synthetic construct
  REGION 1..6: note = Synthetic Construct
AKALYK

SEQ ID NO: 6487 - protein, 6 aa, synthetic construct
  REGION 1..6: note = Synthetic Construct
AKANAK

SEQ ID NO: 6488 - protein, 6 aa, synthetic construct
  REGION 1..6: note = Synthetic Construct
AKANDK

SEQ ID NO: 6489 - protein, 6 aa, synthetic construct
  REGION 1..6: note = Synthetic Construct
AKANEK

SEQ ID NO: 6490 - protein, 6 aa, synthetic construct
  REGION 1..6: note = Synthetic Construct
AKANFK

SEQ ID NO: 6491 - protein, 6 aa, synthetic construct
  REGION 1..6: note = Synthetic Construct
AKANGK

SEQ ID NO: 6492 - protein, 6 aa, synthetic construct
  REGION 1..6: note = Synthetic Construct
AKANHK

SEQ ID NO: 6493 - protein, 6 aa, synthetic construct
  REGION 1..6: note = Synthetic Construct
AKANIK

SEQ ID NO: 6494 - protein, 6 aa, synthetic construct
  REGION 1..6: note = Synthetic Construct
AKANLK

SEQ ID NO: 6495 - protein, 6 aa, synthetic construct
  REGION 1..6: note = Synthetic Construct
AKANNK

SEQ ID NO: 6496 - protein, 6 aa, synthetic construct
  REGION 1..6: note = Synthetic Construct
AKANQK

SEQ ID NO: 6497 - protein, 6 aa, synthetic construct
  REGION 1..6: note = Synthetic Construct
AKANRK

SEQ ID NO: 6498 - protein, 6 aa, synthetic construct
  REGION 1..6: note = Synthetic Construct
AKANSK

SEQ ID NO: 6499 - protein, 6 aa, synthetic construct
  REGION 1..6: note = Synthetic Construct
AKANTK

SEQ ID NO: 6500 - protein, 6 aa, synthetic construct
  REGION 1..6: note = Synthetic Construct
AKANYK

SEQ ID NO: 6501 - protein, 6 aa, synthetic construct
  REGION 1..6: note = Synthetic Construct
AKAQAK

SEQ ID NO: 6502 - protein, 6 aa, synthetic construct
  REGION 1..6: note = Synthetic Construct
AKAQDK

SEQ ID NO: 6503 - protein, 6 aa, synthetic construct
  REGION 1..6: note = Synthetic Construct
AKAQEK

SEQ ID NO: 6504 - protein, 6 aa, synthetic construct
  REGION 1..6: note = Synthetic Construct
AKAQFK

SEQ ID NO: 6505 - protein, 6 aa, synthetic construct
  REGION 1..6: note = Synthetic Construct
AKAQGK

SEQ ID NO: 6506 - protein, 6 aa, synthetic construct
  REGION 1..6: note = Synthetic Construct
AKAQHK

SEQ ID NO: 6507 - protein, 6 aa, synthetic construct
  REGION 1..6: note = Synthetic Construct
AKAQIK

SEQ ID NO: 6508 - protein, 6 aa, synthetic construct
  REGION 1..6: note = Synthetic Construct
AKAQLK

SEQ ID NO: 6509 - protein, 6 aa, synthetic construct
  REGION 1..6: note = Synthetic Construct
AKAQNK

SEQ ID NO: 6510 - protein, 6 aa, synthetic construct
  REGION 1..6: note = Synthetic Construct
AKAQQK

SEQ ID NO: 6511 - protein, 6 aa, synthetic construct
  REGION 1..6: note = Synthetic Construct
AKAQRK

SEQ ID NO: 6512 - protein, 6 aa, synthetic construct
  REGION 1..6: note = Synthetic Construct
AKAQSK

SEQ ID NO: 6513 - protein, 6 aa, synthetic construct
  REGION 1..6: note = Synthetic Construct
AKAQTK

SEQ ID NO: 6514 - protein, 6 aa, synthetic construct
  REGION 1..6: note = Synthetic Construct
AKAQYK

SEQ ID NO: 6515 - protein, 6 aa, synthetic construct
  REGION 1..6: note = Synthetic Construct
AKARAK

SEQ ID NO: 6516 - protein, 6 aa, synthetic construct
  REGION 1..6: note = Synthetic Construct
AKARDK

SEQ ID NO: 6517 - protein, 6 aa, synthetic construct
  REGION 1..6: note = Synthetic Construct
AKAREK

SEQ ID NO: 6518 - protein, 6 aa, synthetic construct
  REGION 1..6: note = Synthetic Construct
AKARFK

SEQ ID NO: 6519 - protein, 6 aa, synthetic construct
  REGION 1..6: note = Synthetic Construct
AKARGK

SEQ ID NO: 6520 - protein, 6 aa, synthetic construct
  REGION 1..6: note = Synthetic Construct
AKARHK

SEQ ID NO: 6521 - protein, 6 aa, synthetic construct
  REGION 1..6: note = Synthetic Construct
AKARIK

SEQ ID NO: 6522 - protein, 6 aa, synthetic construct
  REGION 1..6: note = Synthetic Construct
AKARLK

SEQ ID NO: 6523 - protein, 6 aa, synthetic construct
  REGION 1..6: note = Synthetic Construct
AKARNK

SEQ ID NO: 6524 - protein, 6 aa, synthetic construct
  REGION 1..6: note = Synthetic Construct
AKARQK

SEQ ID NO: 6525 - protein, 6 aa, synthetic construct
  REGION 1..6: note = Synthetic Construct
AKARRK

SEQ ID NO: 6526 - protein, 6 aa, synthetic construct
  REGION 1..6: note = Synthetic Construct
AKARSK

SEQ ID NO: 6527 - protein, 6 aa, synthetic construct
  REGION 1..6: note = Synthetic Construct
AKARTK

SEQ ID NO: 6528 - protein, 6 aa, synthetic construct
  REGION 1..6: note = Synthetic Construct
AKARYK

SEQ ID NO: 6529 - protein, 6 aa, synthetic construct
  REGION 1..6: note = Synthetic Construct
AKASAK

SEQ ID NO: 6530 - protein, 6 aa, synthetic construct
  REGION 1..6: note = Synthetic Construct
AKASDK

SEQ ID NO: 6531 - protein, 6 aa, synthetic construct
  REGION 1..6: note = Synthetic Construct
AKASEK

SEQ ID NO: 6532 - protein, 6 aa, synthetic construct
  REGION 1..6: note = Synthetic Construct
AKASFK

SEQ ID NO: 6533 - protein, 6 aa, synthetic construct
  REGION 1..6: note = Synthetic Construct
AKASGK

SEQ ID NO: 6534 - protein, 6 aa, synthetic construct
  REGION 1..6: note = Synthetic Construct
AKASHK

SEQ ID NO: 6535 - protein, 6 aa, synthetic construct
  REGION 1..6: note = Synthetic Construct
AKASIK

SEQ ID NO: 6536 - protein, 6 aa, synthetic construct
  REGION 1..6: note = Synthetic Construct
AKASLK

SEQ ID NO: 6537 - protein, 6 aa, synthetic construct
  REGION 1..6: note = Synthetic Construct
AKASNK

SEQ ID NO: 6538 - protein, 6 aa, synthetic construct
  REGION 1..6: note = Synthetic Construct
AKASQK

SEQ ID NO: 6539 - protein, 6 aa, synthetic construct
  REGION 1..6: note = Synthetic Construct
AKASRK

SEQ ID NO: 6540 - protein, 6 aa, synthetic construct
  REGION 1..6: note = Synthetic Construct
AKASSK

SEQ ID NO: 6541 - protein, 6 aa, synthetic construct
  REGION 1..6: note = Synthetic Construct
AKASTK

SEQ ID NO: 6542 - protein, 6 aa, synthetic construct
  REGION 1..6: note = Synthetic Construct
AKASYK

SEQ ID NO: 6543 - protein, 6 aa, synthetic construct
  REGION 1..6: note = Synthetic Construct
AKATAK

SEQ ID NO: 6544 - protein, 6 aa, synthetic construct
  REGION 1..6: note = Synthetic Construct
AKATDK

SEQ ID NO: 6545 - protein, 6 aa, synthetic construct
  REGION 1..6: note = Synthetic Construct
AKATEK

SEQ ID NO: 6546 - protein, 6 aa, synthetic construct
  REGION 1..6: note = Synthetic Construct
AKATFK

SEQ ID NO: 6547 - protein, 6 aa, synthetic construct
  REGION 1..6: note = Synthetic Construct
AKATGK

SEQ ID NO: 6548 - protein, 6 aa, synthetic construct
  REGION 1..6: note = Synthetic Construct
AKATHK

SEQ ID NO: 6549 - protein, 6 aa, synthetic construct
  REGION 1..6: note = Synthetic Construct
AKATIK

SEQ ID NO: 6550 - protein, 6 aa, synthetic construct
  REGION 1..6: note = Synthetic Construct
AKATLK

SEQ ID NO: 6551 - protein, 6 aa, synthetic construct
  REGION 1..6: note = Synthetic Construct
AKATNK

SEQ ID NO: 6552 - protein, 6 aa, synthetic construct
  REGION 1..6: note = Synthetic Construct
AKATQK

SEQ ID NO: 6553 - protein, 6 aa, synthetic construct
  REGION 1..6: note = Synthetic Construct
AKATRK

SEQ ID NO: 6554 - protein, 6 aa, synthetic construct
  REGION 1..6: note = Synthetic Construct
AKATSK

SEQ ID NO: 6555 - protein, 6 aa, synthetic construct
  REGION 1..6: note = Synthetic Construct
AKATTK

SEQ ID NO: 6556 - protein, 6 aa, synthetic construct
  REGION 1..6: note = Synthetic Construct
AKATYK

SEQ ID NO: 6557 - protein, 6 aa, synthetic construct
  REGION 1..6: note = Synthetic Construct
AKAYAK

SEQ ID NO: 6558 - protein, 6 aa, synthetic construct
  REGION 1..6: note = Synthetic Construct
AKAYDK

SEQ ID NO: 6559 - protein, 6 aa, synthetic construct
  REGION 1..6: note = Synthetic Construct
AKAYEK

SEQ ID NO: 6560 - protein, 6 aa, synthetic construct
  REGION 1..6: note = Synthetic Construct
AKAYFK

SEQ ID NO: 6561 - protein, 6 aa, synthetic construct
  REGION 1..6: note = Synthetic Construct
AKAYGK

SEQ ID NO: 6562 - protein, 6 aa, synthetic construct
  REGION 1..6: note = Synthetic Construct
AKAYHK

SEQ ID NO: 6563 - protein, 6 aa, synthetic construct
  REGION 1..6: note = Synthetic Construct
AKAYIK

SEQ ID NO: 6564 - protein, 6 aa, synthetic construct
  REGION 1..6: note = Synthetic Construct
AKAYLK

SEQ ID NO: 6565 - protein, 6 aa, synthetic construct
  REGION 1..6: note = Synthetic Construct
AKAYNK

SEQ ID NO: 6566 - protein, 6 aa, synthetic construct
  REGION 1..6: note = Synthetic Construct
AKAYQK

SEQ ID NO: 6567 - protein, 6 aa, synthetic construct
  REGION 1..6: note = Synthetic Construct
AKAYRK

SEQ ID NO: 6568 - protein, 6 aa, synthetic construct
  REGION 1..6: note = Synthetic Construct
AKAYSK

SEQ ID NO: 6569 - protein, 6 aa, synthetic construct
  REGION 1..6: note = Synthetic Construct
AKAYTK

SEQ ID NO: 6570 - protein, 6 aa, synthetic construct
  REGION 1..6: note = Synthetic Construct
AKAYYK

SEQ ID NO: 6571 - protein, 6 aa, synthetic construct
  REGION 1..6: note = Synthetic Construct
AKDAAK

SEQ ID NO: 6572 - protein, 6 aa, synthetic construct
  REGION 1..6: note = Synthetic Construct
AKDADK

SEQ ID NO: 6573 - protein, 6 aa, synthetic construct
  REGION 1..6: note = Synthetic Construct
AKDAEK

SEQ ID NO: 6574 - protein, 6 aa, synthetic construct
  REGION 1..6: note = Synthetic Construct
AKDAFK

SEQ ID NO: 6575 - protein, 6 aa, synthetic construct
  REGION 1..6: note = Synthetic Construct
AKDAGK

SEQ ID NO: 6576 - protein, 6 aa, synthetic construct
  REGION 1..6: note = Synthetic Construct
AKDAHK

SEQ ID NO: 6577 - protein, 6 aa, synthetic construct
  REGION 1..6: note = Synthetic Construct
AKDAIK

SEQ ID NO: 6578 - protein, 6 aa, synthetic construct
  REGION 1..6: note = Synthetic Construct
AKDALK

SEQ ID NO: 6579 - protein, 6 aa, synthetic construct
  REGION 1..6: note = Synthetic Construct
AKDANK

SEQ ID NO: 6580 - protein, 6 aa, synthetic construct
  REGION 1..6: note = Synthetic Construct
AKDAQK

SEQ ID NO: 6581 - protein, 6 aa, synthetic construct
  REGION 1..6: note = Synthetic Construct
AKDARK

SEQ ID NO: 6582 - protein, 6 aa, synthetic construct
  REGION 1..6: note = Synthetic Construct
AKDASK

SEQ ID NO: 6583 - protein, 6 aa, synthetic construct
  REGION 1..6: note = Synthetic Construct
AKDATK

SEQ ID NO: 6584 - protein, 6 aa, synthetic construct
  REGION 1..6: note = Synthetic Construct
AKDAYK

SEQ ID NO: 6585 - protein, 6 aa, synthetic construct
  REGION 1..6: note = Synthetic Construct
AKDDAK

SEQ ID NO: 6586 - protein, 6 aa, synthetic construct
  REGION 1..6: note = Synthetic Construct
AKDDDK

SEQ ID NO: 6587 - protein, 6 aa, synthetic construct
  REGION 1..6: note = Synthetic Construct
AKDDEK

SEQ ID NO: 6588 - protein, 6 aa, synthetic construct
  REGION 1..6: note = Synthetic Construct
AKDDFK

SEQ ID NO: 6589 - protein, 6 aa, synthetic construct
  REGION 1..6: note = Synthetic Construct
AKDDGK

SEQ ID NO: 6590 - protein, 6 aa, synthetic construct
  REGION 1..6: note = Synthetic Construct
AKDDHK

SEQ ID NO: 6591 - protein, 6 aa, synthetic construct
  REGION 1..6: note = Synthetic Construct
AKDDIK

SEQ ID NO: 6592 - protein, 6 aa, synthetic construct
  REGION 1..6: note = Synthetic Construct
AKDDLK

SEQ ID NO: 6593 - protein, 6 aa, synthetic construct
  REGION 1..6: note = Synthetic Construct
AKDDNK

SEQ ID NO: 6594 - protein, 6 aa, synthetic construct
  REGION 1..6: note = Synthetic Construct
AKDDQK

SEQ ID NO: 6595 - protein, 6 aa, synthetic construct
  REGION 1..6: note = Synthetic Construct
AKDDRK

SEQ ID NO: 6596 - protein, 6 aa, synthetic construct
  REGION 1..6: note = Synthetic Construct
AKDDSK

SEQ ID NO: 6597 - protein, 6 aa, synthetic construct
  REGION 1..6: note = Synthetic Construct
AKDDTK

SEQ ID NO: 6598 - protein, 6 aa, synthetic construct
  REGION 1..6: note = Synthetic Construct
AKDDYK

SEQ ID NO: 6599 - protein, 6 aa, synthetic construct
  REGION 1..6: note = Synthetic Construct
AKDEAK

SEQ ID NO: 6600 - protein, 6 aa, synthetic construct
  REGION 1..6: note = Synthetic Construct
AKDEDK

SEQ ID NO: 6601 - protein, 6 aa, synthetic construct
  REGION 1..6: note = Synthetic Construct
AKDEEK

SEQ ID NO: 6602 - protein, 6 aa, synthetic construct
  REGION 1..6: note = Synthetic Construct
AKDEFK

SEQ ID NO: 6603 - protein, 6 aa, synthetic construct
  REGION 1..6: note = Synthetic Construct
AKDEGK

SEQ ID NO: 6604 - protein, 6 aa, synthetic construct
  REGION 1..6: note = Synthetic Construct
AKDEHK

SEQ ID NO: 6605 - protein, 6 aa, synthetic construct
  REGION 1..6: note = Synthetic Construct
AKDEIK

SEQ ID NO: 6606 - protein, 6 aa, synthetic construct
  REGION 1..6: note = Synthetic Construct
AKDELK

SEQ ID NO: 6607 - protein, 6 aa, synthetic construct
  REGION 1..6: note = Synthetic Construct
AKDENK

SEQ ID NO: 6608 - protein, 6 aa, synthetic construct
  REGION 1..6: note = Synthetic Construct
AKDEQK

SEQ ID NO: 6609 - protein, 6 aa, synthetic construct
  REGION 1..6: note = Synthetic Construct
AKDERK

SEQ ID NO: 6610 - protein, 6 aa, synthetic construct
  REGION 1..6: note = Synthetic Construct
AKDESK

SEQ ID NO: 6611 - protein, 6 aa, synthetic construct
  REGION 1..6: note = Synthetic Construct
AKDETK

SEQ ID NO: 6612 - protein, 6 aa, synthetic construct
  REGION 1..6: note = Synthetic Construct
AKDEYK

SEQ ID NO: 6613 - protein, 6 aa, synthetic construct
  REGION 1..6: note = Synthetic Construct
AKDFAK

SEQ ID NO: 6614 - protein, 6 aa, synthetic construct
  REGION 1..6: note = Synthetic Construct
AKDFDK

SEQ ID NO: 6615 - protein, 6 aa, synthetic construct
  REGION 1..6: note = Synthetic Construct
AKDFEK

SEQ ID NO: 6616 - protein, 6 aa, synthetic construct
  REGION 1..6: note = Synthetic Construct
AKDFFK

SEQ ID NO: 6617 - protein, 6 aa, synthetic construct
  REGION 1..6: note = Synthetic Construct
AKDFGK

SEQ ID NO: 6618 - protein, 6 aa, synthetic construct
  REGION 1..6: note = Synthetic Construct
AKDFHK

SEQ ID NO: 6619 - protein, 6 aa, synthetic construct
  REGION 1..6: note = Synthetic Construct
AKDFIK

SEQ ID NO: 6620 - protein, 6 aa, synthetic construct
  REGION 1..6: note = Synthetic Construct
AKDFLK

SEQ ID NO: 6621 - protein, 6 aa, synthetic construct
  REGION 1..6: note = Synthetic Construct
AKDFNK

SEQ ID NO: 6622 - protein, 6 aa, synthetic construct
  REGION 1..6: note = Synthetic Construct
AKDFQK

SEQ ID NO: 6623 - protein, 6 aa, synthetic construct
  REGION 1..6: note = Synthetic Construct
AKDFRK

SEQ ID NO: 6624 - protein, 6 aa, synthetic construct
  REGION 1..6: note = Synthetic Construct
AKDFSK

SEQ ID NO: 6625 - protein, 6 aa, synthetic construct
  REGION 1..6: note = Synthetic Construct
AKDFTK

SEQ ID NO: 6626 - protein, 6 aa, synthetic construct
  REGION 1..6: note = Synthetic Construct
AKDFYK

SEQ ID NO: 6627 - protein, 6 aa, synthetic construct
  REGION 1..6: note = Synthetic Construct
AKDGAK

SEQ ID NO: 6628 - protein, 6 aa, synthetic construct
  REGION 1..6: note = Synthetic Construct
AKDGDK

SEQ ID NO: 6629 - protein, 6 aa, synthetic construct
  REGION 1..6: note = Synthetic Construct
AKDGEK

SEQ ID NO: 6630 - protein, 6 aa, synthetic construct
  REGION 1..6: note = Synthetic Construct
AKDGFK

SEQ ID NO: 6631 - protein, 6 aa, synthetic construct
  REGION 1..6: note = Synthetic Construct
AKDGGK

SEQ ID NO: 6632 - protein, 6 aa, synthetic construct
  REGION 1..6: note = Synthetic Construct
AKDGHK

SEQ ID NO: 6633 - protein, 6 aa, synthetic construct
  REGION 1..6: note = Synthetic Construct
AKDGIK

SEQ ID NO: 6634 - protein, 6 aa, synthetic construct
  REGION 1..6: note = Synthetic Construct
AKDGLK

SEQ ID NO: 6635 - protein, 6 aa, synthetic construct
  REGION 1..6: note = Synthetic Construct
AKDGNK

SEQ ID NO: 6636 - protein, 6 aa, synthetic construct
  REGION 1..6: note = Synthetic Construct
AKDGQK

SEQ ID NO: 6637 - protein, 6 aa, synthetic construct
  REGION 1..6: note = Synthetic Construct
AKDGRK

SEQ ID NO: 6638 - protein, 6 aa, synthetic construct
  REGION 1..6: note = Synthetic Construct
AKDGSK

SEQ ID NO: 6639 - protein, 6 aa, synthetic construct
  REGION 1..6: note = Synthetic Construct
AKDGTK

SEQ ID NO: 6640 - protein, 6 aa, synthetic construct
  REGION 1..6: note = Synthetic Construct
AKDGYK

SEQ ID NO: 6641 - protein, 6 aa, synthetic construct
  REGION 1..6: note = Synthetic Construct
AKDHAK

SEQ ID NO: 6642 - protein, 6 aa, synthetic construct
  REGION 1..6: note = Synthetic Construct
AKDHDK

SEQ ID NO: 6643 - protein, 6 aa, synthetic construct
  REGION 1..6: note = Synthetic Construct
AKDHEK

SEQ ID NO: 6644 - protein, 6 aa, synthetic construct
  REGION 1..6: note = Synthetic Construct
AKDHFK

SEQ ID NO: 6645 - protein, 6 aa, synthetic construct
  REGION 1..6: note = Synthetic Construct
AKDHGK

SEQ ID NO: 6646 - protein, 6 aa, synthetic construct
  REGION 1..6: note = Synthetic Construct
AKDHHK

SEQ ID NO: 6647 - protein, 6 aa, synthetic construct
  REGION 1..6: note = Synthetic Construct
AKDHIK

SEQ ID NO: 6648 - protein, 6 aa, synthetic construct
  REGION 1..6: note = Synthetic Construct
AKDHLK

SEQ ID NO: 6649 - protein, 6 aa, synthetic construct
  REGION 1..6: note = Synthetic Construct
AKDHNK

SEQ ID NO: 6650 - protein, 6 aa, synthetic construct
  REGION 1..6: note = Synthetic Construct
AKDHQK

SEQ ID NO: 6651 - protein, 6 aa, synthetic construct
  REGION 1..6: note = Synthetic Construct
AKDHRK

SEQ ID NO: 6652 - protein, 6 aa, synthetic construct
  REGION 1..6: note = Synthetic Construct
AKDHSK

SEQ ID NO: 6653 - protein, 6 aa, synthetic construct
  REGION 1..6: note = Synthetic Construct
AKDHTK

SEQ ID NO: 6654 - protein, 6 aa, synthetic construct
  REGION 1..6: note = Synthetic Construct
AKDHYK

SEQ ID NO: 6655 - protein, 6 aa, synthetic construct
  REGION 1..6: note = Synthetic Construct
AKDIAK

SEQ ID NO: 6656 - protein, 6 aa, synthetic construct
  REGION 1..6: note = Synthetic Construct
AKDIDK

SEQ ID NO: 6657 - protein, 6 aa, synthetic construct
  REGION 1..6: note = Synthetic Construct
AKDIEK

SEQ ID NO: 6658 - protein, 6 aa, synthetic construct
  REGION 1..6: note = Synthetic Construct
AKDIFK

SEQ ID NO: 6659 - protein, 6 aa, synthetic construct
  REGION 1..6: note = Synthetic Construct
AKDIGK

SEQ ID NO: 6660 - protein, 6 aa, synthetic construct
  REGION 1..6: note = Synthetic Construct
AKDIHK

SEQ ID NO: 6661 - protein, 6 aa, synthetic construct
  REGION 1..6: note = Synthetic Construct
AKDIIK

SEQ ID NO: 6662 - protein, 6 aa, synthetic construct
  REGION 1..6: note = Synthetic Construct
AKDILK

SEQ ID NO: 6663 - protein, 6 aa, synthetic construct
  REGION 1..6: note = Synthetic Construct
AKDINK

SEQ ID NO: 6664 - protein, 6 aa, synthetic construct
  REGION 1..6: note = Synthetic Construct
AKDIQK

SEQ ID NO: 6665 - protein, 6 aa, synthetic construct
  REGION 1..6: note = Synthetic Construct
AKDIRK

SEQ ID NO: 6666 - protein, 6 aa, synthetic construct
  REGION 1..6: note = Synthetic Construct
AKDISK

SEQ ID NO: 6667 - protein, 6 aa, synthetic construct
  REGION 1..6: note = Synthetic Construct
AKDITK

SEQ ID NO: 6668 - protein, 6 aa, synthetic construct
  REGION 1..6: note = Synthetic Construct
AKDIYK

SEQ ID NO: 6669 - protein, 6 aa, synthetic construct
  REGION 1..6: note = Synthetic Construct
AKDLAK

SEQ ID NO: 6670 - protein, 6 aa, synthetic construct
  REGION 1..6: note = Synthetic Construct
AKDLDK

SEQ ID NO: 6671 - protein, 6 aa, synthetic construct
  REGION 1..6: note = Synthetic Construct
AKDLEK

SEQ ID NO: 6672 - protein, 6 aa, synthetic construct
  REGION 1..6: note = Synthetic Construct
AKDLFK

SEQ ID NO: 6673 - protein, 6 aa, synthetic construct
  REGION 1..6: note = Synthetic Construct
AKDLGK

SEQ ID NO: 6674 - protein, 6 aa, synthetic construct
  REGION 1..6: note = Synthetic Construct
AKDLHK

SEQ ID NO: 6675 - protein, 6 aa, synthetic construct
  REGION 1..6: note = Synthetic Construct
AKDLIK

SEQ ID NO: 6676 - protein, 6 aa, synthetic construct
  REGION 1..6: note = Synthetic Construct
AKDLLK

SEQ ID NO: 6677 - protein, 6 aa, synthetic construct
  REGION 1..6: note = Synthetic Construct
AKDLNK

SEQ ID NO: 6678 - protein, 6 aa, synthetic construct
  REGION 1..6: note = Synthetic Construct
AKDLQK

SEQ ID NO: 6679 - protein, 6 aa, synthetic construct
  REGION 1..6: note = Synthetic Construct
AKDLRK

SEQ ID NO: 6680 - protein, 6 aa, synthetic construct
  REGION 1..6: note = Synthetic Construct
AKDLSK

SEQ ID NO: 6681 - protein, 6 aa, synthetic construct
  REGION 1..6: note = Synthetic Construct
AKDLTK

SEQ ID NO: 6682 - protein, 6 aa, synthetic construct
  REGION 1..6: note = Synthetic Construct
AKDLYK

SEQ ID NO: 6683 - protein, 6 aa, synthetic construct
  REGION 1..6: note = Synthetic Construct
AKDNAK

SEQ ID NO: 6684 - protein, 6 aa, synthetic construct
  REGION 1..6: note = Synthetic Construct
AKDNDK

SEQ ID NO: 6685 - protein, 6 aa, synthetic construct
  REGION 1..6: note = Synthetic Construct
AKDNEK

SEQ ID NO: 6686 - protein, 6 aa, synthetic construct
  REGION 1..6: note = Synthetic Construct
AKDNFK

SEQ ID NO: 6687 - protein, 6 aa, synthetic construct
  REGION 1..6: note = Synthetic Construct
AKDNGK

SEQ ID NO: 6688 - protein, 6 aa, synthetic construct
  REGION 1..6: note = Synthetic Construct
AKDNHK

SEQ ID NO: 6689 - protein, 6 aa, synthetic construct
  REGION 1..6: note = Synthetic Construct
AKDNIK

SEQ ID NO: 6690 - protein, 6 aa, synthetic construct
  REGION 1..6: note = Synthetic Construct
AKDNLK

SEQ ID NO: 6691 - protein, 6 aa, synthetic construct
  REGION 1..6: note = Synthetic Construct
AKDNNK

SEQ ID NO: 6692 - protein, 6 aa, synthetic construct
  REGION 1..6: note = Synthetic Construct
AKDNQK

SEQ ID NO: 6693 - protein, 6 aa, synthetic construct
  REGION 1..6: note = Synthetic Construct
AKDNRK

SEQ ID NO: 6694 - protein, 6 aa, synthetic construct
  REGION 1..6: note = Synthetic Construct
AKDNSK

SEQ ID NO: 6695 - protein, 6 aa, synthetic construct
  REGION 1..6: note = Synthetic Construct
AKDNTK

SEQ ID NO: 6696 - protein, 6 aa, synthetic construct
  REGION 1..6: note = Synthetic Construct
AKDNYK

SEQ ID NO: 6697 - protein, 6 aa, synthetic construct
  REGION 1..6: note = Synthetic Construct
AKDQAK

SEQ ID NO: 6698 - protein, 6 aa, synthetic construct
  REGION 1..6: note = Synthetic Construct
AKDQDK

SEQ ID NO: 6699 - protein, 6 aa, synthetic construct
  REGION 1..6: note = Synthetic Construct
AKDQEK

SEQ ID NO: 6700 - protein, 6 aa, synthetic construct
  REGION 1..6: note = Synthetic Construct
AKDQFK

SEQ ID NO: 6701 - protein, 6 aa, synthetic construct
  REGION 1..6: note = Synthetic Construct
AKDQGK

SEQ ID NO: 6702 - protein, 6 aa, synthetic construct
  REGION 1..6: note = Synthetic Construct
AKDQHK

SEQ ID NO: 6703 - protein, 6 aa, synthetic construct
  REGION 1..6: note = Synthetic Construct
AKDQIK

SEQ ID NO: 6704 - protein, 6 aa, synthetic construct
  REGION 1..6: note = Synthetic Construct
AKDQLK

SEQ ID NO: 6705 - protein, 6 aa, synthetic construct
  REGION 1..6: note = Synthetic Construct
AKDQNK

SEQ ID NO: 6706 - protein, 6 aa, synthetic construct
  REGION 1..6: note = Synthetic Construct
AKDQQK

SEQ ID NO: 6707 - protein, 6 aa, synthetic construct
  REGION 1..6: note = Synthetic Construct
AKDQRK

SEQ ID NO: 6708 - protein, 6 aa, synthetic construct
  REGION 1..6: note = Synthetic Construct
AKDQSK

SEQ ID NO: 6709 - protein, 6 aa, synthetic construct
  REGION 1..6: note = Synthetic Construct
AKDQTK

SEQ ID NO: 6710 - protein, 6 aa, synthetic construct
  REGION 1..6: note = Synthetic Construct
AKDQYK

SEQ ID NO: 6711 - protein, 6 aa, synthetic construct
  REGION 1..6: note = Synthetic Construct
AKDRAK

SEQ ID NO: 6712 - protein, 6 aa, synthetic construct
  REGION 1..6: note = Synthetic Construct
AKDRDK

SEQ ID NO: 6713 - protein, 6 aa, synthetic construct
  REGION 1..6: note = Synthetic Construct
AKDREK

SEQ ID NO: 6714 - protein, 6 aa, synthetic construct
  REGION 1..6: note = Synthetic Construct
AKDRFK

SEQ ID NO: 6715 - protein, 6 aa, synthetic construct
  REGION 1..6: note = Synthetic Construct
AKDRGK

SEQ ID NO: 6716 - protein, 6 aa, synthetic construct
  REGION 1..6: note = Synthetic Construct
AKDRHK

SEQ ID NO: 6717 - protein, 6 aa, synthetic construct
  REGION 1..6: note = Synthetic Construct
AKDRIK

SEQ ID NO: 6718 - protein, 6 aa, synthetic construct
  REGION 1..6: note = Synthetic Construct
AKDRLK

SEQ ID NO: 6719 - protein, 6 aa, synthetic construct
  REGION 1..6: note = Synthetic Construct
AKDRNK

SEQ ID NO: 6720 - protein, 6 aa, synthetic construct
  REGION 1..6: note = Synthetic Construct
AKDRQK

SEQ ID NO: 6721 - protein, 6 aa, synthetic construct
  REGION 1..6: note = Synthetic Construct
AKDRRK

SEQ ID NO: 6722 - protein, 6 aa, synthetic construct
  REGION 1..6: note = Synthetic Construct
AKDRSK

SEQ ID NO: 6723 - protein, 6 aa, synthetic construct
  REGION 1..6: note = Synthetic Construct
AKDRTK

SEQ ID NO: 6724 - protein, 6 aa, synthetic construct
  REGION 1..6: note = Synthetic Construct
AKDRYK

SEQ ID NO: 6725 - protein, 6 aa, synthetic construct
  REGION 1..6: note = Synthetic Construct
AKDSAK

SEQ ID NO: 6726 - protein, 6 aa, synthetic construct
  REGION 1..6: note = Synthetic Construct
AKDSDK

SEQ ID NO: 6727 - protein, 6 aa, synthetic construct
  REGION 1..6: note = Synthetic Construct
AKDSEK

SEQ ID NO: 6728 - protein, 6 aa, synthetic construct
  REGION 1..6: note = Synthetic Construct
AKDSFK

SEQ ID NO: 6729 - protein, 6 aa, synthetic construct
  REGION 1..6: note = Synthetic Construct
AKDSGK

SEQ ID NO: 6730 - protein, 6 aa, synthetic construct
  REGION 1..6: note = Synthetic Construct
AKDSHK

SEQ ID NO: 6731 - protein, 6 aa, synthetic construct
  REGION 1..6: note = Synthetic Construct
AKDSIK

SEQ ID NO: 6732 - protein, 6 aa, synthetic construct
  REGION 1..6: note = Synthetic Construct
AKDSLK

SEQ ID NO: 6733 - protein, 6 aa, synthetic construct
  REGION 1..6: note = Synthetic Construct
AKDSNK

SEQ ID NO: 6734 - protein, 6 aa, synthetic construct
  REGION 1..6: note = Synthetic Construct
AKDSQK

SEQ ID NO: 6735 - protein, 6 aa, synthetic construct
  REGION 1..6: note = Synthetic Construct
AKDSRK

SEQ ID NO: 6736 - protein, 6 aa, synthetic construct
  REGION 1..6: note = Synthetic Construct
AKDSSK

SEQ ID NO: 6737 - protein, 6 aa, synthetic construct
  REGION 1..6: note = Synthetic Construct
AKDSTK

SEQ ID NO: 6738 - protein, 6 aa, synthetic construct
  REGION 1..6: note = Synthetic Construct
AKDSYK

SEQ ID NO: 6739 - protein, 6 aa, synthetic construct
  REGION 1..6: note = Synthetic Construct
AKDTAK

SEQ ID NO: 6740 - protein, 6 aa, synthetic construct
  REGION 1..6: note = Synthetic Construct
AKDTDK

SEQ ID NO: 6741 - protein, 6 aa, synthetic construct
  REGION 1..6: note = Synthetic Construct
AKDTEK

SEQ ID NO: 6742 - protein, 6 aa, synthetic construct
  REGION 1..6: note = Synthetic Construct
AKDTFK

SEQ ID NO: 6743 - protein, 6 aa, synthetic construct
  REGION 1..6: note = Synthetic Construct
AKDTGK

SEQ ID NO: 6744 - protein, 6 aa, synthetic construct
  REGION 1..6: note = Synthetic Construct
AKDTHK

SEQ ID NO: 6745 - protein, 6 aa, synthetic construct
  REGION 1..6: note = Synthetic Construct
AKDTIK

SEQ ID NO: 6746 - protein, 6 aa, synthetic construct
  REGION 1..6: note = Synthetic Construct
AKDTLK

SEQ ID NO: 6747 - protein, 6 aa, synthetic construct
  REGION 1..6: note = Synthetic Construct
AKDTNK

SEQ ID NO: 6748 - protein, 6 aa, synthetic construct
  REGION 1..6: note = Synthetic Construct
AKDTQK

SEQ ID NO: 6749 - protein, 6 aa, synthetic construct
  REGION 1..6: note = Synthetic Construct
AKDTRK

SEQ ID NO: 6750 - protein, 6 aa, synthetic construct
  REGION 1..6: note = Synthetic Construct
AKDTSK

SEQ ID NO: 6751 - protein, 6 aa, synthetic construct
  REGION 1..6: note = Synthetic Construct
AKDTTK

SEQ ID NO: 6752 - protein, 6 aa, synthetic construct
  REGION 1..6: note = Synthetic Construct
AKDTYK

SEQ ID NO: 6753 - protein, 6 aa, synthetic construct
  REGION 1..6: note = Synthetic Construct
AKDYAK

SEQ ID NO: 6754 - protein, 6 aa, synthetic construct
  REGION 1..6: note = Synthetic Construct
AKDYDK

SEQ ID NO: 6755 - protein, 6 aa, synthetic construct
  REGION 1..6: note = Synthetic Construct
AKDYEK

SEQ ID NO: 6756 - protein, 6 aa, synthetic construct
  REGION 1..6: note = Synthetic Construct
AKDYFK

SEQ ID NO: 6757 - protein, 6 aa, synthetic construct
  REGION 1..6: note = Synthetic Construct
AKDYGK

SEQ ID NO: 6758 - protein, 6 aa, synthetic construct
  REGION 1..6: note = Synthetic Construct
AKDYHK

SEQ ID NO: 6759 - protein, 6 aa, synthetic construct
  REGION 1..6: note = Synthetic Construct
AKDYIK

SEQ ID NO: 6760 - protein, 6 aa, synthetic construct
  REGION 1..6: note = Synthetic Construct
AKDYLK

SEQ ID NO: 6761 - protein, 6 aa, synthetic construct
  REGION 1..6: note = Synthetic Construct
AKDYNK

SEQ ID NO: 6762 - protein, 6 aa, synthetic construct
  REGION 1..6: note = Synthetic Construct
AKDYQK

SEQ ID NO: 6763 - protein, 6 aa, synthetic construct
  REGION 1..6: note = Synthetic Construct
AKDYRK

SEQ ID NO: 6764 - protein, 6 aa, synthetic construct
  REGION 1..6: note = Synthetic Construct
AKDYSK

SEQ ID NO: 6765 - protein, 6 aa, synthetic construct
  REGION 1..6: note = Synthetic Construct
AKDYTK

SEQ ID NO: 6766 - protein, 6 aa, synthetic construct
  REGION 1..6: note = Synthetic Construct
AKDYYK

SEQ ID NO: 6767 - protein, 6 aa, synthetic construct
  REGION 1..6: note = Synthetic Construct
AKEAAK

SEQ ID NO: 6768 - protein, 6 aa, synthetic construct
  REGION 1..6: note = Synthetic Construct
AKEADK

SEQ ID NO: 6769 - protein, 6 aa, synthetic construct
  REGION 1..6: note = Synthetic Construct
AKEAEK

SEQ ID NO: 6770 - protein, 6 aa, synthetic construct
  REGION 1..6: note = Synthetic Construct
AKEAFK

SEQ ID NO: 6771 - protein, 6 aa, synthetic construct
  REGION 1..6: note = Synthetic Construct
AKEAGK

SEQ ID NO: 6772 - protein, 6 aa, synthetic construct
  REGION 1..6: note = Synthetic Construct
AKEAHK

SEQ ID NO: 6773 - protein, 6 aa, synthetic construct
  REGION 1..6: note = Synthetic Construct
AKEAIK

SEQ ID NO: 6774 - protein, 6 aa, synthetic construct
  REGION 1..6: note = Synthetic Construct
AKEALK

SEQ ID NO: 6775 - protein, 6 aa, synthetic construct
  REGION 1..6: note = Synthetic Construct
AKEANK

SEQ ID NO: 6776 - protein, 6 aa, synthetic construct
  REGION 1..6: note = Synthetic Construct
AKEAQK

SEQ ID NO: 6777 - protein, 6 aa, synthetic construct
  REGION 1..6: note = Synthetic Construct
AKEARK

SEQ ID NO: 6778 - protein, 6 aa, synthetic construct
  REGION 1..6: note = Synthetic Construct
AKEASK

SEQ ID NO: 6779 - protein, 6 aa, synthetic construct
  REGION 1..6: note = Synthetic Construct
AKEATK

SEQ ID NO: 6780 - protein, 6 aa, synthetic construct
  REGION 1..6: note = Synthetic Construct
AKEAYK

SEQ ID NO: 6781 - protein, 6 aa, synthetic construct
  REGION 1..6: note = Synthetic Construct
AKEDAK

SEQ ID NO: 6782 - protein, 6 aa, synthetic construct
  REGION 1..6: note = Synthetic Construct
AKEDDK

SEQ ID NO: 6783 - protein, 6 aa, synthetic construct
  REGION 1..6: note = Synthetic Construct
AKEDEK

SEQ ID NO: 6784 - protein, 6 aa, synthetic construct
  REGION 1..6: note = Synthetic Construct
AKEDFK

SEQ ID NO: 6785 - protein, 6 aa, synthetic construct
  REGION 1..6: note = Synthetic Construct
AKEDGK

SEQ ID NO: 6786 - protein, 6 aa, synthetic construct
  REGION 1..6: note = Synthetic Construct
AKEDHK

SEQ ID NO: 6787 - protein, 6 aa, synthetic construct
  REGION 1..6: note = Synthetic Construct
AKEDIK

SEQ ID NO: 6788 - protein, 6 aa, synthetic construct
  REGION 1..6: note = Synthetic Construct
AKEDLK

SEQ ID NO: 6789 - protein, 6 aa, synthetic construct
  REGION 1..6: note = Synthetic Construct
AKEDNK

SEQ ID NO: 6790 - protein, 6 aa, synthetic construct
  REGION 1..6: note = Synthetic Construct
AKEDQK

SEQ ID NO: 6791 - protein, 6 aa, synthetic construct
  REGION 1..6: note = Synthetic Construct
AKEDRK

SEQ ID NO: 6792 - protein, 6 aa, synthetic construct
  REGION 1..6: note = Synthetic Construct
AKEDSK

SEQ ID NO: 6793 - protein, 6 aa, synthetic construct
  REGION 1..6: note = Synthetic Construct
AKEDTK

SEQ ID NO: 6794 - protein, 6 aa, synthetic construct
  REGION 1..6: note = Synthetic Construct
AKEDYK

SEQ ID NO: 6795 - protein, 6 aa, synthetic construct
  REGION 1..6: note = Synthetic Construct
AKEEAK

SEQ ID NO: 6796 - protein, 6 aa, synthetic construct
  REGION 1..6: note = Synthetic Construct
AKEEDK

SEQ ID NO: 6797 - protein, 6 aa, synthetic construct
  REGION 1..6: note = Synthetic Construct
AKEEEK

SEQ ID NO: 6798 - protein, 6 aa, synthetic construct
  REGION 1..6: note = Synthetic Construct
AKEEFK

SEQ ID NO: 6799 - protein, 6 aa, synthetic construct
  REGION 1..6: note = Synthetic Construct
AKEEGK

SEQ ID NO: 6800 - protein, 6 aa, synthetic construct
  REGION 1..6: note = Synthetic Construct
AKEEHK

SEQ ID NO: 6801 - protein, 6 aa, synthetic construct
  REGION 1..6: note = Synthetic Construct
AKEEIK

SEQ ID NO: 6802 - protein, 6 aa, synthetic construct
  REGION 1..6: note = Synthetic Construct
AKEELK

SEQ ID NO: 6803 - protein, 6 aa, synthetic construct
  REGION 1..6: note = Synthetic Construct
AKEENK

SEQ ID NO: 6804 - protein, 6 aa, synthetic construct
  REGION 1..6: note = Synthetic Construct
AKEEQK

SEQ ID NO: 6805 - protein, 6 aa, synthetic construct
  REGION 1..6: note = Synthetic Construct
AKEERK

SEQ ID NO: 6806 - protein, 6 aa, synthetic construct
  REGION 1..6: note = Synthetic Construct
AKEESK

SEQ ID NO: 6807 - protein, 6 aa, synthetic construct
  REGION 1..6: note = Synthetic Construct
AKEETK

SEQ ID NO: 6808 - protein, 6 aa, synthetic construct
  REGION 1..6: note = Synthetic Construct
AKEEYK

SEQ ID NO: 6809 - protein, 6 aa, synthetic construct
  REGION 1..6: note = Synthetic Construct
AKEFAK

SEQ ID NO: 6810 - protein, 6 aa, synthetic construct
  REGION 1..6: note = Synthetic Construct
AKEFDK

SEQ ID NO: 6811 - protein, 6 aa, synthetic construct
  REGION 1..6: note = Synthetic Construct
AKEFEK

SEQ ID NO: 6812 - protein, 6 aa, synthetic construct
  REGION 1..6: note = Synthetic Construct
AKEFFK

SEQ ID NO: 6813 - protein, 6 aa, synthetic construct
  REGION 1..6: note = Synthetic Construct
AKEFGK

SEQ ID NO: 6814 - protein, 6 aa, synthetic construct
  REGION 1..6: note = Synthetic Construct
AKEFHK

SEQ ID NO: 6815 - protein, 6 aa, synthetic construct
  REGION 1..6: note = Synthetic Construct
AKEFIK

SEQ ID NO: 6816 - protein, 6 aa, synthetic construct
  REGION 1..6: note = Synthetic Construct
AKEFLK

SEQ ID NO: 6817 - protein, 6 aa, synthetic construct
  REGION 1..6: note = Synthetic Construct
AKEFNK

SEQ ID NO: 6818 - protein, 6 aa, synthetic construct
  REGION 1..6: note = Synthetic Construct
AKEFQK

SEQ ID NO: 6819 - protein, 6 aa, synthetic construct
  REGION 1..6: note = Synthetic Construct
AKEFRK

SEQ ID NO: 6820 - protein, 6 aa, synthetic construct
  REGION 1..6: note = Synthetic Construct
AKEFSK

SEQ ID NO: 6821 - protein, 6 aa, synthetic construct
  REGION 1..6: note = Synthetic Construct
AKEFTK

SEQ ID NO: 6822 - protein, 6 aa, synthetic construct
  REGION 1..6: note = Synthetic Construct
AKEFYK

SEQ ID NO: 6823 - protein, 6 aa, synthetic construct
  REGION 1..6: note = Synthetic Construct
AKEGAK

SEQ ID NO: 6824 - protein, 6 aa, synthetic construct
  REGION 1..6: note = Synthetic Construct
AKEGDK

SEQ ID NO: 6825 - protein, 6 aa, synthetic construct
  REGION 1..6: note = Synthetic Construct
AKEGEK

SEQ ID NO: 6826 - protein, 6 aa, synthetic construct
  REGION 1..6: note = Synthetic Construct
AKEGFK

SEQ ID NO: 6827 - protein, 6 aa, synthetic construct
  REGION 1..6: note = Synthetic Construct
AKEGGK

SEQ ID NO: 6828 - protein, 6 aa, synthetic construct
  REGION 1..6: note = Synthetic Construct
AKEGHK

SEQ ID NO: 6829 - protein, 6 aa, synthetic construct
  REGION 1..6: note = Synthetic Construct
AKEGIK

SEQ ID NO: 6830 - protein, 6 aa, synthetic construct
  REGION 1..6: note = Synthetic Construct
AKEGLK

SEQ ID NO: 6831 - protein, 6 aa, synthetic construct
  REGION 1..6: note = Synthetic Construct
AKEGNK

SEQ ID NO: 6832 - protein, 6 aa, synthetic construct
  REGION 1..6: note = Synthetic Construct
AKEGQK

SEQ ID NO: 6833 - protein, 6 aa, synthetic construct
  REGION 1..6: note = Synthetic Construct
AKEGRK

SEQ ID NO: 6834 - protein, 6 aa, synthetic construct
  REGION 1..6: note = Synthetic Construct
AKEGSK

SEQ ID NO: 6835 - protein, 6 aa, synthetic construct
  REGION 1..6: note = Synthetic Construct
AKEGTK

SEQ ID NO: 6836 - protein, 6 aa, synthetic construct
  REGION 1..6: note = Synthetic Construct
AKEGYK

SEQ ID NO: 6837 - protein, 6 aa, synthetic construct
  REGION 1..6: note = Synthetic Construct
AKEHAK

SEQ ID NO: 6838 - protein, 6 aa, synthetic construct
  REGION 1..6: note = Synthetic Construct
AKEHDK

SEQ ID NO: 6839 - protein, 6 aa, synthetic construct
  REGION 1..6: note = Synthetic Construct
AKEHEK

SEQ ID NO: 6840 - protein, 6 aa, synthetic construct
  REGION 1..6: note = Synthetic Construct
AKEHFK

SEQ ID NO: 6841 - protein, 6 aa, synthetic construct
  REGION 1..6: note = Synthetic Construct
AKEHGK

SEQ ID NO: 6842 - protein, 6 aa, synthetic construct
  REGION 1..6: note = Synthetic Construct
AKEHHK

SEQ ID NO: 6843 - protein, 6 aa, synthetic construct
  REGION 1..6: note = Synthetic Construct
AKEHIK

SEQ ID NO: 6844 - protein, 6 aa, synthetic construct
  REGION 1..6: note = Synthetic Construct
AKEHLK

SEQ ID NO: 6845 - protein, 6 aa, synthetic construct
  REGION 1..6: note = Synthetic Construct
AKEHNK

SEQ ID NO: 6846 - protein, 6 aa, synthetic construct
  REGION 1..6: note = Synthetic Construct
AKEHQK

SEQ ID NO: 6847 - protein, 6 aa, synthetic construct
  REGION 1..6: note = Synthetic Construct
AKEHRK

SEQ ID NO: 6848 - protein, 6 aa, synthetic construct
  REGION 1..6: note = Synthetic Construct
AKEHSK

SEQ ID NO: 6849 - protein, 6 aa, synthetic construct
  REGION 1..6: note = Synthetic Construct
AKEHTK

SEQ ID NO: 6850 - protein, 6 aa, synthetic construct
  REGION 1..6: note = Synthetic Construct
AKEHYK

SEQ ID NO: 6851 - protein, 6 aa, synthetic construct
  REGION 1..6: note = Synthetic Construct
AKEIAK

SEQ ID NO: 6852 - protein, 6 aa, synthetic construct
  REGION 1..6: note = Synthetic Construct
AKEIDK

SEQ ID NO: 6853 - protein, 6 aa, synthetic construct
  REGION 1..6: note = Synthetic Construct
AKEIEK

SEQ ID NO: 6854 - protein, 6 aa, synthetic construct
  REGION 1..6: note = Synthetic Construct
AKEIFK

SEQ ID NO: 6855 - protein, 6 aa, synthetic construct
  REGION 1..6: note = Synthetic Construct
AKEIGK

SEQ ID NO: 6856 - protein, 6 aa, synthetic construct
  REGION 1..6: note = Synthetic Construct
AKEIHK

SEQ ID NO: 6857 - protein, 6 aa, synthetic construct
  REGION 1..6: note = Synthetic Construct
AKEIIK

SEQ ID NO: 6858 - protein, 6 aa, synthetic construct
  REGION 1..6: note = Synthetic Construct
AKEILK

SEQ ID NO: 6859 - protein, 6 aa, synthetic construct
  REGION 1..6: note = Synthetic Construct
AKEINK

SEQ ID NO: 6860 - protein, 6 aa, synthetic construct
  REGION 1..6: note = Synthetic Construct
AKEIQK

SEQ ID NO: 6861 - protein, 6 aa, synthetic construct
  REGION 1..6: note = Synthetic Construct
AKEIRK

SEQ ID NO: 6862 - protein, 6 aa, synthetic construct
  REGION 1..6: note = Synthetic Construct
AKEISK

SEQ ID NO: 6863 - protein, 6 aa, synthetic construct
  REGION 1..6: note = Synthetic Construct
AKEITK

SEQ ID NO: 6864 - protein, 6 aa, synthetic construct
  REGION 1..6: note = Synthetic Construct
AKEIYK

SEQ ID NO: 6865 - protein, 6 aa, synthetic construct
  REGION 1..6: note = Synthetic Construct
AKELAK

SEQ ID NO: 6866 - protein, 6 aa, synthetic construct
  REGION 1..6: note = Synthetic Construct
AKELDK

SEQ ID NO: 6867 - protein, 6 aa, synthetic construct
  REGION 1..6: note = Synthetic Construct
AKELEK

SEQ ID NO: 6868 - protein, 6 aa, synthetic construct
  REGION 1..6: note = Synthetic Construct
AKELFK

SEQ ID NO: 6869 - protein, 6 aa, synthetic construct
  REGION 1..6: note = Synthetic Construct
AKELGK

SEQ ID NO: 6870 - protein, 6 aa, synthetic construct
  REGION 1..6: note = Synthetic Construct
AKELHK

SEQ ID NO: 6871 - protein, 6 aa, synthetic construct
  REGION 1..6: note = Synthetic Construct
AKELIK

SEQ ID NO: 6872 - protein, 6 aa, synthetic construct
  REGION 1..6: note = Synthetic Construct
AKELLK

SEQ ID NO: 6873 - protein, 6 aa, synthetic construct
  REGION 1..6: note = Synthetic Construct
AKELNK

SEQ ID NO: 6874 - protein, 6 aa, synthetic construct
  REGION 1..6: note = Synthetic Construct
AKELQK

SEQ ID NO: 6875 - protein, 6 aa, synthetic construct
  REGION 1..6: note = Synthetic Construct
AKELRK

SEQ ID NO: 6876 - protein, 6 aa, synthetic construct
  REGION 1..6: note = Synthetic Construct
AKELSK

SEQ ID NO: 6877 - protein, 6 aa, synthetic construct
  REGION 1..6: note = Synthetic Construct
AKELTK

SEQ ID NO: 6878 - protein, 6 aa, synthetic construct
  REGION 1..6: note = Synthetic Construct
AKELYK

SEQ ID NO: 6879 - protein, 6 aa, synthetic construct
  REGION 1..6: note = Synthetic Construct
AKENAK

SEQ ID NO: 6880 - protein, 6 aa, synthetic construct
  REGION 1..6: note = Synthetic Construct
AKENDK

SEQ ID NO: 6881 - protein, 6 aa, synthetic construct
  REGION 1..6: note = Synthetic Construct
AKENEK

SEQ ID NO: 6882 - protein, 6 aa, synthetic construct
  REGION 1..6: note = Synthetic Construct
AKENFK

SEQ ID NO: 6883 - protein, 6 aa, synthetic construct
  REGION 1..6: note = Synthetic Construct
AKENGK

SEQ ID NO: 6884 - protein, 6 aa, synthetic construct
  REGION 1..6: note = Synthetic Construct
AKENHK

SEQ ID NO: 6885 - protein, 6 aa, synthetic construct
  REGION 1..6: note = Synthetic Construct
AKENIK

SEQ ID NO: 6886 - protein, 6 aa, synthetic construct
  REGION 1..6: note = Synthetic Construct
AKENLK

SEQ ID NO: 6887 - protein, 6 aa, synthetic construct
  REGION 1..6: note = Synthetic Construct
AKENNK

SEQ ID NO: 6888 - protein, 6 aa, synthetic construct
  REGION 1..6: note = Synthetic Construct
AKENQK

SEQ ID NO: 6889 - protein, 6 aa, synthetic construct
  REGION 1..6: note = Synthetic Construct
AKENRK

SEQ ID NO: 6890 - protein, 6 aa, synthetic construct
  REGION 1..6: note = Synthetic Construct
AKENSK

SEQ ID NO: 6891 - protein, 6 aa, synthetic construct
  REGION 1..6: note = Synthetic Construct
AKENTK

SEQ ID NO: 6892 - protein, 6 aa, synthetic construct
  REGION 1..6: note = Synthetic Construct
AKENYK

SEQ ID NO: 6893 - protein, 6 aa, synthetic construct
  REGION 1..6: note = Synthetic Construct
AKEQAK

SEQ ID NO: 6894 - protein, 6 aa, synthetic construct
  REGION 1..6: note = Synthetic Construct
AKEQDK

SEQ ID NO: 6895 - protein, 6 aa, synthetic construct
  REGION 1..6: note = Synthetic Construct
AKEQEK

SEQ ID NO: 6896 - protein, 6 aa, synthetic construct
  REGION 1..6: note = Synthetic Construct
AKEQFK

SEQ ID NO: 6897 - protein, 6 aa, synthetic construct
  REGION 1..6: note = Synthetic Construct
AKEQGK

SEQ ID NO: 6898 - protein, 6 aa, synthetic construct
  REGION 1..6: note = Synthetic Construct
AKEQHK

SEQ ID NO: 6899 - protein, 6 aa, synthetic construct
  REGION 1..6: note = Synthetic Construct
AKEQIK

SEQ ID NO: 6900 - protein, 6 aa, synthetic construct
  REGION 1..6: note = Synthetic Construct
AKEQLK

SEQ ID NO: 6901 - protein, 6 aa, synthetic construct
  REGION 1..6: note = Synthetic Construct
AKEQNK

SEQ ID NO: 6902 - protein, 6 aa, synthetic construct
  REGION 1..6: note = Synthetic Construct
AKEQQK

SEQ ID NO: 6903 - protein, 6 aa, synthetic construct
  REGION 1..6: note = Synthetic Construct
AKEQRK

SEQ ID NO: 6904 - protein, 6 aa, synthetic construct
  REGION 1..6: note = Synthetic Construct
AKEQSK

SEQ ID NO: 6905 - protein, 6 aa, synthetic construct
  REGION 1..6: note = Synthetic Construct
AKEQTK

SEQ ID NO: 6906 - protein, 6 aa, synthetic construct
  REGION 1..6: note = Synthetic Construct
AKEQYK

SEQ ID NO: 6907 - protein, 6 aa, synthetic construct
  REGION 1..6: note = Synthetic Construct
AKERAK

SEQ ID NO: 6908 - protein, 6 aa, synthetic construct
  REGION 1..6: note = Synthetic Construct
AKERDK

SEQ ID NO: 6909 - protein, 6 aa, synthetic construct
  REGION 1..6: note = Synthetic Construct
AKEREK

SEQ ID NO: 6910 - protein, 6 aa, synthetic construct
  REGION 1..6: note = Synthetic Construct
AKERFK

SEQ ID NO: 6911 - protein, 6 aa, synthetic construct
  REGION 1..6: note = Synthetic Construct
AKERGK

SEQ ID NO: 6912 - protein, 6 aa, synthetic construct
  REGION 1..6: note = Synthetic Construct
AKERHK

SEQ ID NO: 6913 - protein, 6 aa, synthetic construct
  REGION 1..6: note = Synthetic Construct
AKERIK

SEQ ID NO: 6914 - protein, 6 aa, synthetic construct
  REGION 1..6: note = Synthetic Construct
AKERLK

SEQ ID NO: 6915 - protein, 6 aa, synthetic construct
  REGION 1..6: note = Synthetic Construct
AKERNK

SEQ ID NO: 6916 - protein, 6 aa, synthetic construct
  REGION 1..6: note = Synthetic Construct
AKERQK

SEQ ID NO: 6917 - protein, 6 aa, synthetic construct
  REGION 1..6: note = Synthetic Construct
AKERRK

SEQ ID NO: 6918 - protein, 6 aa, synthetic construct
  REGION 1..6: note = Synthetic Construct
AKERSK

SEQ ID NO: 6919 - protein, 6 aa, synthetic construct
  REGION 1..6: note = Synthetic Construct
AKERTK

SEQ ID NO: 6920 - protein, 6 aa, synthetic construct
  REGION 1..6: note = Synthetic Construct
AKERYK

SEQ ID NO: 6921 - protein, 6 aa, synthetic construct
  REGION 1..6: note = Synthetic Construct
AKESAK

SEQ ID NO: 6922 - protein, 6 aa, synthetic construct
  REGION 1..6: note = Synthetic Construct
AKESDK

SEQ ID NO: 6923 - protein, 6 aa, synthetic construct
  REGION 1..6: note = Synthetic Construct
AKESEK

SEQ ID NO: 6924 - protein, 6 aa, synthetic construct
  REGION 1..6: note = Synthetic Construct
AKESFK

SEQ ID NO: 6925 - protein, 6 aa, synthetic construct
  REGION 1..6: note = Synthetic Construct
AKESGK

SEQ ID NO: 6926 - protein, 6 aa, synthetic construct
  REGION 1..6: note = Synthetic Construct
AKESHK

SEQ ID NO: 6927 - protein, 6 aa, synthetic construct
  REGION 1..6: note = Synthetic Construct
AKESIK

SEQ ID NO: 6928 - protein, 6 aa, synthetic construct
  REGION 1..6: note = Synthetic Construct
AKESLK

SEQ ID NO: 6929 - protein, 6 aa, synthetic construct
  REGION 1..6: note = Synthetic Construct
AKESNK

SEQ ID NO: 6930 - protein, 6 aa, synthetic construct
  REGION 1..6: note = Synthetic Construct
AKESQK

SEQ ID NO: 6931 - protein, 6 aa, synthetic construct
  REGION 1..6: note = Synthetic Construct
AKESRK

SEQ ID NO: 6932 - protein, 6 aa, synthetic construct
  REGION 1..6: note = Synthetic Construct
AKESSK

SEQ ID NO: 6933 - protein, 6 aa, synthetic construct
  REGION 1..6: note = Synthetic Construct
AKESTK

SEQ ID NO: 6934 - protein, 6 aa, synthetic construct
  REGION 1..6: note = Synthetic Construct
AKESYK

SEQ ID NO: 6935 - protein, 6 aa, synthetic construct
  REGION 1..6: note = Synthetic Construct
AKETAK

SEQ ID NO: 6936 - protein, 6 aa, synthetic construct
  REGION 1..6: note = Synthetic Construct
AKETDK

SEQ ID NO: 6937 - protein, 6 aa, synthetic construct
  REGION 1..6: note = Synthetic Construct
AKETEK

SEQ ID NO: 6938 - protein, 6 aa, synthetic construct
  REGION 1..6: note = Synthetic Construct
AKETFK

SEQ ID NO: 6939 - protein, 6 aa, synthetic construct
  REGION 1..6: note = Synthetic Construct
AKETGK

SEQ ID NO: 6940 - protein, 6 aa, synthetic construct
  REGION 1..6: note = Synthetic Construct
AKETHK

SEQ ID NO: 6941 - protein, 6 aa, synthetic construct
  REGION 1..6: note = Synthetic Construct
AKETIK

SEQ ID NO: 6942 - protein, 6 aa, synthetic construct
  REGION 1..6: note = Synthetic Construct
AKETLK

SEQ ID NO: 6943 - protein, 6 aa, synthetic construct
  REGION 1..6: note = Synthetic Construct
AKETNK

SEQ ID NO: 6944 - protein, 6 aa, synthetic construct
  REGION 1..6: note = Synthetic Construct
AKETQK

SEQ ID NO: 6945 - protein, 6 aa, synthetic construct
  REGION 1..6: note = Synthetic Construct
AKETRK

SEQ ID NO: 6946 - protein, 6 aa, synthetic construct
  REGION 1..6: note = Synthetic Construct
AKETSK

SEQ ID NO: 6947 - protein, 6 aa, synthetic construct
  REGION 1..6: note = Synthetic Construct
AKETTK

SEQ ID NO: 6948 - protein, 6 aa, synthetic construct
  REGION 1..6: note = Synthetic Construct
AKETYK

SEQ ID NO: 6949 - protein, 6 aa, synthetic construct
  REGION 1..6: note = Synthetic Construct
AKEYAK

SEQ ID NO: 6950 - protein, 6 aa, synthetic construct
  REGION 1..6: note = Synthetic Construct
AKEYDK

SEQ ID NO: 6951 - protein, 6 aa, synthetic construct
  REGION 1..6: note = Synthetic Construct
AKEYEK

SEQ ID NO: 6952 - protein, 6 aa, synthetic construct
  REGION 1..6: note = Synthetic Construct
AKEYFK

SEQ ID NO: 6953 - protein, 6 aa, synthetic construct
  REGION 1..6: note = Synthetic Construct
AKEYGK

SEQ ID NO: 6954 - protein, 6 aa, synthetic construct
  REGION 1..6: note = Synthetic Construct
AKEYHK

SEQ ID NO: 6955 - protein, 6 aa, synthetic construct
  REGION 1..6: note = Synthetic Construct
AKEYIK

SEQ ID NO: 6956 - protein, 6 aa, synthetic construct
  REGION 1..6: note = Synthetic Construct
AKEYLK

SEQ ID NO: 6957 - protein, 6 aa, synthetic construct
  REGION 1..6: note = Synthetic Construct
AKEYNK

SEQ ID NO: 6958 - protein, 6 aa, synthetic construct
  REGION 1..6: note = Synthetic Construct
AKEYQK

SEQ ID NO: 6959 - protein, 6 aa, synthetic construct
  REGION 1..6: note = Synthetic Construct
AKEYRK

SEQ ID NO: 6960 - protein, 6 aa, synthetic construct
  REGION 1..6: note = Synthetic Construct
AKEYSK

SEQ ID NO: 6961 - protein, 6 aa, synthetic construct
  REGION 1..6: note = Synthetic Construct
AKEYTK

SEQ ID NO: 6962 - protein, 6 aa, synthetic construct
  REGION 1..6: note = Synthetic Construct
AKEYYK

SEQ ID NO: 6963 - protein, 6 aa, synthetic construct
  REGION 1..6: note = Synthetic Construct
AKFAAK

SEQ ID NO: 6964 - protein, 6 aa, synthetic construct
  REGION 1..6: note = Synthetic Construct
AKFADK

SEQ ID NO: 6965 - protein, 6 aa, synthetic construct
  REGION 1..6: note = Synthetic Construct
AKFAEK

SEQ ID NO: 6966 - protein, 6 aa, synthetic construct
  REGION 1..6: note = Synthetic Construct
AKFAFK

SEQ ID NO: 6967 - protein, 6 aa, synthetic construct
  REGION 1..6: note = Synthetic Construct
AKFAGK

SEQ ID NO: 6968 - protein, 6 aa, synthetic construct
  REGION 1..6: note = Synthetic Construct
AKFAHK

SEQ ID NO: 6969 - protein, 6 aa, synthetic construct
  REGION 1..6: note = Synthetic Construct
AKFAIK

SEQ ID NO: 6970 - protein, 6 aa, synthetic construct
  REGION 1..6: note = Synthetic Construct
AKFALK

SEQ ID NO: 6971 - protein, 6 aa, synthetic construct
  REGION 1..6: note = Synthetic Construct
AKFANK

SEQ ID NO: 6972 - protein, 6 aa, synthetic construct
  REGION 1..6: note = Synthetic Construct
AKFAQK

SEQ ID NO: 6973 - protein, 6 aa, synthetic construct
  REGION 1..6: note = Synthetic Construct
AKFARK

SEQ ID NO: 6974 - protein, 6 aa, synthetic construct
  REGION 1..6: note = Synthetic Construct
AKFASK

SEQ ID NO: 6975 - protein, 6 aa, synthetic construct
  REGION 1..6: note = Synthetic Construct
AKFATK

SEQ ID NO: 6976 - protein, 6 aa, synthetic construct
  REGION 1..6: note = Synthetic Construct
AKFAYK

SEQ ID NO: 6977 - protein, 6 aa, synthetic construct
  REGION 1..6: note = Synthetic Construct
AKFDAK

SEQ ID NO: 6978 - protein, 6 aa, synthetic construct
  REGION 1..6: note = Synthetic Construct
AKFDDK

SEQ ID NO: 6979 - protein, 6 aa, synthetic construct
  REGION 1..6: note = Synthetic Construct
AKFDEK

SEQ ID NO: 6980 - protein, 6 aa, synthetic construct
  REGION 1..6: note = Synthetic Construct
AKFDFK

SEQ ID NO: 6981 - protein, 6 aa, synthetic construct
  REGION 1..6: note = Synthetic Construct
AKFDGK

SEQ ID NO: 6982 - protein, 6 aa, synthetic construct
  REGION 1..6: note = Synthetic Construct
AKFDHK

SEQ ID NO: 6983 - protein, 6 aa, synthetic construct
  REGION 1..6: note = Synthetic Construct
AKFDIK

SEQ ID NO: 6984 - protein, 6 aa, synthetic construct
  REGION 1..6: note = Synthetic Construct
AKFDLK

SEQ ID NO: 6985 - protein, 6 aa, synthetic construct
  REGION 1..6: note = Synthetic Construct
AKFDNK

SEQ ID NO: 6986 - protein, 6 aa, synthetic construct
  REGION 1..6: note = Synthetic Construct
AKFDQK

SEQ ID NO: 6987 - protein, 6 aa, synthetic construct
  REGION 1..6: note = Synthetic Construct
AKFDRK

SEQ ID NO: 6988 - protein, 6 aa, synthetic construct
  REGION 1..6: note = Synthetic Construct
AKFDSK

SEQ ID NO: 6989 - protein, 6 aa, synthetic construct
  REGION 1..6: note = Synthetic Construct
AKFDTK

SEQ ID NO: 6990 - protein, 6 aa, synthetic construct
  REGION 1..6: note = Synthetic Construct
AKFDYK

SEQ ID NO: 6991 - protein, 6 aa, synthetic construct
  REGION 1..6: note = Synthetic Construct
AKFEAK

SEQ ID NO: 6992 - protein, 6 aa, synthetic construct
  REGION 1..6: note = Synthetic Construct
AKFEDK

SEQ ID NO: 6993 - protein, 6 aa, synthetic construct
  REGION 1..6: note = Synthetic Construct
AKFEEK

SEQ ID NO: 6994 - protein, 6 aa, synthetic construct
  REGION 1..6: note = Synthetic Construct
AKFEFK

SEQ ID NO: 6995 - protein, 6 aa, synthetic construct
  REGION 1..6: note = Synthetic Construct
AKFEGK

SEQ ID NO: 6996 - protein, 6 aa, synthetic construct
  REGION 1..6: note = Synthetic Construct
AKFEHK

SEQ ID NO: 6997 - protein, 6 aa, synthetic construct
  REGION 1..6: note = Synthetic Construct
AKFEIK

SEQ ID NO: 6998 - protein, 6 aa, synthetic construct
  REGION 1..6: note = Synthetic Construct
AKFELK

SEQ ID NO: 6999 - protein, 6 aa, synthetic construct
  REGION 1..6: note = Synthetic Construct
AKFENK

SEQ ID NO: 7000 - protein, 6 aa, synthetic construct
  REGION 1..6: note = Synthetic Construct
AKFEQK

SEQ ID NO: 7001 - protein, 6 aa, synthetic construct
  REGION 1..6: note = Synthetic Construct
AKFERK

SEQ ID NO: 7002 - protein, 6 aa, synthetic construct
  REGION 1..6: note = Synthetic Construct
AKFESK

SEQ ID NO: 7003 - protein, 6 aa, synthetic construct
  REGION 1..6: note = Synthetic Construct
AKFETK

SEQ ID NO: 7004 - protein, 6 aa, synthetic construct
  REGION 1..6: note = Synthetic Construct
AKFEYK

SEQ ID NO: 7005 - protein, 6 aa, synthetic construct
  REGION 1..6: note = Synthetic Construct
AKFFAK

SEQ ID NO: 7006 - protein, 6 aa, synthetic construct
  REGION 1..6: note = Synthetic Construct
AKFFDK

SEQ ID NO: 7007 - protein, 6 aa, synthetic construct
  REGION 1..6: note = Synthetic Construct
AKFFEK

SEQ ID NO: 7008 - protein, 6 aa, synthetic construct
  REGION 1..6: note = Synthetic Construct
AKFFFK

SEQ ID NO: 7009 - protein, 6 aa, synthetic construct
  REGION 1..6: note = Synthetic Construct
AKFFGK

SEQ ID NO: 7010 - protein, 6 aa, synthetic construct
  REGION 1..6: note = Synthetic Construct
AKFFHK

SEQ ID NO: 7011 - protein, 6 aa, synthetic construct
  REGION 1..6: note = Synthetic Construct
AKFFIK

SEQ ID NO: 7012 - protein, 6 aa, synthetic construct
  REGION 1..6: note = Synthetic Construct
AKFFLK

SEQ ID NO: 7013 - protein, 6 aa, synthetic construct
  REGION 1..6: note = Synthetic Construct
AKFFNK

SEQ ID NO: 7014 - protein, 6 aa, synthetic construct
  REGION 1..6: note = Synthetic Construct
AKFFQK

SEQ ID NO: 7015 - protein, 6 aa, synthetic construct
  REGION 1..6: note = Synthetic Construct
AKFFRK

SEQ ID NO: 7016 - protein, 6 aa, synthetic construct
  REGION 1..6: note = Synthetic Construct
AKFFSK

SEQ ID NO: 7017 - protein, 6 aa, synthetic construct
  REGION 1..6: note = Synthetic Construct
AKFFTK

SEQ ID NO: 7018 - protein, 6 aa, synthetic construct
  REGION 1..6: note = Synthetic Construct
AKFFYK

SEQ ID NO: 7019 - protein, 6 aa, synthetic construct
  REGION 1..6: note = Synthetic Construct
AKFGAK

SEQ ID NO: 7020 - protein, 6 aa, synthetic construct
  REGION 1..6: note = Synthetic Construct
AKFGDK

SEQ ID NO: 7021 - protein, 6 aa, synthetic construct
  REGION 1..6: note = Synthetic Construct
AKFGEK

SEQ ID NO: 7022 - protein, 6 aa, synthetic construct
  REGION 1..6: note = Synthetic Construct
AKFGFK

SEQ ID NO: 7023 - protein, 6 aa, synthetic construct
  REGION 1..6: note = Synthetic Construct
AKFGGK

SEQ ID NO: 7024 - protein, 6 aa, synthetic construct
  REGION 1..6: note = Synthetic Construct
AKFGHK

SEQ ID NO: 7025 - protein, 6 aa, synthetic construct
  REGION 1..6: note = Synthetic Construct
AKFGIK

SEQ ID NO: 7026 - protein, 6 aa, synthetic construct
  REGION 1..6: note = Synthetic Construct
AKFGLK

SEQ ID NO: 7027 - protein, 6 aa, synthetic construct
  REGION 1..6: note = Synthetic Construct
AKFGNK

SEQ ID NO: 7028 - protein, 6 aa, synthetic construct
  REGION 1..6: note = Synthetic Construct
AKFGQK

SEQ ID NO: 7029 - protein, 6 aa, synthetic construct
  REGION 1..6: note = Synthetic Construct
AKFGRK

SEQ ID NO: 7030 - protein, 6 aa, synthetic construct
  REGION 1..6: note = Synthetic Construct
AKFGSK

SEQ ID NO: 7031 - protein, 6 aa, synthetic construct
  REGION 1..6: note = Synthetic Construct
AKFGTK

SEQ ID NO: 7032 - protein, 6 aa, synthetic construct
  REGION 1..6: note = Synthetic Construct
AKFGYK

SEQ ID NO: 7033 - protein, 6 aa, synthetic construct
  REGION 1..6: note = Synthetic Construct
AKFHAK

SEQ ID NO: 7034 - protein, 6 aa, synthetic construct
  REGION 1..6: note = Synthetic Construct
AKFHDK

SEQ ID NO: 7035 - protein, 6 aa, synthetic construct
  REGION 1..6: note = Synthetic Construct
AKFHEK

SEQ ID NO: 7036 - protein, 6 aa, synthetic construct
  REGION 1..6: note = Synthetic Construct
AKFHFK

SEQ ID NO: 7037 - protein, 6 aa, synthetic construct
  REGION 1..6: note = Synthetic Construct
AKFHGK

SEQ ID NO: 7038 - protein, 6 aa, synthetic construct
  REGION 1..6: note = Synthetic Construct
AKFHHK

SEQ ID NO: 7039 - protein, 6 aa, synthetic construct
  REGION 1..6: note = Synthetic Construct
AKFHIK

SEQ ID NO: 7040 - protein, 6 aa, synthetic construct
  REGION 1..6: note = Synthetic Construct
AKFHLK

SEQ ID NO: 7041 - protein, 6 aa, synthetic construct
  REGION 1..6: note = Synthetic Construct
AKFHNK

SEQ ID NO: 7042 - protein, 6 aa, synthetic construct
  REGION 1..6: note = Synthetic Construct
AKFHQK

SEQ ID NO: 7043 - protein, 6 aa, synthetic construct
  REGION 1..6: note = Synthetic Construct
AKFHRK

SEQ ID NO: 7044 - protein, 6 aa, synthetic construct
  REGION 1..6: note = Synthetic Construct
AKFHSK

SEQ ID NO: 7045 - protein, 6 aa, synthetic construct
  REGION 1..6: note = Synthetic Construct
AKFHTK

SEQ ID NO: 7046 - protein, 6 aa, synthetic construct
  REGION 1..6: note = Synthetic Construct
AKFHYK

SEQ ID NO: 7047 - protein, 6 aa, synthetic construct
  REGION 1..6: note = Synthetic Construct
AKFIAK

SEQ ID NO: 7048 - protein, 6 aa, synthetic construct
  REGION 1..6: note = Synthetic Construct
AKFIDK

SEQ ID NO: 7049 - protein, 6 aa, synthetic construct
  REGION 1..6: note = Synthetic Construct
AKFIEK

SEQ ID NO: 7050 - protein, 6 aa, synthetic construct
  REGION 1..6: note = Synthetic Construct
AKFIFK

SEQ ID NO: 7051 - protein, 6 aa, synthetic construct
  REGION 1..6: note = Synthetic Construct
AKFIGK

SEQ ID NO: 7052 - protein, 6 aa, synthetic construct
  REGION 1..6: note = Synthetic Construct
AKFIHK

SEQ ID NO: 7053 - protein, 6 aa, synthetic construct
  REGION 1..6: note = Synthetic Construct
AKFIIK

SEQ ID NO: 7054 - protein, 6 aa, synthetic construct
  REGION 1..6: note = Synthetic Construct
AKFILK

SEQ ID NO: 7055 - protein, 6 aa, synthetic construct
  REGION 1..6: note = Synthetic Construct
AKFINK

SEQ ID NO: 7056 - protein, 6 aa, synthetic construct
  REGION 1..6: note = Synthetic Construct
AKFIQK

SEQ ID NO: 7057 - protein, 6 aa, synthetic construct
  REGION 1..6: note = Synthetic Construct
AKFIRK

SEQ ID NO: 7058 - protein, 6 aa, synthetic construct
  REGION 1..6: note = Synthetic Construct
AKFISK

SEQ ID NO: 7059 - protein, 6 aa, synthetic construct
  REGION 1..6: note = Synthetic Construct
AKFITK

SEQ ID NO: 7060 - protein, 6 aa, synthetic construct
  REGION 1..6: note = Synthetic Construct
AKFIYK

SEQ ID NO: 7061 - protein, 6 aa, synthetic construct
  REGION 1..6: note = Synthetic Construct
AKFLAK

SEQ ID NO: 7062 - protein, 6 aa, synthetic construct
  REGION 1..6: note = Synthetic Construct
AKFLDK

SEQ ID NO: 7063 - protein, 6 aa, synthetic construct
  REGION 1..6: note = Synthetic Construct
AKFLEK

SEQ ID NO: 7064 - protein, 6 aa, synthetic construct
  REGION 1..6: note = Synthetic Construct
AKFLFK

SEQ ID NO: 7065 - protein, 6 aa, synthetic construct
  REGION 1..6: note = Synthetic Construct
AKFLGK

SEQ ID NO: 7066 - protein, 6 aa, synthetic construct
  REGION 1..6: note = Synthetic Construct
AKFLHK

SEQ ID NO: 7067 - protein, 6 aa, synthetic construct
  REGION 1..6: note = Synthetic Construct
AKFLIK

SEQ ID NO: 7068 - protein, 6 aa, synthetic construct
  REGION 1..6: note = Synthetic Construct
AKFLLK

SEQ ID NO: 7069 - protein, 6 aa, synthetic construct
  REGION 1..6: note = Synthetic Construct
AKFLNK

SEQ ID NO: 7070 - protein, 6 aa, synthetic construct
  REGION 1..6: note = Synthetic Construct
AKFLQK

SEQ ID NO: 7071 - protein, 6 aa, synthetic construct
  REGION 1..6: note = Synthetic Construct
AKFLRK

SEQ ID NO: 7072 - protein, 6 aa, synthetic construct
  REGION 1..6: note = Synthetic Construct
AKFLSK

SEQ ID NO: 7073 - protein, 6 aa, synthetic construct
  REGION 1..6: note = Synthetic Construct
AKFLTK

SEQ ID NO: 7074 - protein, 6 aa, synthetic construct
  REGION 1..6: note = Synthetic Construct
AKFLYK

SEQ ID NO: 7075 - protein, 6 aa, synthetic construct
  REGION 1..6: note = Synthetic Construct
AKFNAK

SEQ ID NO: 7076 - protein, 6 aa, synthetic construct
  REGION 1..6: note = Synthetic Construct
AKFNDK

SEQ ID NO: 7077 - protein, 6 aa, synthetic construct
  REGION 1..6: note = Synthetic Construct
AKFNEK

SEQ ID NO: 7078 - protein, 6 aa, synthetic construct
  REGION 1..6: note = Synthetic Construct
AKFNFK

SEQ ID NO: 7079 - protein, 6 aa, synthetic construct
  REGION 1..6: note = Synthetic Construct
AKFNGK

SEQ ID NO: 7080 - protein, 6 aa, synthetic construct
  REGION 1..6: note = Synthetic Construct
AKFNHK

SEQ ID NO: 7081 - protein, 6 aa, synthetic construct
  REGION 1..6: note = Synthetic Construct
AKFNIK

SEQ ID NO: 7082 - protein, 6 aa, synthetic construct
  REGION 1..6: note = Synthetic Construct
AKFNLK

SEQ ID NO: 7083 - protein, 6 aa, synthetic construct
  REGION 1..6: note = Synthetic Construct
AKFNNK

SEQ ID NO: 7084 - protein, 6 aa, synthetic construct
  REGION 1..6: note = Synthetic Construct
AKFNQK

SEQ ID NO: 7085 - protein, 6 aa, synthetic construct
  REGION 1..6: note = Synthetic Construct
AKFNRK

SEQ ID NO: 7086 - protein, 6 aa, synthetic construct
  REGION 1..6: note = Synthetic Construct
AKFNSK

SEQ ID NO: 7087 - protein, 6 aa, synthetic construct
  REGION 1..6: note = Synthetic Construct
AKFNTK

SEQ ID NO: 7088 - protein, 6 aa, synthetic construct
  REGION 1..6: note = Synthetic Construct
AKFNYK

SEQ ID NO: 7089 - protein, 6 aa, synthetic construct
  REGION 1..6: note = Synthetic Construct
AKFQAK

SEQ ID NO: 7090 - protein, 6 aa, synthetic construct
  REGION 1..6: note = Synthetic Construct
AKFQDK

SEQ ID NO: 7091 - protein, 6 aa, synthetic construct
  REGION 1..6: note = Synthetic Construct
AKFQEK

SEQ ID NO: 7092 - protein, 6 aa, synthetic construct
  REGION 1..6: note = Synthetic Construct
AKFQFK

SEQ ID NO: 7093 - protein, 6 aa, synthetic construct
  REGION 1..6: note = Synthetic Construct
AKFQGK

SEQ ID NO: 7094 - protein, 6 aa, synthetic construct
  REGION 1..6: note = Synthetic Construct
AKFQHK

SEQ ID NO: 7095 - protein, 6 aa, synthetic construct
  REGION 1..6: note = Synthetic Construct
AKFQIK

SEQ ID NO: 7096 - protein, 6 aa, synthetic construct
  REGION 1..6: note = Synthetic Construct
AKFQLK

SEQ ID NO: 7097 - protein, 6 aa, synthetic construct
  REGION 1..6: note = Synthetic Construct
AKFQNK

SEQ ID NO: 7098 - protein, 6 aa, synthetic construct
  REGION 1..6: note = Synthetic Construct
AKFQQK

SEQ ID NO: 7099 - protein, 6 aa, synthetic construct
  REGION 1..6: note = Synthetic Construct
AKFQRK

SEQ ID NO: 7100 - protein, 6 aa, synthetic construct
  REGION 1..6: note = Synthetic Construct
AKFQSK

SEQ ID NO: 7101 - protein, 6 aa, synthetic construct
  REGION 1..6: note = Synthetic Construct
AKFQTK

SEQ ID NO: 7102 - protein, 6 aa, synthetic construct
  REGION 1..6: note = Synthetic Construct
AKFQYK

SEQ ID NO: 7103 - protein, 6 aa, synthetic construct
  REGION 1..6: note = Synthetic Construct
AKFRAK

SEQ ID NO: 7104 - protein, 6 aa, synthetic construct
  REGION 1..6: note = Synthetic Construct
AKFRDK

SEQ ID NO: 7105 - protein, 6 aa, synthetic construct
  REGION 1..6: note = Synthetic Construct
AKFREK

SEQ ID NO: 7106 - protein, 6 aa, synthetic construct
  REGION 1..6: note = Synthetic Construct
AKFRFK

SEQ ID NO: 7107 - protein, 6 aa, synthetic construct
  REGION 1..6: note = Synthetic Construct
AKFRGK

SEQ ID NO: 7108 - protein, 6 aa, synthetic construct
  REGION 1..6: note = Synthetic Construct
AKFRHK

SEQ ID NO: 7109 - protein, 6 aa, synthetic construct
  REGION 1..6: note = Synthetic Construct
AKFRIK

SEQ ID NO: 7110 - protein, 6 aa, synthetic construct
  REGION 1..6: note = Synthetic Construct
AKFRLK

SEQ ID NO: 7111 - protein, 6 aa, synthetic construct
  REGION 1..6: note = Synthetic Construct
AKFRNK

SEQ ID NO: 7112 - protein, 6 aa, synthetic construct
  REGION 1..6: note = Synthetic Construct
AKFRQK

SEQ ID NO: 7113 - protein, 6 aa, synthetic construct
  REGION 1..6: note = Synthetic Construct
AKFRRK

SEQ ID NO: 7114 - protein, 6 aa, synthetic construct
  REGION 1..6: note = Synthetic Construct
AKFRSK

SEQ ID NO: 7115 - protein, 6 aa, synthetic construct
  REGION 1..6: note = Synthetic Construct
AKFRTK

SEQ ID NO: 7116 - protein, 6 aa, synthetic construct
  REGION 1..6: note = Synthetic Construct
AKFRYK

SEQ ID NO: 7117 - protein, 6 aa, synthetic construct
  REGION 1..6: note = Synthetic Construct
AKFSAK

SEQ ID NO: 7118 - protein, 6 aa, synthetic construct
  REGION 1..6: note = Synthetic Construct
AKFSDK

SEQ ID NO: 7119 - protein, 6 aa, synthetic construct
  REGION 1..6: note = Synthetic Construct
AKFSEK

SEQ ID NO: 7120 - protein, 6 aa, synthetic construct
  REGION 1..6: note = Synthetic Construct
AKFSFK

SEQ ID NO: 7121 - protein, 6 aa, synthetic construct
  REGION 1..6: note = Synthetic Construct
AKFSGK

SEQ ID NO: 7122 - protein, 6 aa, synthetic construct
  REGION 1..6: note = Synthetic Construct
AKFSHK

SEQ ID NO: 7123 - protein, 6 aa, synthetic construct
  REGION 1..6: note = Synthetic Construct
AKFSIK

SEQ ID NO: 7124 - protein, 6 aa, synthetic construct
  REGION 1..6: note = Synthetic Construct
AKFSLK

SEQ ID NO: 7125 - protein, 6 aa, synthetic construct
  REGION 1..6: note = Synthetic Construct
AKFSNK

SEQ ID NO: 7126 - protein, 6 aa, synthetic construct
  REGION 1..6: note = Synthetic Construct
AKFSQK

SEQ ID NO: 7127 - protein, 6 aa, synthetic construct
  REGION 1..6: note = Synthetic Construct
AKFSRK

SEQ ID NO: 7128 - protein, 6 aa, synthetic construct
  REGION 1..6: note = Synthetic Construct
AKFSSK

SEQ ID NO: 7129 - protein, 6 aa, synthetic construct
  REGION 1..6: note = Synthetic Construct
AKFSTK

SEQ ID NO: 7130 - protein, 6 aa, synthetic construct
  REGION 1..6: note = Synthetic Construct
AKFSYK

SEQ ID NO: 7131 - protein, 6 aa, synthetic construct
  REGION 1..6: note = Synthetic Construct
AKFTAK

SEQ ID NO: 7132 - protein, 6 aa, synthetic construct
  REGION 1..6: note = Synthetic Construct
AKFTDK

SEQ ID NO: 7133 - protein, 6 aa, synthetic construct
  REGION 1..6: note = Synthetic Construct
AKFTEK

SEQ ID NO: 7134 - protein, 6 aa, synthetic construct
  REGION 1..6: note = Synthetic Construct
AKFTFK

SEQ ID NO: 7135 - protein, 6 aa, synthetic construct
  REGION 1..6: note = Synthetic Construct
AKFTGK

SEQ ID NO: 7136 - protein, 6 aa, synthetic construct
  REGION 1..6: note = Synthetic Construct
AKFTHK

SEQ ID NO: 7137 - protein, 6 aa, synthetic construct
  REGION 1..6: note = Synthetic Construct
AKFTIK

SEQ ID NO: 7138 - protein, 6 aa, synthetic construct
  REGION 1..6: note = Synthetic Construct
AKFTLK

SEQ ID NO: 7139 - protein, 6 aa, synthetic construct
  REGION 1..6: note = Synthetic Construct
AKFTNK

SEQ ID NO: 7140 - protein, 6 aa, synthetic construct
  REGION 1..6: note = Synthetic Construct
AKFTQK

SEQ ID NO: 7141 - protein, 6 aa, synthetic construct
  REGION 1..6: note = Synthetic Construct
AKFTRK

SEQ ID NO: 7142 - protein, 6 aa, synthetic construct
  REGION 1..6: note = Synthetic Construct
AKFTSK

SEQ ID NO: 7143 - protein, 6 aa, synthetic construct
  REGION 1..6: note = Synthetic Construct
AKFTTK

SEQ ID NO: 7144 - protein, 6 aa, synthetic construct
  REGION 1..6: note = Synthetic Construct
AKFTYK

SEQ ID NO: 7145 - protein, 6 aa, synthetic construct
  REGION 1..6: note = Synthetic Construct
AKFYAK

SEQ ID NO: 7146 - protein, 6 aa, synthetic construct
  REGION 1..6: note = Synthetic Construct
AKFYDK

SEQ ID NO: 7147 - protein, 6 aa, synthetic construct
  REGION 1..6: note = Synthetic Construct
AKFYEK

SEQ ID NO: 7148 - protein, 6 aa, synthetic construct
  REGION 1..6: note = Synthetic Construct
AKFYFK

SEQ ID NO: 7149 - protein, 6 aa, synthetic construct
  REGION 1..6: note = Synthetic Construct
AKFYGK

SEQ ID NO: 7150 - protein, 6 aa, synthetic construct
  REGION 1..6: note = Synthetic Construct
AKFYHK

SEQ ID NO: 7151 - protein, 6 aa, synthetic construct
  REGION 1..6: note = Synthetic Construct
AKFYIK

SEQ ID NO: 7152 - protein, 6 aa, synthetic construct
  REGION 1..6: note = Synthetic Construct
AKFYLK

SEQ ID NO: 7153 - protein, 6 aa, synthetic construct
  REGION 1..6: note = Synthetic Construct
AKFYNK

SEQ ID NO: 7154 - protein, 6 aa, synthetic construct
  REGION 1..6: note = Synthetic Construct
AKFYQK

SEQ ID NO: 7155 - protein, 6 aa, synthetic construct
  REGION 1..6: note = Synthetic Construct
AKFYRK

SEQ ID NO: 7156 - protein, 6 aa, synthetic construct
  REGION 1..6: note = Synthetic Construct
AKFYSK

SEQ ID NO: 7157 - protein, 6 aa, synthetic construct
  REGION 1..6: note = Synthetic Construct
AKFYTK

SEQ ID NO: 7158 - protein, 6 aa, synthetic construct
  REGION 1..6: note = Synthetic Construct
AKFYYK

SEQ ID NO: 7159 - protein, 6 aa, synthetic construct
  REGION 1..6: note = Synthetic Construct
AKGAAK

SEQ ID NO: 7160 - protein, 6 aa, synthetic construct
  REGION 1..6: note = Synthetic Construct
AKGADK

SEQ ID NO: 7161 - protein, 6 aa, synthetic construct
  REGION 1..6: note = Synthetic Construct
AKGAEK

SEQ ID NO: 7162 - protein, 6 aa, synthetic construct
  REGION 1..6: note = Synthetic Construct
AKGAFK

SEQ ID NO: 7163 - protein, 6 aa, synthetic construct
  REGION 1..6: note = Synthetic Construct
AKGAGK

SEQ ID NO: 7164 - protein, 6 aa, synthetic construct
  REGION 1..6: note = Synthetic Construct
AKGAHK

SEQ ID NO: 7165 - protein, 6 aa, synthetic construct
  REGION 1..6: note = Synthetic Construct
AKGAIK

SEQ ID NO: 7166 - protein, 6 aa, synthetic construct
  REGION 1..6: note = Synthetic Construct
AKGALK

SEQ ID NO: 7167 - protein, 6 aa, synthetic construct
  REGION 1..6: note = Synthetic Construct
AKGANK

SEQ ID NO: 7168 - protein, 6 aa, synthetic construct
  REGION 1..6: note = Synthetic Construct
AKGAQK

SEQ ID NO: 7169 - protein, 6 aa, synthetic construct
  REGION 1..6: note = Synthetic Construct
AKGARK

SEQ ID NO: 7170 - protein, 6 aa, synthetic construct
  REGION 1..6: note = Synthetic Construct
AKGASK

SEQ ID NO: 7171 - protein, 6 aa, synthetic construct
  REGION 1..6: note = Synthetic Construct
AKGATK

SEQ ID NO: 7172 - protein, 6 aa, synthetic construct
  REGION 1..6: note = Synthetic Construct
AKGAYK

SEQ ID NO: 7173 - protein, 6 aa, synthetic construct
  REGION 1..6: note = Synthetic Construct
AKGDAK

SEQ ID NO: 7174 - protein, 6 aa, synthetic construct
  REGION 1..6: note = Synthetic Construct
AKGDDK

SEQ ID NO: 7175 - protein, 6 aa, synthetic construct
  REGION 1..6: note = Synthetic Construct
AKGDEK

SEQ ID NO: 7176 - protein, 6 aa, synthetic construct
  REGION 1..6: note = Synthetic Construct
AKGDFK

SEQ ID NO: 7177 - protein, 6 aa, synthetic construct
  REGION 1..6: note = Synthetic Construct
AKGDGK

SEQ ID NO: 7178 - protein, 6 aa, synthetic construct
  REGION 1..6: note = Synthetic Construct
AKGDHK

SEQ ID NO: 7179 - protein, 6 aa, synthetic construct
  REGION 1..6: note = Synthetic Construct
AKGDIK

SEQ ID NO: 7180 - protein, 6 aa, synthetic construct
  REGION 1..6: note = Synthetic Construct
AKGDLK

SEQ ID NO: 7181 - protein, 6 aa, synthetic construct
  REGION 1..6: note = Synthetic Construct
AKGDNK

SEQ ID NO: 7182 - protein, 6 aa, synthetic construct
  REGION 1..6: note = Synthetic Construct
AKGDQK

SEQ ID NO: 7183 - protein, 6 aa, synthetic construct
  REGION 1..6: note = Synthetic Construct
AKGDRK

SEQ ID NO: 7184 - protein, 6 aa, synthetic construct
  REGION 1..6: note = Synthetic Construct
AKGDSK

SEQ ID NO: 7185 - protein, 6 aa, synthetic construct
  REGION 1..6: note = Synthetic Construct
AKGDTK

SEQ ID NO: 7186 - protein, 6 aa, synthetic construct
  REGION 1..6: note = Synthetic Construct
AKGDYK

SEQ ID NO: 7187 - protein, 6 aa, synthetic construct
  REGION 1..6: note = Synthetic Construct
AKGEAK

SEQ ID NO: 7188 - protein, 6 aa, synthetic construct
  REGION 1..6: note = Synthetic Construct
AKGEDK

SEQ ID NO: 7189 - protein, 6 aa, synthetic construct
  REGION 1..6: note = Synthetic Construct
AKGEEK

SEQ ID NO: 7190 - protein, 6 aa, synthetic construct
  REGION 1..6: note = Synthetic Construct
AKGEFK

SEQ ID NO: 7191 - protein, 6 aa, synthetic construct
  REGION 1..6: note = Synthetic Construct
AKGEGK

SEQ ID NO: 7192 - protein, 6 aa, synthetic construct
  REGION 1..6: note = Synthetic Construct
AKGEHK

SEQ ID NO: 7193 - protein, 6 aa, synthetic construct
  REGION 1..6: note = Synthetic Construct
AKGEIK

SEQ ID NO: 7194 - protein, 6 aa, synthetic construct
  REGION 1..6: note = Synthetic Construct
AKGELK

SEQ ID NO: 7195 - protein, 6 aa, synthetic construct
  REGION 1..6: note = Synthetic Construct
AKGENK

SEQ ID NO: 7196 - protein, 6 aa, synthetic construct
  REGION 1..6: note = Synthetic Construct
AKGEQK

SEQ ID NO: 7197 - protein, 6 aa, synthetic construct
  REGION 1..6: note = Synthetic Construct
AKGERK

SEQ ID NO: 7198 - protein, 6 aa, synthetic construct
  REGION 1..6: note = Synthetic Construct
AKGESK

SEQ ID NO: 7199 - protein, 6 aa, synthetic construct
  REGION 1..6: note = Synthetic Construct
AKGETK

SEQ ID NO: 7200 - protein, 6 aa, synthetic construct
  REGION 1..6: note = Synthetic Construct
AKGEYK

SEQ ID NO: 7201 - protein, 6 aa, synthetic construct
  REGION 1..6: note = Synthetic Construct
AKGFAK

SEQ ID NO: 7202 - protein, 6 aa, synthetic construct
  REGION 1..6: note = Synthetic Construct
AKGFDK

SEQ ID NO: 7203 - protein, 6 aa, synthetic construct
  REGION 1..6: note = Synthetic Construct
AKGFEK

SEQ ID NO: 7204 - protein, 6 aa, synthetic construct
  REGION 1..6: note = Synthetic Construct
AKGFFK

SEQ ID NO: 7205 - protein, 6 aa, synthetic construct
  REGION 1..6: note = Synthetic Construct
AKGFGK

SEQ ID NO: 7206 - protein, 6 aa, synthetic construct
  REGION 1..6: note = Synthetic Construct
AKGFHK

SEQ ID NO: 7207 - protein, 6 aa, synthetic construct
  REGION 1..6: note = Synthetic Construct
AKGFIK

SEQ ID NO: 7208 - protein, 6 aa, synthetic construct
  REGION 1..6: note = Synthetic Construct
AKGFLK

SEQ ID NO: 7209 - protein, 6 aa, synthetic construct
  REGION 1..6: note = Synthetic Construct
AKGFNK

SEQ ID NO: 7210 - protein, 6 aa, synthetic construct
  REGION 1..6: note = Synthetic Construct
AKGFQK

SEQ ID NO: 7211 - protein, 6 aa, synthetic construct
  REGION 1..6: note = Synthetic Construct
AKGFRK

SEQ ID NO: 7212 - protein, 6 aa, synthetic construct
  REGION 1..6: note = Synthetic Construct
AKGFSK

SEQ ID NO: 7213 - protein, 6 aa, synthetic construct
  REGION 1..6: note = Synthetic Construct
AKGFTK

SEQ ID NO: 7214 - protein, 6 aa, synthetic construct
  REGION 1..6: note = Synthetic Construct
AKGFYK

SEQ ID NO: 7215 - protein, 6 aa, synthetic construct
  REGION 1..6: note = Synthetic Construct
AKGGAK

SEQ ID NO: 7216 - protein, 6 aa, synthetic construct
  REGION 1..6: note = Synthetic Construct
AKGGDK

SEQ ID NO: 7217 - protein, 6 aa, synthetic construct
  REGION 1..6: note = Synthetic Construct
AKGGEK

SEQ ID NO: 7218 - protein, 6 aa, synthetic construct
  REGION 1..6: note = Synthetic Construct
AKGGFK

SEQ ID NO: 7219 - protein, 6 aa, synthetic construct
  REGION 1..6: note = Synthetic Construct
AKGGGK

SEQ ID NO: 7220 - protein, 6 aa, synthetic construct
  REGION 1..6: note = Synthetic Construct
AKGGHK

SEQ ID NO: 7221 - protein, 6 aa, synthetic construct
  REGION 1..6: note = Synthetic Construct
AKGGIK

SEQ ID NO: 7222 - protein, 6 aa, synthetic construct
  REGION 1..6: note = Synthetic Construct
AKGGLK

SEQ ID NO: 7223 - protein, 6 aa, synthetic construct
  REGION 1..6: note = Synthetic Construct
AKGGNK

SEQ ID NO: 7224 - protein, 6 aa, synthetic construct
  REGION 1..6: note = Synthetic Construct
AKGGQK

SEQ ID NO: 7225 - protein, 6 aa, synthetic construct
  REGION 1..6: note = Synthetic Construct
AKGGRK

SEQ ID NO: 7226 - protein, 6 aa, synthetic construct
  REGION 1..6: note = Synthetic Construct
AKGGSK

SEQ ID NO: 7227 - protein, 6 aa, synthetic construct
  REGION 1..6: note = Synthetic Construct
AKGGTK

SEQ ID NO: 7228 - protein, 6 aa, synthetic construct
  REGION 1..6: note = Synthetic Construct
AKGGYK

SEQ ID NO: 7229 - protein, 6 aa, synthetic construct
  REGION 1..6: note = Synthetic Construct
AKGHAK

SEQ ID NO: 7230 - protein, 6 aa, synthetic construct
  REGION 1..6: note = Synthetic Construct
AKGHDK

SEQ ID NO: 7231 - protein, 6 aa, synthetic construct
  REGION 1..6: note = Synthetic Construct
AKGHEK

SEQ ID NO: 7232 - protein, 6 aa, synthetic construct
  REGION 1..6: note = Synthetic Construct
AKGHFK

SEQ ID NO: 7233 - protein, 6 aa, synthetic construct
  REGION 1..6: note = Synthetic Construct
AKGHGK

SEQ ID NO: 7234 - protein, 6 aa, synthetic construct
  REGION 1..6: note = Synthetic Construct
AKGHHK

SEQ ID NO: 7235 - protein, 6 aa, synthetic construct
  REGION 1..6: note = Synthetic Construct
AKGHIK

SEQ ID NO: 7236 - protein, 6 aa, synthetic construct
  REGION 1..6: note = Synthetic Construct
AKGHLK

SEQ ID NO: 7237 - protein, 6 aa, synthetic construct
  REGION 1..6: note = Synthetic Construct
AKGHNK

SEQ ID NO: 7238 - protein, 6 aa, synthetic construct
  REGION 1..6: note = Synthetic Construct
AKGHQK

SEQ ID NO: 7239 - protein, 6 aa, synthetic construct
  REGION 1..6: note = Synthetic Construct
AKGHRK

SEQ ID NO: 7240 - protein, 6 aa, synthetic construct
  REGION 1..6: note = Synthetic Construct
AKGHSK

SEQ ID NO: 7241 - protein, 6 aa, synthetic construct
  REGION 1..6: note = Synthetic Construct
AKGHTK

SEQ ID NO: 7242 - protein, 6 aa, synthetic construct
  REGION 1..6: note = Synthetic Construct
AKGHYK

SEQ ID NO: 7243 - protein, 6 aa, synthetic construct
  REGION 1..6: note = Synthetic Construct
AKGIAK

SEQ ID NO: 7244 - protein, 6 aa, synthetic construct
  REGION 1..6: note = Synthetic Construct
AKGIDK

SEQ ID NO: 7245 - protein, 6 aa, synthetic construct
  REGION 1..6: note = Synthetic Construct
AKGIEK

SEQ ID NO: 7246 - protein, 6 aa, synthetic construct
  REGION 1..6: note = Synthetic Construct
AKGIFK

SEQ ID NO: 7247 - protein, 6 aa, synthetic construct
  REGION 1..6: note = Synthetic Construct
AKGIGK

SEQ ID NO: 7248 - protein, 6 aa, synthetic construct
  REGION 1..6: note = Synthetic Construct
AKGIHK

SEQ ID NO: 7249 - protein, 6 aa, synthetic construct
  REGION 1..6: note = Synthetic Construct
AKGIIK

SEQ ID NO: 7250 - protein, 6 aa, synthetic construct
  REGION 1..6: note = Synthetic Construct
AKGILK

SEQ ID NO: 7251 - protein, 6 aa, synthetic construct
  REGION 1..6: note = Synthetic Construct
AKGINK

SEQ ID NO: 7252 - protein, 6 aa, synthetic construct
  REGION 1..6: note = Synthetic Construct
AKGIQK

SEQ ID NO: 7253 - protein, 6 aa, synthetic construct
  REGION 1..6: note = Synthetic Construct
AKGIRK

SEQ ID NO: 7254 - protein, 6 aa, synthetic construct
  REGION 1..6: note = Synthetic Construct
AKGISK

SEQ ID NO: 7255 - protein, 6 aa, synthetic construct
  REGION 1..6: note = Synthetic Construct
AKGITK

SEQ ID NO: 7256 - protein, 6 aa, synthetic construct
  REGION 1..6: note = Synthetic Construct
AKGIYK

SEQ ID NO: 7257 - protein, 6 aa, synthetic construct
  REGION 1..6: note = Synthetic Construct
AKGLAK

SEQ ID NO: 7258 - protein, 6 aa, synthetic construct
  REGION 1..6: note = Synthetic Construct
AKGLDK

SEQ ID NO: 7259 - protein, 6 aa, synthetic construct
  REGION 1..6: note = Synthetic Construct
AKGLEK

SEQ ID NO: 7260 - protein, 6 aa, synthetic construct
  REGION 1..6: note = Synthetic Construct
AKGLFK

SEQ ID NO: 7261 - protein, 6 aa, synthetic construct
  REGION 1..6: note = Synthetic Construct
AKGLGK

SEQ ID NO: 7262 - protein, 6 aa, synthetic construct
  REGION 1..6: note = Synthetic Construct
AKGLHK

SEQ ID NO: 7263 - protein, 6 aa, synthetic construct
  REGION 1..6: note = Synthetic Construct
AKGLIK

SEQ ID NO: 7264 - protein, 6 aa, synthetic construct
  REGION 1..6: note = Synthetic Construct
AKGLLK

SEQ ID NO: 7265 - protein, 6 aa, synthetic construct
  REGION 1..6: note = Synthetic Construct
AKGLNK

SEQ ID NO: 7266 - protein, 6 aa, synthetic construct
  REGION 1..6: note = Synthetic Construct
AKGLQK

SEQ ID NO: 7267 - protein, 6 aa, synthetic construct
  REGION 1..6: note = Synthetic Construct
AKGLRK

SEQ ID NO: 7268 - protein, 6 aa, synthetic construct
  REGION 1..6: note = Synthetic Construct
AKGLSK

SEQ ID NO: 7269 - protein, 6 aa, synthetic construct
  REGION 1..6: note = Synthetic Construct
AKGLTK

SEQ ID NO: 7270 - protein, 6 aa, synthetic construct
  REGION 1..6: note = Synthetic Construct
AKGLYK

SEQ ID NO: 7271 - protein, 6 aa, synthetic construct
  REGION 1..6: note = Synthetic Construct
AKGNAK

SEQ ID NO: 7272 - protein, 6 aa, synthetic construct
  REGION 1..6: note = Synthetic Construct
AKGNDK

SEQ ID NO: 7273 - protein, 6 aa, synthetic construct
  REGION 1..6: note = Synthetic Construct
AKGNEK

SEQ ID NO: 7274 - protein, 6 aa, synthetic construct
  REGION 1..6: note = Synthetic Construct
AKGNFK

SEQ ID NO: 7275 - protein, 6 aa, synthetic construct
  REGION 1..6: note = Synthetic Construct
AKGNGK

SEQ ID NO: 7276 - protein, 6 aa, synthetic construct
  REGION 1..6: note = Synthetic Construct
AKGNHK

SEQ ID NO: 7277 - protein, 6 aa, synthetic construct
  REGION 1..6: note = Synthetic Construct
AKGNIK

SEQ ID NO: 7278 - protein, 6 aa, synthetic construct
  REGION 1..6: note = Synthetic Construct
AKGNLK

SEQ ID NO: 7279 - protein, 6 aa, synthetic construct
  REGION 1..6: note = Synthetic Construct
AKGNNK

SEQ ID NO: 7280 - protein, 6 aa, synthetic construct
  REGION 1..6: note = Synthetic Construct
AKGNQK

SEQ ID NO: 7281 - protein, 6 aa, synthetic construct
  REGION 1..6: note = Synthetic Construct
AKGNRK

SEQ ID NO: 7282 - protein, 6 aa, synthetic construct
  REGION 1..6: note = Synthetic Construct
AKGNSK

SEQ ID NO: 7283 - protein, 6 aa, synthetic construct
  REGION 1..6: note = Synthetic Construct
AKGNTK

SEQ ID NO: 7284 - protein, 6 aa, synthetic construct
  REGION 1..6: note = Synthetic Construct
AKGNYK

SEQ ID NO: 7285 - protein, 6 aa, synthetic construct
  REGION 1..6: note = Synthetic Construct
AKGQAK

SEQ ID NO: 7286 - protein, 6 aa, synthetic construct
  REGION 1..6: note = Synthetic Construct
AKGQDK

SEQ ID NO: 7287 - protein, 6 aa, synthetic construct
  REGION 1..6: note = Synthetic Construct
AKGQEK

SEQ ID NO: 7288 - protein, 6 aa, synthetic construct
  REGION 1..6: note = Synthetic Construct
AKGQFK

SEQ ID NO: 7289 - protein, 6 aa, synthetic construct
  REGION 1..6: note = Synthetic Construct
AKGQGK

SEQ ID NO: 7290 - protein, 6 aa, synthetic construct
  REGION 1..6: note = Synthetic Construct
AKGQHK

SEQ ID NO: 7291 - protein, 6 aa, synthetic construct
  REGION 1..6: note = Synthetic Construct
AKGQIK

SEQ ID NO: 7292 - protein, 6 aa, synthetic construct
  REGION 1..6: note = Synthetic Construct
AKGQLK

SEQ ID NO: 7293 - protein, 6 aa, synthetic construct
  REGION 1..6: note = Synthetic Construct
AKGQNK

SEQ ID NO: 7294 - protein, 6 aa, synthetic construct
  REGION 1..6: note = Synthetic Construct
AKGQQK

SEQ ID NO: 7295 - protein, 6 aa, synthetic construct
  REGION 1..6: note = Synthetic Construct
AKGQRK

SEQ ID NO: 7296 - protein, 6 aa, synthetic construct
  REGION 1..6: note = Synthetic Construct
AKGQSK

SEQ ID NO: 7297 - protein, 6 aa, synthetic construct
  REGION 1..6: note = Synthetic Construct
AKGQTK

SEQ ID NO: 7298 - protein, 6 aa, synthetic construct
  REGION 1..6: note = Synthetic Construct
AKGQYK

SEQ ID NO: 7299 - protein, 6 aa, synthetic construct
  REGION 1..6: note = Synthetic Construct
AKGRAK

SEQ ID NO: 7300 - protein, 6 aa, synthetic construct
  REGION 1..6: note = Synthetic Construct
AKGRDK

SEQ ID NO: 7301 - protein, 6 aa, synthetic construct
  REGION 1..6: note = Synthetic Construct
AKGREK

SEQ ID NO: 7302 - protein, 6 aa, synthetic construct
  REGION 1..6: note = Synthetic Construct
AKGRFK

SEQ ID NO: 7303 - protein, 6 aa, synthetic construct
  REGION 1..6: note = Synthetic Construct
AKGRGK

SEQ ID NO: 7304 - protein, 6 aa, synthetic construct
  REGION 1..6: note = Synthetic Construct
AKGRHK

SEQ ID NO: 7305 - protein, 6 aa, synthetic construct
  REGION 1..6: note = Synthetic Construct
AKGRIK

SEQ ID NO: 7306 - protein, 6 aa, synthetic construct
  REGION 1..6: note = Synthetic Construct
AKGRLK

SEQ ID NO: 7307 - protein, 6 aa, synthetic construct
  REGION 1..6: note = Synthetic Construct
AKGRNK

SEQ ID NO: 7308 - protein, 6 aa, synthetic construct
  REGION 1..6: note = Synthetic Construct
AKGRQK

SEQ ID NO: 7309 - protein, 6 aa, synthetic construct
  REGION 1..6: note = Synthetic Construct
AKGRRK

SEQ ID NO: 7310 - protein, 6 aa, synthetic construct
  REGION 1..6: note = Synthetic Construct
AKGRSK

SEQ ID NO: 7311 - protein, 6 aa, synthetic construct
  REGION 1..6: note = Synthetic Construct
AKGRTK

SEQ ID NO: 7312 - protein, 6 aa, synthetic construct
  REGION 1..6: note = Synthetic Construct
AKGRYK

SEQ ID NO: 7313 - protein, 6 aa, synthetic construct
  REGION 1..6: note = Synthetic Construct
AKGSAK

SEQ ID NO: 7314 - protein, 6 aa, synthetic construct
  REGION 1..6: note = Synthetic Construct
AKGSDK

SEQ ID NO: 7315 - protein, 6 aa, synthetic construct
  REGION 1..6: note = Synthetic Construct
AKGSEK

SEQ ID NO: 7316 - protein, 6 aa, synthetic construct
  REGION 1..6: note = Synthetic Construct
AKGSFK

SEQ ID NO: 7317 - protein, 6 aa, synthetic construct
  REGION 1..6: note = Synthetic Construct
AKGSGK

SEQ ID NO: 7318 - protein, 6 aa, synthetic construct
  REGION 1..6: note = Synthetic Construct
AKGSHK

SEQ ID NO: 7319 - protein, 6 aa, synthetic construct
  REGION 1..6: note = Synthetic Construct
AKGSIK

SEQ ID NO: 7320 - protein, 6 aa, synthetic construct
  REGION 1..6: note = Synthetic Construct
AKGSLK

SEQ ID NO: 7321 - protein, 6 aa, synthetic construct
  REGION 1..6: note = Synthetic Construct
AKGSNK

SEQ ID NO: 7322 - protein, 6 aa, synthetic construct
  REGION 1..6: note = Synthetic Construct
AKGSQK

SEQ ID NO: 7323 - protein, 6 aa, synthetic construct
  REGION 1..6: note = Synthetic Construct
AKGSRK

SEQ ID NO: 7324 - protein, 6 aa, synthetic construct
  REGION 1..6: note = Synthetic Construct
AKGSSK

SEQ ID NO: 7325 - protein, 6 aa, synthetic construct
  REGION 1..6: note = Synthetic Construct
AKGSTK

SEQ ID NO: 7326 - protein, 6 aa, synthetic construct
  REGION 1..6: note = Synthetic Construct
AKGSYK

SEQ ID NO: 7327 - protein, 6 aa, synthetic construct
  REGION 1..6: note = Synthetic Construct
AKGTAK

SEQ ID NO: 7328 - protein, 6 aa, synthetic construct
  REGION 1..6: note = Synthetic Construct
AKGTDK

SEQ ID NO: 7329 - protein, 6 aa, synthetic construct
  REGION 1..6: note = Synthetic Construct
AKGTEK

SEQ ID NO: 7330 - protein, 6 aa, synthetic construct
  REGION 1..6: note = Synthetic Construct
AKGTFK

SEQ ID NO: 7331 - protein, 6 aa, synthetic construct
  REGION 1..6: note = Synthetic Construct
AKGTGK

SEQ ID NO: 7332 - protein, 6 aa, synthetic construct
  REGION 1..6: note = Synthetic Construct
AKGTHK

SEQ ID NO: 7333 - protein, 6 aa, synthetic construct
  REGION 1..6: note = Synthetic Construct
AKGTIK

SEQ ID NO: 7334 - protein, 6 aa, synthetic construct
  REGION 1..6: note = Synthetic Construct
AKGTLK

SEQ ID NO: 7335 - protein, 6 aa, synthetic construct
  REGION 1..6: note = Synthetic Construct
AKGTNK

SEQ ID NO: 7336 - protein, 6 aa, synthetic construct
  REGION 1..6: note = Synthetic Construct
AKGTQK

SEQ ID NO: 7337 - protein, 6 aa, synthetic construct
  REGION 1..6: note = Synthetic Construct
AKGTRK

SEQ ID NO: 7338 - protein, 6 aa, synthetic construct
  REGION 1..6: note = Synthetic Construct
AKGTSK

SEQ ID NO: 7339 - protein, 6 aa, synthetic construct
  REGION 1..6: note = Synthetic Construct
AKGTTK

SEQ ID NO: 7340 - protein, 6 aa, synthetic construct
  REGION 1..6: note = Synthetic Construct
AKGTYK

SEQ ID NO: 7341 - protein, 6 aa, synthetic construct
  REGION 1..6: note = Synthetic Construct
AKGYAK

SEQ ID NO: 7342 - protein, 6 aa, synthetic construct
  REGION 1..6: note = Synthetic Construct
AKGYDK

SEQ ID NO: 7343 - protein, 6 aa, synthetic construct
  REGION 1..6: note = Synthetic Construct
AKGYEK

SEQ ID NO: 7344 - protein, 6 aa, synthetic construct
  REGION 1..6: note = Synthetic Construct
AKGYFK

SEQ ID NO: 7345 - protein, 6 aa, synthetic construct
  REGION 1..6: note = Synthetic Construct
AKGYGK

SEQ ID NO: 7346 - protein, 6 aa, synthetic construct
  REGION 1..6: note = Synthetic Construct
AKGYHK

SEQ ID NO: 7347 - protein, 6 aa, synthetic construct
  REGION 1..6: note = Synthetic Construct
AKGYIK

SEQ ID NO: 7348 - protein, 6 aa, synthetic construct
  REGION 1..6: note = Synthetic Construct
AKGYLK

SEQ ID NO: 7349 - protein, 6 aa, synthetic construct
  REGION 1..6: note = Synthetic Construct
AKGYNK

SEQ ID NO: 7350 - protein, 6 aa, synthetic construct
  REGION 1..6: note = Synthetic Construct
AKGYQK

SEQ ID NO: 7351 - protein, 6 aa, synthetic construct
  REGION 1..6: note = Synthetic Construct
AKGYRK

SEQ ID NO: 7352 - protein, 6 aa, synthetic construct
  REGION 1..6: note = Synthetic Construct
AKGYSK

SEQ ID NO: 7353 - protein, 6 aa, synthetic construct
  REGION 1..6: note = Synthetic Construct
AKGYTK

SEQ ID NO: 7354 - protein, 6 aa, synthetic construct
  REGION 1..6: note = Synthetic Construct
AKGYYK

SEQ ID NO: 7355 - protein, 6 aa, synthetic construct
  REGION 1..6: note = Synthetic Construct
AKHAAK

SEQ ID NO: 7356 - protein, 6 aa, synthetic construct
  REGION 1..6: note = Synthetic Construct
AKHADK

SEQ ID NO: 7357 - protein, 6 aa, synthetic construct
  REGION 1..6: note = Synthetic Construct
AKHAEK

SEQ ID NO: 7358 - protein, 6 aa, synthetic construct
  REGION 1..6: note = Synthetic Construct
AKHAFK

SEQ ID NO: 7359 - protein, 6 aa, synthetic construct
  REGION 1..6: note = Synthetic Construct
AKHAGK

SEQ ID NO: 7360 - protein, 6 aa, synthetic construct
  REGION 1..6: note = Synthetic Construct
AKHAHK

SEQ ID NO: 7361 - protein, 6 aa, synthetic construct
  REGION 1..6: note = Synthetic Construct
AKHAIK

SEQ ID NO: 7362 - protein, 6 aa, synthetic construct
  REGION 1..6: note = Synthetic Construct
AKHALK

SEQ ID NO: 7363 - protein, 6 aa, synthetic construct
  REGION 1..6: note = Synthetic Construct
AKHANK

SEQ ID NO: 7364 - protein, 6 aa, synthetic construct
  REGION 1..6: note = Synthetic Construct
AKHAQK

SEQ ID NO: 7365 - protein, 6 aa, synthetic construct
  REGION 1..6: note = Synthetic Construct
AKHARK

SEQ ID NO: 7366 - protein, 6 aa, synthetic construct
  REGION 1..6: note = Synthetic Construct
AKHASK

SEQ ID NO: 7367 - protein, 6 aa, synthetic construct
  REGION 1..6: note = Synthetic Construct
AKHATK

SEQ ID NO: 7368 - protein, 6 aa, synthetic construct
  REGION 1..6: note = Synthetic Construct
AKHAYK

SEQ ID NO: 7369 - protein, 6 aa, synthetic construct
  REGION 1..6: note = Synthetic Construct
AKHDAK

SEQ ID NO: 7370 - protein, 6 aa, synthetic construct
  REGION 1..6: note = Synthetic Construct
AKHDDK

SEQ ID NO: 7371 - protein, 6 aa, synthetic construct
  REGION 1..6: note = Synthetic Construct
AKHDEK

SEQ ID NO: 7372 - protein, 6 aa, synthetic construct
  REGION 1..6: note = Synthetic Construct
AKHDFK

SEQ ID NO: 7373 - protein, 6 aa, synthetic construct
  REGION 1..6: note = Synthetic Construct
AKHDGK

SEQ ID NO: 7374 - protein, 6 aa, synthetic construct
  REGION 1..6: note = Synthetic Construct
AKHDHK

SEQ ID NO: 7375 - protein, 6 aa, synthetic construct
  REGION 1..6: note = Synthetic Construct
AKHDIK

SEQ ID NO: 7376 - protein, 6 aa, synthetic construct
  REGION 1..6: note = Synthetic Construct
AKHDLK

SEQ ID NO: 7377 - protein, 6 aa, synthetic construct
  REGION 1..6: note = Synthetic Construct
AKHDNK

SEQ ID NO: 7378 - protein, 6 aa, synthetic construct
  REGION 1..6: note = Synthetic Construct
AKHDQK

SEQ ID NO: 7379 - protein, 6 aa, synthetic construct
  REGION 1..6: note = Synthetic Construct
AKHDRK

SEQ ID NO: 7380 - protein, 6 aa, synthetic construct
  REGION 1..6: note = Synthetic Construct
AKHDSK

SEQ ID NO: 7381 - protein, 6 aa, synthetic construct
  REGION 1..6: note = Synthetic Construct
AKHDTK

SEQ ID NO: 7382 - protein, 6 aa, synthetic construct
  REGION 1..6: note = Synthetic Construct
AKHDYK

SEQ ID NO: 7383 - protein, 6 aa, synthetic construct
  REGION 1..6: note = Synthetic Construct
AKHEAK

SEQ ID NO: 7384 - protein, 6 aa, synthetic construct
  REGION 1..6: note = Synthetic Construct
AKHEDK

SEQ ID NO: 7385 - protein, 6 aa, synthetic construct
  REGION 1..6: note = Synthetic Construct
AKHEEK

SEQ ID NO: 7386 - protein, 6 aa, synthetic construct
  REGION 1..6: note = Synthetic Construct
AKHEFK

SEQ ID NO: 7387 - protein, 6 aa, synthetic construct
  REGION 1..6: note = Synthetic Construct
AKHEGK

SEQ ID NO: 7388 - protein, 6 aa, synthetic construct
  REGION 1..6: note = Synthetic Construct
AKHEHK

SEQ ID NO: 7389 - protein, 6 aa, synthetic construct
  REGION 1..6: note = Synthetic Construct
AKHEIK

SEQ ID NO: 7390 - protein, 6 aa, synthetic construct
  REGION 1..6: note = Synthetic Construct
AKHELK

SEQ ID NO: 7391 - protein, 6 aa, synthetic construct
  REGION 1..6: note = Synthetic Construct
AKHENK

SEQ ID NO: 7392 - protein, 6 aa, synthetic construct
  REGION 1..6: note = Synthetic Construct
AKHEQK

SEQ ID NO: 7393 - protein, 6 aa, synthetic construct
  REGION 1..6: note = Synthetic Construct
AKHERK

SEQ ID NO: 7394 - protein, 6 aa, synthetic construct
  REGION 1..6: note = Synthetic Construct
AKHESK

SEQ ID NO: 7395 - protein, 6 aa, synthetic construct
  REGION 1..6: note = Synthetic Construct
AKHETK

SEQ ID NO: 7396 - protein, 6 aa, synthetic construct
  REGION 1..6: note = Synthetic Construct
AKHEYK

SEQ ID NO: 7397 - protein, 6 aa, synthetic construct
  REGION 1..6: note = Synthetic Construct
AKHFAK

SEQ ID NO: 7398 - protein, 6 aa, synthetic construct
  REGION 1..6: note = Synthetic Construct
AKHFDK

SEQ ID NO: 7399 - protein, 6 aa, synthetic construct
  REGION 1..6: note = Synthetic Construct
AKHFEK

SEQ ID NO: 7400 - protein, 6 aa, synthetic construct
  REGION 1..6: note = Synthetic Construct
AKHFFK

SEQ ID NO: 7401 - protein, 6 aa, synthetic construct
  REGION 1..6: note = Synthetic Construct
AKHFGK

SEQ ID NO: 7402 - protein, 6 aa, synthetic construct
  REGION 1..6: note = Synthetic Construct
AKHFHK

SEQ ID NO: 7403 - protein, 6 aa, synthetic construct
  REGION 1..6: note = Synthetic Construct
AKHFIK

SEQ ID NO: 7404 - protein, 6 aa, synthetic construct
  REGION 1..6: note = Synthetic Construct
AKHFLK

SEQ ID NO: 7405 - protein, 6 aa, synthetic construct
  REGION 1..6: note = Synthetic Construct
AKHFNK

SEQ ID NO: 7406 - protein, 6 aa, synthetic construct
  REGION 1..6: note = Synthetic Construct
AKHFQK

SEQ ID NO: 7407 - protein, 6 aa, synthetic construct
  REGION 1..6: note = Synthetic Construct
AKHFRK

SEQ ID NO: 7408 - protein, 6 aa, synthetic construct
  REGION 1..6: note = Synthetic Construct
AKHFSK

SEQ ID NO: 7409 - protein, 6 aa, synthetic construct
  REGION 1..6: note = Synthetic Construct
AKHFTK

SEQ ID NO: 7410 - protein, 6 aa, synthetic construct
  REGION 1..6: note = Synthetic Construct
AKHFYK

SEQ ID NO: 7411 - protein, 6 aa, synthetic construct
  REGION 1..6: note = Synthetic Construct
AKHGAK

SEQ ID NO: 7412 - protein, 6 aa, synthetic construct
  REGION 1..6: note = Synthetic Construct
AKHGDK

SEQ ID NO: 7413 - protein, 6 aa, synthetic construct
  REGION 1..6: note = Synthetic Construct
AKHGEK

SEQ ID NO: 7414 - protein, 6 aa, synthetic construct
  REGION 1..6: note = Synthetic Construct
AKHGFK

SEQ ID NO: 7415 - protein, 6 aa, synthetic construct
  REGION 1..6: note = Synthetic Construct
AKHGGK

SEQ ID NO: 7416 - protein, 6 aa, synthetic construct
  REGION 1..6: note = Synthetic Construct
AKHGHK

SEQ ID NO: 7417 - protein, 6 aa, synthetic construct
  REGION 1..6: note = Synthetic Construct
AKHGIK

SEQ ID NO: 7418 - protein, 6 aa, synthetic construct
  REGION 1..6: note = Synthetic Construct
AKHGLK

SEQ ID NO: 7419 - protein, 6 aa, synthetic construct
  REGION 1..6: note = Synthetic Construct
AKHGNK

SEQ ID NO: 7420 - protein, 6 aa, synthetic construct
  REGION 1..6: note = Synthetic Construct
AKHGQK

SEQ ID NO: 7421 - protein, 6 aa, synthetic construct
  REGION 1..6: note = Synthetic Construct
AKHGRK

SEQ ID NO: 7422 - protein, 6 aa, synthetic construct
  REGION 1..6: note = Synthetic Construct
AKHGSK

SEQ ID NO: 7423 - protein, 6 aa, synthetic construct
  REGION 1..6: note = Synthetic Construct
AKHGTK

SEQ ID NO: 7424 - protein, 6 aa, synthetic construct
  REGION 1..6: note = Synthetic Construct
AKHGYK

SEQ ID NO: 7425 - protein, 6 aa, synthetic construct
  REGION 1..6: note = Synthetic Construct
AKHHAK

SEQ ID NO: 7426 - protein, 6 aa, synthetic construct
  REGION 1..6: note = Synthetic Construct
AKHHDK

SEQ ID NO: 7427 - protein, 6 aa, synthetic construct
  REGION 1..6: note = Synthetic Construct
AKHHEK

SEQ ID NO: 7428 - protein, 6 aa, synthetic construct
  REGION 1..6: note = Synthetic Construct
AKHHFK

SEQ ID NO: 7429 - protein, 6 aa, synthetic construct
  REGION 1..6: note = Synthetic Construct
AKHHGK

SEQ ID NO: 7430 - protein, 6 aa, synthetic construct
  REGION 1..6: note = Synthetic Construct
AKHHHK

SEQ ID NO: 7431 - protein, 6 aa, synthetic construct
  REGION 1..6: note = Synthetic Construct
AKHHIK

SEQ ID NO: 7432 - protein, 6 aa, synthetic construct
  REGION 1..6: note = Synthetic Construct
AKHHLK

SEQ ID NO: 7433 - protein, 6 aa, synthetic construct
  REGION 1..6: note = Synthetic Construct
AKHHNK

SEQ ID NO: 7434 - protein, 6 aa, synthetic construct
  REGION 1..6: note = Synthetic Construct
AKHHQK

SEQ ID NO: 7435 - protein, 6 aa, synthetic construct
  REGION 1..6: note = Synthetic Construct
AKHHRK

SEQ ID NO: 7436 - protein, 6 aa, synthetic construct
  REGION 1..6: note = Synthetic Construct
AKHHSK

SEQ ID NO: 7437 - protein, 6 aa, synthetic construct
  REGION 1..6: note = Synthetic Construct
AKHHTK

SEQ ID NO: 7438 - protein, 6 aa, synthetic construct
  REGION 1..6: note = Synthetic Construct
AKHHYK

SEQ ID NO: 7439 - protein, 6 aa, synthetic construct
  REGION 1..6: note = Synthetic Construct
AKHIAK

SEQ ID NO: 7440 - protein, 6 aa, synthetic construct
  REGION 1..6: note = Synthetic Construct
AKHIDK

SEQ ID NO: 7441 - protein, 6 aa, synthetic construct
  REGION 1..6: note = Synthetic Construct
AKHIEK

SEQ ID NO: 7442 - protein, 6 aa, synthetic construct
  REGION 1..6: note = Synthetic Construct
AKHIFK

SEQ ID NO: 7443 - protein, 6 aa, synthetic construct
  REGION 1..6: note = Synthetic Construct
AKHIGK

SEQ ID NO: 7444 - protein, 6 aa, synthetic construct
  REGION 1..6: note = Synthetic Construct
AKHIHK

SEQ ID NO: 7445 - protein, 6 aa, synthetic construct
  REGION 1..6: note = Synthetic Construct
AKHIIK

SEQ ID NO: 7446 - protein, 6 aa, synthetic construct
  REGION 1..6: note = Synthetic Construct
AKHILK

SEQ ID NO: 7447 - protein, 6 aa, synthetic construct
  REGION 1..6: note = Synthetic Construct
AKHINK

SEQ ID NO: 7448 - protein, 6 aa, synthetic construct
  REGION 1..6: note = Synthetic Construct
AKHIQK

SEQ ID NO: 7449 - protein, 6 aa, synthetic construct
  REGION 1..6: note = Synthetic Construct
AKHIRK

SEQ ID NO: 7450 - protein, 6 aa, synthetic construct
  REGION 1..6: note = Synthetic Construct
AKHISK

SEQ ID NO: 7451 - protein, 6 aa, synthetic construct
  REGION 1..6: note = Synthetic Construct
AKHITK

SEQ ID NO: 7452 - protein, 6 aa, synthetic construct
  REGION 1..6: note = Synthetic Construct
AKHIYK

SEQ ID NO: 7453 - protein, 6 aa, synthetic construct
  REGION 1..6: note = Synthetic Construct
AKHLAK

SEQ ID NO: 7454 - protein, 6 aa, synthetic construct
  REGION 1..6: note = Synthetic Construct
AKHLDK

SEQ ID NO: 7455 - protein, 6 aa, synthetic construct
  REGION 1..6: note = Synthetic Construct
AKHLEK

SEQ ID NO: 7456 - protein, 6 aa, synthetic construct
  REGION 1..6: note = Synthetic Construct
AKHLFK

SEQ ID NO: 7457 - protein, 6 aa, synthetic construct
  REGION 1..6: note = Synthetic Construct
AKHLGK

SEQ ID NO: 7458 - protein, 6 aa, synthetic construct
  REGION 1..6: note = Synthetic Construct
AKHLHK

SEQ ID NO: 7459 - protein, 6 aa, synthetic construct
  REGION 1..6: note = Synthetic Construct
AKHLIK

SEQ ID NO: 7460 - protein, 6 aa, synthetic construct
  REGION 1..6: note = Synthetic Construct
AKHLLK

SEQ ID NO: 7461 - protein, 6 aa, synthetic construct
  REGION 1..6: note = Synthetic Construct
AKHLNK

SEQ ID NO: 7462 - protein, 6 aa, synthetic construct
  REGION 1..6: note = Synthetic Construct
AKHLQK

SEQ ID NO: 7463 - protein, 6 aa, synthetic construct
  REGION 1..6: note = Synthetic Construct
AKHLRK

SEQ ID NO: 7464 - protein, 6 aa, synthetic construct
  REGION 1..6: note = Synthetic Construct
AKHLSK

SEQ ID NO: 7465 - protein, 6 aa, synthetic construct
  REGION 1..6: note = Synthetic Construct
AKHLTK

SEQ ID NO: 7466 - protein, 6 aa, synthetic construct
  REGION 1..6: note = Synthetic Construct
AKHLYK

SEQ ID NO: 7467 - protein, 6 aa, synthetic construct
  REGION 1..6: note = Synthetic Construct
AKHNAK

SEQ ID NO: 7468 - protein, 6 aa, synthetic construct
  REGION 1..6: note = Synthetic Construct
AKHNDK

SEQ ID NO: 7469 - protein, 6 aa, synthetic construct
  REGION 1..6: note = Synthetic Construct
AKHNEK

SEQ ID NO: 7470 - protein, 6 aa, synthetic construct
  REGION 1..6: note = Synthetic Construct
AKHNFK

SEQ ID NO: 7471 - protein, 6 aa, synthetic construct
  REGION 1..6: note = Synthetic Construct
AKHNGK

SEQ ID NO: 7472 - protein, 6 aa, synthetic construct
  REGION 1..6: note = Synthetic Construct
AKHNHK

SEQ ID NO: 7473 - protein, 6 aa, synthetic construct
  REGION 1..6: note = Synthetic Construct
AKHNIK

SEQ ID NO: 7474 - protein, 6 aa, synthetic construct
  REGION 1..6: note = Synthetic Construct
AKHNLK

SEQ ID NO: 7475 - protein, 6 aa, synthetic construct
  REGION 1..6: note = Synthetic Construct
AKHNNK

SEQ ID NO: 7476 - protein, 6 aa, synthetic construct
  REGION 1..6: note = Synthetic Construct
AKHNQK

SEQ ID NO: 7477 - protein, 6 aa, synthetic construct
  REGION 1..6: note = Synthetic Construct
AKHNRK

SEQ ID NO: 7478 - protein, 6 aa, synthetic construct
  REGION 1..6: note = Synthetic Construct
AKHNSK

SEQ ID NO: 7479 - protein, 6 aa, synthetic construct
  REGION 1..6: note = Synthetic Construct
AKHNTK

SEQ ID NO: 7480 - protein, 6 aa, synthetic construct
  REGION 1..6: note = Synthetic Construct
AKHNYK

SEQ ID NO: 7481 - protein, 6 aa, synthetic construct
  REGION 1..6: note = Synthetic Construct
AKHQAK

SEQ ID NO: 7482 - protein, 6 aa, synthetic construct
  REGION 1..6: note = Synthetic Construct
AKHQDK

SEQ ID NO: 7483 - protein, 6 aa, synthetic construct
  REGION 1..6: note = Synthetic Construct
AKHQEK

SEQ ID NO: 7484 - protein, 6 aa, synthetic construct
  REGION 1..6: note = Synthetic Construct
AKHQFK

SEQ ID NO: 7485 - protein, 6 aa, synthetic construct
  REGION 1..6: note = Synthetic Construct
AKHQGK

SEQ ID NO: 7486 - protein, 6 aa, synthetic construct
  REGION 1..6: note = Synthetic Construct
AKHQHK

SEQ ID NO: 7487 - protein, 6 aa, synthetic construct
  REGION 1..6: note = Synthetic Construct
AKHQIK

SEQ ID NO: 7488 - protein, 6 aa, synthetic construct
  REGION 1..6: note = Synthetic Construct
AKHQLK

SEQ ID NO: 7489 - protein, 6 aa, synthetic construct
  REGION 1..6: note = Synthetic Construct
AKHQNK

SEQ ID NO: 7490 - protein, 6 aa, synthetic construct
  REGION 1..6: note = Synthetic Construct
AKHQQK

SEQ ID NO: 7491 - protein, 6 aa, synthetic construct
  REGION 1..6: note = Synthetic Construct
AKHQRK

SEQ ID NO: 7492 - protein, 6 aa, synthetic construct
  REGION 1..6: note = Synthetic Construct
AKHQSK

SEQ ID NO: 7493 - protein, 6 aa, synthetic construct
  REGION 1..6: note = Synthetic Construct
AKHQTK

SEQ ID NO: 7494 - protein, 6 aa, synthetic construct
  REGION 1..6: note = Synthetic Construct
AKHQYK

SEQ ID NO: 7495 - protein, 6 aa, synthetic construct
  REGION 1..6: note = Synthetic Construct
AKHRAK

SEQ ID NO: 7496 - protein, 6 aa, synthetic construct
  REGION 1..6: note = Synthetic Construct
AKHRDK

SEQ ID NO: 7497 - protein, 6 aa, synthetic construct
  REGION 1..6: note = Synthetic Construct
AKHREK

SEQ ID NO: 7498 - protein, 6 aa, synthetic construct
  REGION 1..6: note = Synthetic Construct
AKHRFK

SEQ ID NO: 7499 - protein, 6 aa, synthetic construct
  REGION 1..6: note = Synthetic Construct
AKHRGK

SEQ ID NO: 7500 - protein, 6 aa, synthetic construct
  REGION 1..6: note = Synthetic Construct
AKHRHK

SEQ ID NO: 7501 - protein, 6 aa, synthetic construct
  REGION 1..6: note = Synthetic Construct
AKHRIK

SEQ ID NO: 7502 - protein, 6 aa, synthetic construct
  REGION 1..6: note = Synthetic Construct
AKHRLK

SEQ ID NO: 7503 - protein, 6 aa, synthetic construct
  REGION 1..6: note = Synthetic Construct
AKHRNK

SEQ ID NO: 7504 - protein, 6 aa, synthetic construct
  REGION 1..6: note = Synthetic Construct
AKHRQK

SEQ ID NO: 7505 - protein, 6 aa, synthetic construct
  REGION 1..6: note = Synthetic Construct
AKHRRK

SEQ ID NO: 7506 - protein, 6 aa, synthetic construct
  REGION 1..6: note = Synthetic Construct
AKHRSK

SEQ ID NO: 7507 - protein, 6 aa, synthetic construct
  REGION 1..6: note = Synthetic Construct
AKHRTK

SEQ ID NO: 7508 - protein, 6 aa, synthetic construct
  REGION 1..6: note = Synthetic Construct
AKHRYK

SEQ ID NO: 7509 - protein, 6 aa, synthetic construct
  REGION 1..6: note = Synthetic Construct
AKHSAK

SEQ ID NO: 7510 - protein, 6 aa, synthetic construct
  REGION 1..6: note = Synthetic Construct
AKHSDK

SEQ ID NO: 7511 - protein, 6 aa, synthetic construct
  REGION 1..6: note = Synthetic Construct
AKHSEK

SEQ ID NO: 7512 - protein, 6 aa, synthetic construct
  REGION 1..6: note = Synthetic Construct
AKHSFK

SEQ ID NO: 7513 - protein, 6 aa, synthetic construct
  REGION 1..6: note = Synthetic Construct
AKHSGK

SEQ ID NO: 7514 - protein, 6 aa, synthetic construct
  REGION 1..6: note = Synthetic Construct
AKHSHK

SEQ ID NO: 7515 - protein, 6 aa, synthetic construct
  REGION 1..6: note = Synthetic Construct
AKHSIK

SEQ ID NO: 7516 - protein, 6 aa, synthetic construct
  REGION 1..6: note = Synthetic Construct
AKHSLK

SEQ ID NO: 7517 - protein, 6 aa, synthetic construct
  REGION 1..6: note = Synthetic Construct
AKHSNK

SEQ ID NO: 7518 - protein, 6 aa, synthetic construct
  REGION 1..6: note = Synthetic Construct
AKHSQK

SEQ ID NO: 7519 - protein, 6 aa, synthetic construct
  REGION 1..6: note = Synthetic Construct
AKHSRK

SEQ ID NO: 7520 - protein, 6 aa, synthetic construct
  REGION 1..6: note = Synthetic Construct
AKHSSK

SEQ ID NO: 7521 - protein, 6 aa, synthetic construct
  REGION 1..6: note = Synthetic Construct
AKHSTK

SEQ ID NO: 7522 - protein, 6 aa, synthetic construct
  REGION 1..6: note = Synthetic Construct
AKHSYK

SEQ ID NO: 7523 - protein, 6 aa, synthetic construct
  REGION 1..6: note = Synthetic Construct
AKHTAK

SEQ ID NO: 7524 - protein, 6 aa, synthetic construct
  REGION 1..6: note = Synthetic Construct
AKHTDK

SEQ ID NO: 7525 - protein, 6 aa, synthetic construct
  REGION 1..6: note = Synthetic Construct
AKHTEK

SEQ ID NO: 7526 - protein, 6 aa, synthetic construct
  REGION 1..6: note = Synthetic Construct
AKHTFK

SEQ ID NO: 7527 - protein, 6 aa, synthetic construct
  REGION 1..6: note = Synthetic Construct
AKHTGK

SEQ ID NO: 7528 - protein, 6 aa, synthetic construct
  REGION 1..6: note = Synthetic Construct
AKHTHK

SEQ ID NO: 7529 - protein, 6 aa, synthetic construct
  REGION 1..6: note = Synthetic Construct
AKHTIK

SEQ ID NO: 7530 - protein, 6 aa, synthetic construct
  REGION 1..6: note = Synthetic Construct
AKHTLK

SEQ ID NO: 7531 - protein, 6 aa, synthetic construct
  REGION 1..6: note = Synthetic Construct
AKHTNK

SEQ ID NO: 7532 - protein, 6 aa, synthetic construct
  REGION 1..6: note = Synthetic Construct
AKHTQK

SEQ ID NO: 7533 - protein, 6 aa, synthetic construct
  REGION 1..6: note = Synthetic Construct
AKHTRK

SEQ ID NO: 7534 - protein, 6 aa, synthetic construct
  REGION 1..6: note = Synthetic Construct
AKHTSK

SEQ ID NO: 7535 - protein, 6 aa, synthetic construct
  REGION 1..6: note = Synthetic Construct
AKHTTK

SEQ ID NO: 7536 - protein, 6 aa, synthetic construct
  REGION 1..6: note = Synthetic Construct
AKHTYK

SEQ ID NO: 7537 - protein, 6 aa, synthetic construct
  REGION 1..6: note = Synthetic Construct
AKHYAK

SEQ ID NO: 7538 - protein, 6 aa, synthetic construct
  REGION 1..6: note = Synthetic Construct
AKHYDK

SEQ ID NO: 7539 - protein, 6 aa, synthetic construct
  REGION 1..6: note = Synthetic Construct
AKHYEK

SEQ ID NO: 7540 - protein, 6 aa, synthetic construct
  REGION 1..6: note = Synthetic Construct
AKHYFK

SEQ ID NO: 7541 - protein, 6 aa, synthetic construct
  REGION 1..6: note = Synthetic Construct
AKHYGK

SEQ ID NO: 7542 - protein, 6 aa, synthetic construct
  REGION 1..6: note = Synthetic Construct
AKHYHK

SEQ ID NO: 7543 - protein, 6 aa, synthetic construct
  REGION 1..6: note = Synthetic Construct
AKHYIK

SEQ ID NO: 7544 - protein, 6 aa, synthetic construct
  REGION 1..6: note = Synthetic Construct
AKHYLK

SEQ ID NO: 7545 - protein, 6 aa, synthetic construct
  REGION 1..6: note = Synthetic Construct
AKHYNK

SEQ ID NO: 7546 - protein, 6 aa, synthetic construct
  REGION 1..6: note = Synthetic Construct
AKHYQK

SEQ ID NO: 7547 - protein, 6 aa, synthetic construct
  REGION 1..6: note = Synthetic Construct
AKHYRK

SEQ ID NO: 7548 - protein, 6 aa, synthetic construct
  REGION 1..6: note = Synthetic Construct
AKHYSK

SEQ ID NO: 7549 - protein, 6 aa, synthetic construct
  REGION 1..6: note = Synthetic Construct
AKHYTK

SEQ ID NO: 7550 - protein, 6 aa, synthetic construct
  REGION 1..6: note = Synthetic Construct
AKHYYK

SEQ ID NO: 7551 - protein, 6 aa, synthetic construct
  REGION 1..6: note = Synthetic Construct
AKIAAK

SEQ ID NO: 7552 - protein, 6 aa, synthetic construct
  REGION 1..6: note = Synthetic Construct
AKIADK

SEQ ID NO: 7553 - protein, 6 aa, synthetic construct
  REGION 1..6: note = Synthetic Construct
AKIAEK

SEQ ID NO: 7554 - protein, 6 aa, synthetic construct
  REGION 1..6: note = Synthetic Construct
AKIAFK

SEQ ID NO: 7555 - protein, 6 aa, synthetic construct
  REGION 1..6: note = Synthetic Construct
AKIAGK

SEQ ID NO: 7556 - protein, 6 aa, synthetic construct
  REGION 1..6: note = Synthetic Construct
AKIAHK

SEQ ID NO: 7557 - protein, 6 aa, synthetic construct
  REGION 1..6: note = Synthetic Construct
AKIAIK

SEQ ID NO: 7558 - protein, 6 aa, synthetic construct
  REGION 1..6: note = Synthetic Construct
AKIALK

SEQ ID NO: 7559 - protein, 6 aa, synthetic construct
  REGION 1..6: note = Synthetic Construct
AKIANK

SEQ ID NO: 7560 - protein, 6 aa, synthetic construct
  REGION 1..6: note = Synthetic Construct
AKIAQK

SEQ ID NO: 7561 - protein, 6 aa, synthetic construct
  REGION 1..6: note = Synthetic Construct
AKIARK

SEQ ID NO: 7562 - protein, 6 aa, synthetic construct
  REGION 1..6: note = Synthetic Construct
AKIASK

SEQ ID NO: 7563 - protein, 6 aa, synthetic construct
  REGION 1..6: note = Synthetic Construct
AKIATK

SEQ ID NO: 7564 - protein, 6 aa, synthetic construct
  REGION 1..6: note = Synthetic Construct
AKIAYK

SEQ ID NO: 7565 - protein, 6 aa, synthetic construct
  REGION 1..6: note = Synthetic Construct
AKIDAK

SEQ ID NO: 7566 - protein, 6 aa, synthetic construct
  REGION 1..6: note = Synthetic Construct
AKIDDK

SEQ ID NO: 7567 - protein, 6 aa, synthetic construct
  REGION 1..6: note = Synthetic Construct
AKIDEK

SEQ ID NO: 7568 - protein, 6 aa, synthetic construct
  REGION 1..6: note = Synthetic Construct
AKIDFK

SEQ ID NO: 7569 - protein, 6 aa, synthetic construct
  REGION 1..6: note = Synthetic Construct
AKIDGK

SEQ ID NO: 7570 - protein, 6 aa, synthetic construct
  REGION 1..6: note = Synthetic Construct
AKIDHK

SEQ ID NO: 7571 - protein, 6 aa, synthetic construct
  REGION 1..6: note = Synthetic Construct
AKIDIK

SEQ ID NO: 7572 - protein, 6 aa, synthetic construct
  REGION 1..6: note = Synthetic Construct
AKIDLK

SEQ ID NO: 7573 - protein, 6 aa, synthetic construct
  REGION 1..6: note = Synthetic Construct
AKIDNK

SEQ ID NO: 7574 - protein, 6 aa, synthetic construct
  REGION 1..6: note = Synthetic Construct
AKIDQK

SEQ ID NO: 7575 - protein, 6 aa, synthetic construct
  REGION 1..6: note = Synthetic Construct
AKIDRK

SEQ ID NO: 7576 - protein, 6 aa, synthetic construct
  REGION 1..6: note = Synthetic Construct
AKIDSK

SEQ ID NO: 7577 - protein, 6 aa, synthetic construct
  REGION 1..6: note = Synthetic Construct
AKIDTK

SEQ ID NO: 7578 - protein, 6 aa, synthetic construct
  REGION 1..6: note = Synthetic Construct
AKIDYK

SEQ ID NO: 7579 - protein, 6 aa, synthetic construct
  REGION 1..6: note = Synthetic Construct
AKIEAK

SEQ ID NO: 7580 - protein, 6 aa, synthetic construct
  REGION 1..6: note = Synthetic Construct
AKIEDK

SEQ ID NO: 7581 - protein, 6 aa, synthetic construct
  REGION 1..6: note = Synthetic Construct
AKIEEK

SEQ ID NO: 7582 - protein, 6 aa, synthetic construct
  REGION 1..6: note = Synthetic Construct
AKIEFK

SEQ ID NO: 7583 - protein, 6 aa, synthetic construct
  REGION 1..6: note = Synthetic Construct
AKIEGK

SEQ ID NO: 7584 - protein, 6 aa, synthetic construct
  REGION 1..6: note = Synthetic Construct
AKIEHK

SEQ ID NO: 7585 - protein, 6 aa, synthetic construct
  REGION 1..6: note = Synthetic Construct
AKIEIK

SEQ ID NO: 7586 - protein, 6 aa, synthetic construct
  REGION 1..6: note = Synthetic Construct
AKIELK

SEQ ID NO: 7587 - protein, 6 aa, synthetic construct
  REGION 1..6: note = Synthetic Construct
AKIENK

SEQ ID NO: 7588 - protein, 6 aa, synthetic construct
  REGION 1..6: note = Synthetic Construct
AKIEQK

SEQ ID NO: 7589 - protein, 6 aa, synthetic construct
  REGION 1..6: note = Synthetic Construct
AKIERK

SEQ ID NO: 7590 - protein, 6 aa, synthetic construct
  REGION 1..6: note = Synthetic Construct
AKIESK

SEQ ID NO: 7591 - protein, 6 aa, synthetic construct
  REGION 1..6: note = Synthetic Construct
AKIETK

SEQ ID NO: 7592 - protein, 6 aa, synthetic construct
  REGION 1..6: note = Synthetic Construct
AKIEYK

SEQ ID NO: 7593 - protein, 6 aa, synthetic construct
  REGION 1..6: note = Synthetic Construct
AKIFAK

SEQ ID NO: 7594 - protein, 6 aa, synthetic construct
  REGION 1..6: note = Synthetic Construct
AKIFDK

SEQ ID NO: 7595 - protein, 6 aa, synthetic construct
  REGION 1..6: note = Synthetic Construct
AKIFEK

SEQ ID NO: 7596 - protein, 6 aa, synthetic construct
  REGION 1..6: note = Synthetic Construct
AKIFFK

SEQ ID NO: 7597 - protein, 6 aa, synthetic construct
  REGION 1..6: note = Synthetic Construct
AKIFGK

SEQ ID NO: 7598 - protein, 6 aa, synthetic construct
  REGION 1..6: note = Synthetic Construct
AKIFHK

SEQ ID NO: 7599 - protein, 6 aa, synthetic construct
  REGION 1..6: note = Synthetic Construct
AKIFIK

SEQ ID NO: 7600 - protein, 6 aa, synthetic construct
  REGION 1..6: note = Synthetic Construct
AKIFLK

SEQ ID NO: 7601 - protein, 6 aa, synthetic construct
  REGION 1..6: note = Synthetic Construct
AKIFNK

SEQ ID NO: 7602 - protein, 6 aa, synthetic construct
  REGION 1..6: note = Synthetic Construct
AKIFQK

SEQ ID NO: 7603 - protein, 6 aa, synthetic construct
  REGION 1..6: note = Synthetic Construct
AKIFRK

SEQ ID NO: 7604 - protein, 6 aa, synthetic construct
  REGION 1..6: note = Synthetic Construct
AKIFSK

SEQ ID NO: 7605 - protein, 6 aa, synthetic construct
  REGION 1..6: note = Synthetic Construct
AKIFTK

SEQ ID NO: 7606 - protein, 6 aa, synthetic construct
  REGION 1..6: note = Synthetic Construct
AKIFYK

SEQ ID NO: 7607 - protein, 6 aa, synthetic construct
  REGION 1..6: note = Synthetic Construct
AKIGAK

SEQ ID NO: 7608 - protein, 6 aa, synthetic construct
  REGION 1..6: note = Synthetic Construct
AKIGDK

SEQ ID NO: 7609 - protein, 6 aa, synthetic construct
  REGION 1..6: note = Synthetic Construct
AKIGEK

SEQ ID NO: 7610 - protein, 6 aa, synthetic construct
  REGION 1..6: note = Synthetic Construct
AKIGFK

SEQ ID NO: 7611 - protein, 6 aa, synthetic construct
  REGION 1..6: note = Synthetic Construct
AKIGGK

SEQ ID NO: 7612 - protein, 6 aa, synthetic construct
  REGION 1..6: note = Synthetic Construct
AKIGHK

SEQ ID NO: 7613 - protein, 6 aa, synthetic construct
  REGION 1..6: note = Synthetic Construct
AKIGIK

SEQ ID NO: 7614 - protein, 6 aa, synthetic construct
  REGION 1..6: note = Synthetic Construct
AKIGLK

SEQ ID NO: 7615 - protein, 6 aa, synthetic construct
  REGION 1..6: note = Synthetic Construct
AKIGNK

SEQ ID NO: 7616 - protein, 6 aa, synthetic construct
  REGION 1..6: note = Synthetic Construct
AKIGQK

SEQ ID NO: 7617 - protein, 6 aa, synthetic construct
  REGION 1..6: note = Synthetic Construct
AKIGRK

SEQ ID NO: 7618 - protein, 6 aa, synthetic construct
  REGION 1..6: note = Synthetic Construct
AKIGSK

SEQ ID NO: 7619 - protein, 6 aa, synthetic construct
  REGION 1..6: note = Synthetic Construct
AKIGTK

SEQ ID NO: 7620 - protein, 6 aa, synthetic construct
  REGION 1..6: note = Synthetic Construct
AKIGYK

SEQ ID NO: 7621 - protein, 6 aa, synthetic construct
  REGION 1..6: note = Synthetic Construct
AKIHAK

SEQ ID NO: 7622 - protein, 6 aa, synthetic construct
  REGION 1..6: note = Synthetic Construct
AKIHDK

SEQ ID NO: 7623 - protein, 6 aa, synthetic construct
  REGION 1..6: note = Synthetic Construct
AKIHEK

SEQ ID NO: 7624 - protein, 6 aa, synthetic construct
  REGION 1..6: note = Synthetic Construct
AKIHFK

SEQ ID NO: 7625 - protein, 6 aa, synthetic construct
  REGION 1..6: note = Synthetic Construct
AKIHGK

SEQ ID NO: 7626 - protein, 6 aa, synthetic construct
  REGION 1..6: note = Synthetic Construct
AKIHHK

SEQ ID NO: 7627 - protein, 6 aa, synthetic construct
  REGION 1..6: note = Synthetic Construct
AKIHIK

SEQ ID NO: 7628 - protein, 6 aa, synthetic construct
  REGION 1..6: note = Synthetic Construct
AKIHLK

SEQ ID NO: 7629 - protein, 6 aa, synthetic construct
  REGION 1..6: note = Synthetic Construct
AKIHNK

SEQ ID NO: 7630 - protein, 6 aa, synthetic construct
  REGION 1..6: note = Synthetic Construct
AKIHQK

SEQ ID NO: 7631 - protein, 6 aa, synthetic construct
  REGION 1..6: note = Synthetic Construct
AKIHRK

SEQ ID NO: 7632 - protein, 6 aa, synthetic construct
  REGION 1..6: note = Synthetic Construct
AKIHSK

SEQ ID NO: 7633 - protein, 6 aa, synthetic construct
  REGION 1..6: note = Synthetic Construct
AKIHTK

SEQ ID NO: 7634 - protein, 6 aa, synthetic construct
  REGION 1..6: note = Synthetic Construct
AKIHYK

SEQ ID NO: 7635 - protein, 6 aa, synthetic construct
  REGION 1..6: note = Synthetic Construct
AKIIAK

SEQ ID NO: 7636 - protein, 6 aa, synthetic construct
  REGION 1..6: note = Synthetic Construct
AKIIDK

SEQ ID NO: 7637 - protein, 6 aa, synthetic construct
  REGION 1..6: note = Synthetic Construct
AKIIEK

SEQ ID NO: 7638 - protein, 6 aa, synthetic construct
  REGION 1..6: note = Synthetic Construct
AKIIFK

SEQ ID NO: 7639 - protein, 6 aa, synthetic construct
  REGION 1..6: note = Synthetic Construct
AKIIGK

SEQ ID NO: 7640 - protein, 6 aa, synthetic construct
  REGION 1..6: note = Synthetic Construct
AKIIHK

SEQ ID NO: 7641 - protein, 6 aa, synthetic construct
  REGION 1..6: note = Synthetic Construct
AKIIIK

SEQ ID NO: 7642 - protein, 6 aa, synthetic construct
  REGION 1..6: note = Synthetic Construct
AKIILK

SEQ ID NO: 7643 - protein, 6 aa, synthetic construct
  REGION 1..6: note = Synthetic Construct
AKIINK

SEQ ID NO: 7644 - protein, 6 aa, synthetic construct
  REGION 1..6: note = Synthetic Construct
AKIIQK

SEQ ID NO: 7645 - protein, 6 aa, synthetic construct
  REGION 1..6: note = Synthetic Construct
AKIIRK

SEQ ID NO: 7646 - protein, 6 aa, synthetic construct
  REGION 1..6: note = Synthetic Construct
AKIISK

SEQ ID NO: 7647 - protein, 6 aa, synthetic construct
  REGION 1..6: note = Synthetic Construct
AKIITK

SEQ ID NO: 7648 - protein, 6 aa, synthetic construct
  REGION 1..6: note = Synthetic Construct
AKIIYK

SEQ ID NO: 7649 - protein, 6 aa, synthetic construct
  REGION 1..6: note = Synthetic Construct
AKILAK

SEQ ID NO: 7650 - protein, 6 aa, synthetic construct
  REGION 1..6: note = Synthetic Construct
AKILDK

SEQ ID NO: 7651 - protein, 6 aa, synthetic construct
  REGION 1..6: note = Synthetic Construct
AKILEK

SEQ ID NO: 7652 - protein, 6 aa, synthetic construct
  REGION 1..6: note = Synthetic Construct
AKILFK

SEQ ID NO: 7653 - protein, 6 aa, synthetic construct
  REGION 1..6: note = Synthetic Construct
AKILGK

SEQ ID NO: 7654 - protein, 6 aa, synthetic construct
  REGION 1..6: note = Synthetic Construct
AKILHK

SEQ ID NO: 7655 - protein, 6 aa, synthetic construct
  REGION 1..6: note = Synthetic Construct
AKILIK

SEQ ID NO: 7656 - protein, 6 aa, synthetic construct
  REGION 1..6: note = Synthetic Construct
AKILLK

SEQ ID NO: 7657 - protein, 6 aa, synthetic construct
  REGION 1..6: note = Synthetic Construct
AKILNK

SEQ ID NO: 7658 - protein, 6 aa, synthetic construct
  REGION 1..6: note = Synthetic Construct
AKILQK

SEQ ID NO: 7659 - protein, 6 aa, synthetic construct
  REGION 1..6: note = Synthetic Construct
AKILRK

SEQ ID NO: 7660 - protein, 6 aa, synthetic construct
  REGION 1..6: note = Synthetic Construct
AKILSK

SEQ ID NO: 7661 - protein, 6 aa, synthetic construct
  REGION 1..6: note = Synthetic Construct
AKILTK

SEQ ID NO: 7662 - protein, 6 aa, synthetic construct
  REGION 1..6: note = Synthetic Construct
AKILYK

SEQ ID NO: 7663 - protein, 6 aa, synthetic construct
  REGION 1..6: note = Synthetic Construct
AKINAK

SEQ ID NO: 7664 - protein, 6 aa, synthetic construct
  REGION 1..6: note = Synthetic Construct
AKINDK

SEQ ID NO: 7665 - protein, 6 aa, synthetic construct
  REGION 1..6: note = Synthetic Construct
AKINEK

SEQ ID NO: 7666 - protein, 6 aa, synthetic construct
  REGION 1..6: note = Synthetic Construct
AKINFK

SEQ ID NO: 7667 - protein, 6 aa, synthetic construct
  REGION 1..6: note = Synthetic Construct
AKINGK

SEQ ID NO: 7668 - protein, 6 aa, synthetic construct
  REGION 1..6: note = Synthetic Construct
AKINHK

SEQ ID NO: 7669 - protein, 6 aa, synthetic construct
  REGION 1..6: note = Synthetic Construct
AKINIK

SEQ ID NO: 7670 - protein, 6 aa, synthetic construct
  REGION 1..6: note = Synthetic Construct
AKINLK

SEQ ID NO: 7671 - protein, 6 aa, synthetic construct
  REGION 1..6: note = Synthetic Construct
AKINNK

SEQ ID NO: 7672 - protein, 6 aa, synthetic construct
  REGION 1..6: note = Synthetic Construct
AKINQK

SEQ ID NO: 7673 - protein, 6 aa, synthetic construct
  REGION 1..6: note = Synthetic Construct
AKINRK

SEQ ID NO: 7674 - protein, 6 aa, synthetic construct
  REGION 1..6: note = Synthetic Construct
AKINSK

SEQ ID NO: 7675 - protein, 6 aa, synthetic construct
  REGION 1..6: note = Synthetic Construct
AKINTK

SEQ ID NO: 7676 - protein, 6 aa, synthetic construct
  REGION 1..6: note = Synthetic Construct
AKINYK

SEQ ID NO: 7677 - protein, 6 aa, synthetic construct
  REGION 1..6: note = Synthetic Construct
AKIQAK

SEQ ID NO: 7678 - protein, 6 aa, synthetic construct
  REGION 1..6: note = Synthetic Construct
AKIQDK

SEQ ID NO: 7679 - protein, 6 aa, synthetic construct
  REGION 1..6: note = Synthetic Construct
AKIQEK

SEQ ID NO: 7680 - protein, 6 aa, synthetic construct
  REGION 1..6: note = Synthetic Construct
AKIQFK

SEQ ID NO: 7681 - protein, 6 aa, synthetic construct
  REGION 1..6: note = Synthetic Construct
AKIQGK

SEQ ID NO: 7682 - protein, 6 aa, synthetic construct
  REGION 1..6: note = Synthetic Construct
AKIQHK

SEQ ID NO: 7683 - protein, 6 aa, synthetic construct
  REGION 1..6: note = Synthetic Construct
AKIQIK

SEQ ID NO: 7684 - protein, 6 aa, synthetic construct
  REGION 1..6: note = Synthetic Construct
AKIQLK

SEQ ID NO: 7685 - protein, 6 aa, synthetic construct
  REGION 1..6: note = Synthetic Construct
AKIQNK

SEQ ID NO: 7686 - protein, 6 aa, synthetic construct
  REGION 1..6: note = Synthetic Construct
AKIQQK

SEQ ID NO: 7687 - protein, 6 aa, synthetic construct
  REGION 1..6: note = Synthetic Construct
AKIQRK

SEQ ID NO: 7688 - protein, 6 aa, synthetic construct
  REGION 1..6: note = Synthetic Construct
AKIQSK

SEQ ID NO: 7689 - protein, 6 aa, synthetic construct
  REGION 1..6: note = Synthetic Construct
AKIQTK

SEQ ID NO: 7690 - protein, 6 aa, synthetic construct
  REGION 1..6: note = Synthetic Construct
AKIQYK

SEQ ID NO: 7691 - protein, 6 aa, synthetic construct
  REGION 1..6: note = Synthetic Construct
AKIRAK

SEQ ID NO: 7692 - protein, 6 aa, synthetic construct
  REGION 1..6: note = Synthetic Construct
AKIRDK

SEQ ID NO: 7693 - protein, 6 aa, synthetic construct
  REGION 1..6: note = Synthetic Construct
AKIREK

SEQ ID NO: 7694 - protein, 6 aa, synthetic construct
  REGION 1..6: note = Synthetic Construct
AKIRFK

SEQ ID NO: 7695 - protein, 6 aa, synthetic construct
  REGION 1..6: note = Synthetic Construct
AKIRGK

SEQ ID NO: 7696 - protein, 6 aa, synthetic construct
  REGION 1..6: note = Synthetic Construct
AKIRHK

SEQ ID NO: 7697 - protein, 6 aa, synthetic construct
  REGION 1..6: note = Synthetic Construct
AKIRIK

SEQ ID NO: 7698 - protein, 6 aa, synthetic construct
  REGION 1..6: note = Synthetic Construct
AKIRLK

SEQ ID NO: 7699 - protein, 6 aa, synthetic construct
  REGION 1..6: note = Synthetic Construct
AKIRNK

SEQ ID NO: 7700 - protein, 6 aa, synthetic construct
  REGION 1..6: note = Synthetic Construct
AKIRQK

SEQ ID NO: 7701 - protein, 6 aa, synthetic construct
  REGION 1..6: note = Synthetic Construct
AKIRRK

SEQ ID NO: 7702 - protein, 6 aa, synthetic construct
  REGION 1..6: note = Synthetic Construct
AKIRSK

SEQ ID NO: 7703 - protein, 6 aa, synthetic construct
  REGION 1..6: note = Synthetic Construct
AKIRTK

SEQ ID NO: 7704 - protein, 6 aa, synthetic construct
  REGION 1..6: note = Synthetic Construct
AKIRYK

SEQ ID NO: 7705 - protein, 6 aa, synthetic construct
  REGION 1..6: note = Synthetic Construct
AKISAK

SEQ ID NO: 7706 - protein, 6 aa, synthetic construct
  REGION 1..6: note = Synthetic Construct
AKISDK

SEQ ID NO: 7707 - protein, 6 aa, synthetic construct
  REGION 1..6: note = Synthetic Construct
AKISEK

SEQ ID NO: 7708 - protein, 6 aa, synthetic construct
  REGION 1..6: note = Synthetic Construct
AKISFK

SEQ ID NO: 7709 - protein, 6 aa, synthetic construct
  REGION 1..6: note = Synthetic Construct
AKISGK

SEQ ID NO: 7710 - protein, 6 aa, synthetic construct
  REGION 1..6: note = Synthetic Construct
AKISHK

SEQ ID NO: 7711 - protein, 6 aa, synthetic construct
  REGION 1..6: note = Synthetic Construct
AKISIK

SEQ ID NO: 7712 - protein, 6 aa, synthetic construct
  REGION 1..6: note = Synthetic Construct
AKISLK

SEQ ID NO: 7713 - protein, 6 aa, synthetic construct
  REGION 1..6: note = Synthetic Construct
AKISNK

SEQ ID NO: 7714 - protein, 6 aa, synthetic construct
  REGION 1..6: note = Synthetic Construct
AKISQK

SEQ ID NO: 7715 - protein, 6 aa, synthetic construct
  REGION 1..6: note = Synthetic Construct
AKISRK

SEQ ID NO: 7716 - protein, 6 aa, synthetic construct
  REGION 1..6: note = Synthetic Construct
AKISSK

SEQ ID NO: 7717 - protein, 6 aa, synthetic construct
  REGION 1..6: note = Synthetic Construct
AKISTK

SEQ ID NO: 7718 - protein, 6 aa, synthetic construct
  REGION 1..6: note = Synthetic Construct
AKISYK

SEQ ID NO: 7719 - protein, 6 aa, synthetic construct
  REGION 1..6: note = Synthetic Construct
AKITAK

SEQ ID NO: 7720 - protein, 6 aa, synthetic construct
  REGION 1..6: note = Synthetic Construct
AKITDK

SEQ ID NO: 7721 - protein, 6 aa, synthetic construct
  REGION 1..6: note = Synthetic Construct
AKITEK

SEQ ID NO: 7722 - protein, 6 aa, synthetic construct
  REGION 1..6: note = Synthetic Construct
AKITFK

SEQ ID NO: 7723 - protein, 6 aa, synthetic construct
  REGION 1..6: note = Synthetic Construct
AKITGK

SEQ ID NO: 7724 - protein, 6 aa, synthetic construct
  REGION 1..6: note = Synthetic Construct
AKITHK

SEQ ID NO: 7725 - protein, 6 aa, synthetic construct
  REGION 1..6: note = Synthetic Construct
AKITIK

SEQ ID NO: 7726 - protein, 6 aa, synthetic construct
  REGION 1..6: note = Synthetic Construct
AKITLK

SEQ ID NO: 7727 - protein, 6 aa, synthetic construct
  REGION 1..6: note = Synthetic Construct
AKITNK

SEQ ID NO: 7728 - protein, 6 aa, synthetic construct
  REGION 1..6: note = Synthetic Construct
AKITQK

SEQ ID NO: 7729 - protein, 6 aa, synthetic construct
  REGION 1..6: note = Synthetic Construct
AKITRK

SEQ ID NO: 7730 - protein, 6 aa, synthetic construct
  REGION 1..6: note = Synthetic Construct
AKITSK

SEQ ID NO: 7731 - protein, 6 aa, synthetic construct
  REGION 1..6: note = Synthetic Construct
AKITTK

SEQ ID NO: 7732 - protein, 6 aa, synthetic construct
  REGION 1..6: note = Synthetic Construct
AKITYK

SEQ ID NO: 7733 - protein, 6 aa, synthetic construct
  REGION 1..6: note = Synthetic Construct
AKIYAK

SEQ ID NO: 7734 - protein, 6 aa, synthetic construct
  REGION 1..6: note = Synthetic Construct
AKIYDK

SEQ ID NO: 7735 - protein, 6 aa, synthetic construct
  REGION 1..6: note = Synthetic Construct
AKIYEK

SEQ ID NO: 7736 - protein, 6 aa, synthetic construct
  REGION 1..6: note = Synthetic Construct
AKIYFK

SEQ ID NO: 7737 - protein, 6 aa, synthetic construct
  REGION 1..6: note = Synthetic Construct
AKIYGK

SEQ ID NO: 7738 - protein, 6 aa, synthetic construct
  REGION 1..6: note = Synthetic Construct
AKIYHK

SEQ ID NO: 7739 - protein, 6 aa, synthetic construct
  REGION 1..6: note = Synthetic Construct
AKIYIK

SEQ ID NO: 7740 - protein, 6 aa, synthetic construct
  REGION 1..6: note = Synthetic Construct
AKIYLK

SEQ ID NO: 7741 - protein, 6 aa, synthetic construct
  REGION 1..6: note = Synthetic Construct
AKIYNK

SEQ ID NO: 7742 - protein, 6 aa, synthetic construct
  REGION 1..6: note = Synthetic Construct
AKIYQK

SEQ ID NO: 7743 - protein, 6 aa, synthetic construct
  REGION 1..6: note = Synthetic Construct
AKIYRK

SEQ ID NO: 7744 - protein, 6 aa, synthetic construct
  REGION 1..6: note = Synthetic Construct
AKIYSK

SEQ ID NO: 7745 - protein, 6 aa, synthetic construct
  REGION 1..6: note = Synthetic Construct
AKIYTK

SEQ ID NO: 7746 - protein, 6 aa, synthetic construct
  REGION 1..6: note = Synthetic Construct
AKIYYK

SEQ ID NO: 7747 - protein, 6 aa, synthetic construct
  REGION 1..6: note = Synthetic Construct
AKLAAK

SEQ ID NO: 7748 - protein, 6 aa, synthetic construct
  REGION 1..6: note = Synthetic Construct
AKLADK

SEQ ID NO: 7749 - protein, 6 aa, synthetic construct
  REGION 1..6: note = Synthetic Construct
AKLAEK

SEQ ID NO: 7750 - protein, 6 aa, synthetic construct
  REGION 1..6: note = Synthetic Construct
AKLAFK

SEQ ID NO: 7751 - protein, 6 aa, synthetic construct
  REGION 1..6: note = Synthetic Construct
AKLAGK

SEQ ID NO: 7752 - protein, 6 aa, synthetic construct
  REGION 1..6: note = Synthetic Construct
AKLAHK

SEQ ID NO: 7753 - protein, 6 aa, synthetic construct
  REGION 1..6: note = Synthetic Construct
AKLAIK

SEQ ID NO: 7754 - protein, 6 aa, synthetic construct
  REGION 1..6: note = Synthetic Construct
AKLALK

SEQ ID NO: 7755 - protein, 6 aa, synthetic construct
  REGION 1..6: note = Synthetic Construct
AKLANK

SEQ ID NO: 7756 - protein, 6 aa, synthetic construct
  REGION 1..6: note = Synthetic Construct
AKLAQK

SEQ ID NO: 7757 - protein, 6 aa, synthetic construct
  REGION 1..6: note = Synthetic Construct
AKLARK

SEQ ID NO: 7758 - protein, 6 aa, synthetic construct
  REGION 1..6: note = Synthetic Construct
AKLASK

SEQ ID NO: 7759 - protein, 6 aa, synthetic construct
  REGION 1..6: note = Synthetic Construct
AKLATK

SEQ ID NO: 7760 - protein, 6 aa, synthetic construct
  REGION 1..6: note = Synthetic Construct
AKLAYK

SEQ ID NO: 7761 - protein, 6 aa, synthetic construct
  REGION 1..6: note = Synthetic Construct
AKLDAK

SEQ ID NO: 7762 - protein, 6 aa, synthetic construct
  REGION 1..6: note = Synthetic Construct
AKLDDK

SEQ ID NO: 7763 - protein, 6 aa, synthetic construct
  REGION 1..6: note = Synthetic Construct
AKLDEK

SEQ ID NO: 7764 - protein, 6 aa, synthetic construct
  REGION 1..6: note = Synthetic Construct
AKLDFK

SEQ ID NO: 7765 - protein, 6 aa, synthetic construct
  REGION 1..6: note = Synthetic Construct
AKLDGK

SEQ ID NO: 7766 - protein, 6 aa, synthetic construct
  REGION 1..6: note = Synthetic Construct
AKLDHK

SEQ ID NO: 7767 - protein, 6 aa, synthetic construct
  REGION 1..6: note = Synthetic Construct
AKLDIK

SEQ ID NO: 7768 - protein, 6 aa, synthetic construct
  REGION 1..6: note = Synthetic Construct
AKLDLK

SEQ ID NO: 7769 - protein, 6 aa, synthetic construct
  REGION 1..6: note = Synthetic Construct
AKLDNK

SEQ ID NO: 7770 - protein, 6 aa, synthetic construct
  REGION 1..6: note = Synthetic Construct
AKLDQK

SEQ ID NO: 7771 - protein, 6 aa, synthetic construct
  REGION 1..6: note = Synthetic Construct
AKLDRK

SEQ ID NO: 7772 - protein, 6 aa, synthetic construct
  REGION 1..6: note = Synthetic Construct
AKLDSK

SEQ ID NO: 7773 - protein, 6 aa, synthetic construct
  REGION 1..6: note = Synthetic Construct
AKLDTK

SEQ ID NO: 7774 - protein, 6 aa, synthetic construct
  REGION 1..6: note = Synthetic Construct
AKLDYK

SEQ ID NO: 7775 - protein, 6 aa, synthetic construct
  REGION 1..6: note = Synthetic Construct
AKLEAK

SEQ ID NO: 7776 - protein, 6 aa, synthetic construct
  REGION 1..6: note = Synthetic Construct
AKLEDK

SEQ ID NO: 7777 - protein, 6 aa, synthetic construct
  REGION 1..6: note = Synthetic Construct
AKLEEK

SEQ ID NO: 7778 - protein, 6 aa, synthetic construct
  REGION 1..6: note = Synthetic Construct
AKLEFK

SEQ ID NO: 7779 - protein, 6 aa, synthetic construct
  REGION 1..6: note = Synthetic Construct
AKLEGK

SEQ ID NO: 7780 - protein, 6 aa, synthetic construct
  REGION 1..6: note = Synthetic Construct
AKLEHK

SEQ ID NO: 7781 - protein, 6 aa, synthetic construct
  REGION 1..6: note = Synthetic Construct
AKLEIK

SEQ ID NO: 7782 - protein, 6 aa, synthetic construct
  REGION 1..6: note = Synthetic Construct
AKLELK

SEQ ID NO: 7783 - protein, 6 aa, synthetic construct
  REGION 1..6: note = Synthetic Construct
AKLENK

SEQ ID NO: 7784 - protein, 6 aa, synthetic construct
  REGION 1..6: note = Synthetic Construct
AKLEQK

SEQ ID NO: 7785 - protein, 6 aa, synthetic construct
  REGION 1..6: note = Synthetic Construct
AKLERK

SEQ ID NO: 7786 - protein, 6 aa, synthetic construct
  REGION 1..6: note = Synthetic Construct
AKLESK

SEQ ID NO: 7787 - protein, 6 aa, synthetic construct
  REGION 1..6: note = Synthetic Construct
AKLETK

SEQ ID NO: 7788 - protein, 6 aa, synthetic construct
  REGION 1..6: note = Synthetic Construct
AKLEYK

SEQ ID NO: 7789 - protein, 6 aa, synthetic construct
  REGION 1..6: note = Synthetic Construct
AKLFAK

SEQ ID NO: 7790 - protein, 6 aa, synthetic construct
  REGION 1..6: note = Synthetic Construct
AKLFDK

SEQ ID NO: 7791 - protein, 6 aa, synthetic construct
  REGION 1..6: note = Synthetic Construct
AKLFEK

SEQ ID NO: 7792 - protein, 6 aa, synthetic construct
  REGION 1..6: note = Synthetic Construct
AKLFFK

SEQ ID NO: 7793 - protein, 6 aa, synthetic construct
  REGION 1..6: note = Synthetic Construct
AKLFGK

SEQ ID NO: 7794 - protein, 6 aa, synthetic construct
  REGION 1..6: note = Synthetic Construct
AKLFHK

SEQ ID NO: 7795 - protein, 6 aa, synthetic construct
  REGION 1..6: note = Synthetic Construct
AKLFIK

SEQ ID NO: 7796 - protein, 6 aa, synthetic construct
  REGION 1..6: note = Synthetic Construct
AKLFLK

SEQ ID NO: 7797 - protein, 6 aa, synthetic construct
  REGION 1..6: note = Synthetic Construct
AKLFNK

SEQ ID NO: 7798 - protein, 6 aa, synthetic construct
  REGION 1..6: note = Synthetic Construct
AKLFQK

SEQ ID NO: 7799 - protein, 6 aa, synthetic construct
  REGION 1..6: note = Synthetic Construct
AKLFRK

SEQ ID NO: 7800 - protein, 6 aa, synthetic construct
  REGION 1..6: note = Synthetic Construct
AKLFSK

SEQ ID NO: 7801 - protein, 6 aa, synthetic construct
  REGION 1..6: note = Synthetic Construct
AKLFTK

SEQ ID NO: 7802 - protein, 6 aa, synthetic construct
  REGION 1..6: note = Synthetic Construct
AKLFYK

SEQ ID NO: 7803 - protein, 6 aa, synthetic construct
  REGION 1..6: note = Synthetic Construct
AKLGAK

SEQ ID NO: 7804 - protein, 6 aa, synthetic construct
  REGION 1..6: note = Synthetic Construct
AKLGDK

SEQ ID NO: 7805 - protein, 6 aa, synthetic construct
  REGION 1..6: note = Synthetic Construct
AKLGEK

SEQ ID NO: 7806 - protein, 6 aa, synthetic construct
  REGION 1..6: note = Synthetic Construct
AKLGFK

SEQ ID NO: 7807 - protein, 6 aa, synthetic construct
  REGION 1..6: note = Synthetic Construct
AKLGGK

SEQ ID NO: 7808 - protein, 6 aa, synthetic construct
  REGION 1..6: note = Synthetic Construct
AKLGHK

SEQ ID NO: 7809 - protein, 6 aa, synthetic construct
  REGION 1..6: note = Synthetic Construct
AKLGIK

SEQ ID NO: 7810 - protein, 6 aa, synthetic construct
  REGION 1..6: note = Synthetic Construct
AKLGLK

SEQ ID NO: 7811 - protein, 6 aa, synthetic construct
  REGION 1..6: note = Synthetic Construct
AKLGNK

SEQ ID NO: 7812 - protein, 6 aa, synthetic construct
  REGION 1..6: note = Synthetic Construct
AKLGQK

SEQ ID NO: 7813 - protein, 6 aa, synthetic construct
  REGION 1..6: note = Synthetic Construct
AKLGRK

SEQ ID NO: 7814 - protein, 6 aa, synthetic construct
  REGION 1..6: note = Synthetic Construct
AKLGSK

SEQ ID NO: 7815 - protein, 6 aa, synthetic construct
  REGION 1..6: note = Synthetic Construct
AKLGTK

SEQ ID NO: 7816 - protein, 6 aa, synthetic construct
  REGION 1..6: note = Synthetic Construct
AKLGYK

SEQ ID NO: 7817 - protein, 6 aa, synthetic construct
  REGION 1..6: note = Synthetic Construct
AKLHAK

SEQ ID NO: 7818 - protein, 6 aa, synthetic construct
  REGION 1..6: note = Synthetic Construct
AKLHDK

SEQ ID NO: 7819 - protein, 6 aa, synthetic construct
  REGION 1..6: note = Synthetic Construct
AKLHEK

SEQ ID NO: 7820 - protein, 6 aa, synthetic construct
  REGION 1..6: note = Synthetic Construct
AKLHFK

SEQ ID NO: 7821 - protein, 6 aa, synthetic construct
  REGION 1..6: note = Synthetic Construct
AKLHGK

SEQ ID NO: 7822 - protein, 6 aa, synthetic construct
  REGION 1..6: note = Synthetic Construct
AKLHHK

SEQ ID NO: 7823 - protein, 6 aa, synthetic construct
  REGION 1..6: note = Synthetic Construct
AKLHIK

SEQ ID NO: 7824 - protein, 6 aa, synthetic construct
  REGION 1..6: note = Synthetic Construct
AKLHLK

SEQ ID NO: 7825 - protein, 6 aa, synthetic construct
  REGION 1..6: note = Synthetic Construct
AKLHNK

SEQ ID NO: 7826 - protein, 6 aa, synthetic construct
  REGION 1..6: note = Synthetic Construct
AKLHQK

SEQ ID NO: 7827 - protein, 6 aa, synthetic construct
  REGION 1..6: note = Synthetic Construct
AKLHRK

SEQ ID NO: 7828 - protein, 6 aa, synthetic construct
  REGION 1..6: note = Synthetic Construct
AKLHSK

SEQ ID NO: 7829 - protein, 6 aa, synthetic construct
  REGION 1..6: note = Synthetic Construct
AKLHTK

SEQ ID NO: 7830 - protein, 6 aa, synthetic construct
  REGION 1..6: note = Synthetic Construct
AKLHYK

SEQ ID NO: 7831 - protein, 6 aa, synthetic construct
  REGION 1..6: note = Synthetic Construct
AKLIAK

SEQ ID NO: 7832 - protein, 6 aa, synthetic construct
  REGION 1..6: note = Synthetic Construct
AKLIDK

SEQ ID NO: 7833 - protein, 6 aa, synthetic construct
  REGION 1..6: note = Synthetic Construct
AKLIEK

SEQ ID NO: 7834 - protein, 6 aa, synthetic construct
  REGION 1..6: note = Synthetic Construct
AKLIFK

SEQ ID NO: 7835 - protein, 6 aa, synthetic construct
  REGION 1..6: note = Synthetic Construct
AKLIGK

SEQ ID NO: 7836 - protein, 6 aa, synthetic construct
  REGION 1..6: note = Synthetic Construct
AKLIHK

SEQ ID NO: 7837 - protein, 6 aa, synthetic construct
  REGION 1..6: note = Synthetic Construct
AKLIIK

SEQ ID NO: 7838 - protein, 6 aa, synthetic construct
  REGION 1..6: note = Synthetic Construct
AKLILK

SEQ ID NO: 7839 - protein, 6 aa, synthetic construct
  REGION 1..6: note = Synthetic Construct
AKLINK

SEQ ID NO: 7840 - protein, 6 aa, synthetic construct
  REGION 1..6: note = Synthetic Construct
AKLIQK

SEQ ID NO: 7841 - protein, 6 aa, synthetic construct
  REGION 1..6: note = Synthetic Construct
AKLIRK

SEQ ID NO: 7842 - protein, 6 aa, synthetic construct
  REGION 1..6: note = Synthetic Construct
AKLISK

SEQ ID NO: 7843 - protein, 6 aa, synthetic construct
  REGION 1..6: note = Synthetic Construct
AKLITK

SEQ ID NO: 7844 - protein, 6 aa, synthetic construct
  REGION 1..6: note = Synthetic Construct
AKLIYK

SEQ ID NO: 7845 - protein, 6 aa, synthetic construct
  REGION 1..6: note = Synthetic Construct
AKLLAK

SEQ ID NO: 7846 - protein, 6 aa, synthetic construct
  REGION 1..6: note = Synthetic Construct
AKLLDK

SEQ ID NO: 7847 - protein, 6 aa, synthetic construct
  REGION 1..6: note = Synthetic Construct
AKLLEK

SEQ ID NO: 7848 - protein, 6 aa, synthetic construct
  REGION 1..6: note = Synthetic Construct
AKLLFK

SEQ ID NO: 7849 - protein, 6 aa, synthetic construct
  REGION 1..6: note = Synthetic Construct
AKLLGK

SEQ ID NO: 7850 - protein, 6 aa, synthetic construct
  REGION 1..6: note = Synthetic Construct
AKLLHK

SEQ ID NO: 7851 - protein, 6 aa, synthetic construct
  REGION 1..6: note = Synthetic Construct
AKLLIK

SEQ ID NO: 7852 - protein, 6 aa, synthetic construct
  REGION 1..6: note = Synthetic Construct
AKLLLK

SEQ ID NO: 7853 - protein, 6 aa, synthetic construct
  REGION 1..6: note = Synthetic Construct
AKLLNK

SEQ ID NO: 7854 - protein, 6 aa, synthetic construct
  REGION 1..6: note = Synthetic Construct
AKLLQK

SEQ ID NO: 7855 - protein, 6 aa, synthetic construct
  REGION 1..6: note = Synthetic Construct
AKLLRK

SEQ ID NO: 7856 - protein, 6 aa, synthetic construct
  REGION 1..6: note = Synthetic Construct
AKLLSK

SEQ ID NO: 7857 - protein, 6 aa, synthetic construct
  REGION 1..6: note = Synthetic Construct
AKLLTK

SEQ ID NO: 7858 - protein, 6 aa, synthetic construct
  REGION 1..6: note = Synthetic Construct
AKLLYK

SEQ ID NO: 7859 - protein, 6 aa, synthetic construct
  REGION 1..6: note = Synthetic Construct
AKLNAK

SEQ ID NO: 7860 - protein, 6 aa, synthetic construct
  REGION 1..6: note = Synthetic Construct
AKLNDK

SEQ ID NO: 7861 - protein, 6 aa, synthetic construct
  REGION 1..6: note = Synthetic Construct
AKLNEK

SEQ ID NO: 7862 - protein, 6 aa, synthetic construct
  REGION 1..6: note = Synthetic Construct
AKLNFK

SEQ ID NO: 7863 - protein, 6 aa, synthetic construct
  REGION 1..6: note = Synthetic Construct
AKLNGK

SEQ ID NO: 7864 - protein, 6 aa, synthetic construct
  REGION 1..6: note = Synthetic Construct
AKLNHK

SEQ ID NO: 7865 - protein, 6 aa, synthetic construct
  REGION 1..6: note = Synthetic Construct
AKLNIK

SEQ ID NO: 7866 - protein, 6 aa, synthetic construct
  REGION 1..6: note = Synthetic Construct
AKLNLK

SEQ ID NO: 7867 - protein, 6 aa, synthetic construct
  REGION 1..6: note = Synthetic Construct
AKLNNK

SEQ ID NO: 7868 - protein, 6 aa, synthetic construct
  REGION 1..6: note = Synthetic Construct
AKLNQK

SEQ ID NO: 7869 - protein, 6 aa, synthetic construct
  REGION 1..6: note = Synthetic Construct
AKLNRK

SEQ ID NO: 7870 - protein, 6 aa, synthetic construct
  REGION 1..6: note = Synthetic Construct
AKLNSK

SEQ ID NO: 7871 - protein, 6 aa, synthetic construct
  REGION 1..6: note = Synthetic Construct
AKLNTK

SEQ ID NO: 7872 - protein, 6 aa, synthetic construct
  REGION 1..6: note = Synthetic Construct
AKLNYK

SEQ ID NO: 7873 - protein, 6 aa, synthetic construct
  REGION 1..6: note = Synthetic Construct
AKLQAK

SEQ ID NO: 7874 - protein, 6 aa, synthetic construct
  REGION 1..6: note = Synthetic Construct
AKLQDK

SEQ ID NO: 7875 - protein, 6 aa, synthetic construct
  REGION 1..6: note = Synthetic Construct
AKLQEK

SEQ ID NO: 7876 - protein, 6 aa, synthetic construct
  REGION 1..6: note = Synthetic Construct
AKLQFK

SEQ ID NO: 7877 - protein, 6 aa, synthetic construct
  REGION 1..6: note = Synthetic Construct
AKLQGK

SEQ ID NO: 7878 - protein, 6 aa, synthetic construct
  REGION 1..6: note = Synthetic Construct
AKLQHK

SEQ ID NO: 7879 - protein, 6 aa, synthetic construct
  REGION 1..6: note = Synthetic Construct
AKLQIK

SEQ ID NO: 7880 - protein, 6 aa, synthetic construct
  REGION 1..6: note = Synthetic Construct
AKLQLK

SEQ ID NO: 7881 - protein, 6 aa, synthetic construct
  REGION 1..6: note = Synthetic Construct
AKLQNK

SEQ ID NO: 7882 - protein, 6 aa, synthetic construct
  REGION 1..6: note = Synthetic Construct
AKLQQK

SEQ ID NO: 7883 - protein, 6 aa, synthetic construct
  REGION 1..6: note = Synthetic Construct
AKLQRK

SEQ ID NO: 7884 - protein, 6 aa, synthetic construct
  REGION 1..6: note = Synthetic Construct
AKLQSK

SEQ ID NO: 7885 - protein, 6 aa, synthetic construct
  REGION 1..6: note = Synthetic Construct
AKLQTK

SEQ ID NO: 7886 - protein, 6 aa, synthetic construct
  REGION 1..6: note = Synthetic Construct
AKLQYK

SEQ ID NO: 7887 - protein, 6 aa, synthetic construct
  REGION 1..6: note = Synthetic Construct
AKLRAK

SEQ ID NO: 7888 - protein, 6 aa, synthetic construct
  REGION 1..6: note = Synthetic Construct
AKLRDK

SEQ ID NO: 7889 - protein, 6 aa, synthetic construct
  REGION 1..6: note = Synthetic Construct
AKLREK

SEQ ID NO: 7890 - protein, 6 aa, synthetic construct
  REGION 1..6: note = Synthetic Construct
AKLRFK

SEQ ID NO: 7891 - protein, 6 aa, synthetic construct
  REGION 1..6: note = Synthetic Construct
AKLRGK

SEQ ID NO: 7892 - protein, 6 aa, synthetic construct
  REGION 1..6: note = Synthetic Construct
AKLRHK

SEQ ID NO: 7893 - protein, 6 aa, synthetic construct
  REGION 1..6: note = Synthetic Construct
AKLRIK

SEQ ID NO: 7894 - protein, 6 aa, synthetic construct
  REGION 1..6: note = Synthetic Construct
AKLRLK

SEQ ID NO: 7895 - protein, 6 aa, synthetic construct
  REGION 1..6: note = Synthetic Construct
AKLRNK

SEQ ID NO: 7896 - protein, 6 aa, synthetic construct
  REGION 1..6: note = Synthetic Construct
AKLRQK

SEQ ID NO: 7897 - protein, 6 aa, synthetic construct
  REGION 1..6: note = Synthetic Construct
AKLRRK

SEQ ID NO: 7898 - protein, 6 aa, synthetic construct
  REGION 1..6: note = Synthetic Construct
AKLRSK

SEQ ID NO: 7899 - protein, 6 aa, synthetic construct
  REGION 1..6: note = Synthetic Construct
AKLRTK

SEQ ID NO: 7900 - protein, 6 aa, synthetic construct
  REGION 1..6: note = Synthetic Construct
AKLRYK

SEQ ID NO: 7901 - protein, 6 aa, synthetic construct
  REGION 1..6: note = Synthetic Construct
AKLSAK

SEQ ID NO: 7902 - protein, 6 aa, synthetic construct
  REGION 1..6: note = Synthetic Construct
AKLSDK

SEQ ID NO: 7903 - protein, 6 aa, synthetic construct
  REGION 1..6: note = Synthetic Construct
AKLSEK

SEQ ID NO: 7904 - protein, 6 aa, synthetic construct
  REGION 1..6: note = Synthetic Construct
AKLSFK

SEQ ID NO: 7905 - protein, 6 aa, synthetic construct
  REGION 1..6: note = Synthetic Construct
AKLSGK

SEQ ID NO: 7906 - protein, 6 aa, synthetic construct
  REGION 1..6: note = Synthetic Construct
AKLSHK

SEQ ID NO: 7907 - protein, 6 aa, synthetic construct
  REGION 1..6: note = Synthetic Construct
AKLSIK

SEQ ID NO: 7908 - protein, 6 aa, synthetic construct
  REGION 1..6: note = Synthetic Construct
AKLSLK

SEQ ID NO: 7909 - protein, 6 aa, synthetic construct
  REGION 1..6: note = Synthetic Construct
AKLSNK

SEQ ID NO: 7910 - protein, 6 aa, synthetic construct
  REGION 1..6: note = Synthetic Construct
AKLSQK

SEQ ID NO: 7911 - protein, 6 aa, synthetic construct
  REGION 1..6: note = Synthetic Construct
AKLSRK

SEQ ID NO: 7912 - protein, 6 aa, synthetic construct
  REGION 1..6: note = Synthetic Construct
AKLSSK

SEQ ID NO: 7913 - protein, 6 aa, synthetic construct
  REGION 1..6: note = Synthetic Construct
AKLSTK

SEQ ID NO: 7914 - protein, 6 aa, synthetic construct
  REGION 1..6: note = Synthetic Construct
AKLSYK

SEQ ID NO: 7915 - protein, 6 aa, synthetic construct
  REGION 1..6: note = Synthetic Construct
AKLTAK

SEQ ID NO: 7916 - protein, 6 aa, synthetic construct
  REGION 1..6: note = Synthetic Construct
AKLTDK

SEQ ID NO: 7917 - protein, 6 aa, synthetic construct
  REGION 1..6: note = Synthetic Construct
AKLTEK

SEQ ID NO: 7918 - protein, 6 aa, synthetic construct
  REGION 1..6: note = Synthetic Construct
AKLTFK

SEQ ID NO: 7919 - protein, 6 aa, synthetic construct
  REGION 1..6: note = Synthetic Construct
AKLTGK

SEQ ID NO: 7920 - protein, 6 aa, synthetic construct
  REGION 1..6: note = Synthetic Construct
AKLTHK

SEQ ID NO: 7921 - protein, 6 aa, synthetic construct
  REGION 1..6: note = Synthetic Construct
AKLTIK

SEQ ID NO: 7922 - protein, 6 aa, synthetic construct
  REGION 1..6: note = Synthetic Construct
AKLTLK

SEQ ID NO: 7923 - protein, 6 aa, synthetic construct
  REGION 1..6: note = Synthetic Construct
AKLTNK

SEQ ID NO: 7924 - protein, 6 aa, synthetic construct
  REGION 1..6: note = Synthetic Construct
AKLTQK

SEQ ID NO: 7925 - protein, 6 aa, synthetic construct
  REGION 1..6: note = Synthetic Construct
AKLTRK

SEQ ID NO: 7926 - protein, 6 aa, synthetic construct
  REGION 1..6: note = Synthetic Construct
AKLTSK

SEQ ID NO: 7927 - protein, 6 aa, synthetic construct
  REGION 1..6: note = Synthetic Construct
AKLTTK

SEQ ID NO: 7928 - protein, 6 aa, synthetic construct
  REGION 1..6: note = Synthetic Construct
AKLTYK

SEQ ID NO: 7929 - protein, 6 aa, synthetic construct
  REGION 1..6: note = Synthetic Construct
AKLYAK

SEQ ID NO: 7930 - protein, 6 aa, synthetic construct
  REGION 1..6: note = Synthetic Construct
AKLYDK

SEQ ID NO: 7931 - protein, 6 aa, synthetic construct
  REGION 1..6: note = Synthetic Construct
AKLYEK

SEQ ID NO: 7932 - protein, 6 aa, synthetic construct
  REGION 1..6: note = Synthetic Construct
AKLYFK

SEQ ID NO: 7933 - protein, 6 aa, synthetic construct
  REGION 1..6: note = Synthetic Construct
AKLYGK

SEQ ID NO: 7934 - protein, 6 aa, synthetic construct
  REGION 1..6: note = Synthetic Construct
AKLYHK

SEQ ID NO: 7935 - protein, 6 aa, synthetic construct
  REGION 1..6: note = Synthetic Construct
AKLYIK

SEQ ID NO: 7936 - protein, 6 aa, synthetic construct
  REGION 1..6: note = Synthetic Construct
AKLYLK

SEQ ID NO: 7937 - protein, 6 aa, synthetic construct
  REGION 1..6: note = Synthetic Construct
AKLYNK

SEQ ID NO: 7938 - protein, 6 aa, synthetic construct
  REGION 1..6: note = Synthetic Construct
AKLYQK

SEQ ID NO: 7939 - protein, 6 aa, synthetic construct
  REGION 1..6: note = Synthetic Construct
AKLYRK

SEQ ID NO: 7940 - protein, 6 aa, synthetic construct
  REGION 1..6: note = Synthetic Construct
AKLYSK

SEQ ID NO: 7941 - protein, 6 aa, synthetic construct
  REGION 1..6: note = Synthetic Construct
AKLYTK

SEQ ID NO: 7942 - protein, 6 aa, synthetic construct
  REGION 1..6: note = Synthetic Construct
AKLYYK

SEQ ID NO: 7943 - protein, 6 aa, synthetic construct
  REGION 1..6: note = Synthetic Construct
AKNAAK

SEQ ID NO: 7944 - protein, 6 aa, synthetic construct
  REGION 1..6: note = Synthetic Construct
AKNADK

SEQ ID NO: 7945 - protein, 6 aa, synthetic construct
  REGION 1..6: note = Synthetic Construct
AKNAEK

SEQ ID NO: 7946 - protein, 6 aa, synthetic construct
  REGION 1..6: note = Synthetic Construct
AKNAFK

SEQ ID NO: 7947 - protein, 6 aa, synthetic construct
  REGION 1..6: note = Synthetic Construct
AKNAGK

SEQ ID NO: 7948 - protein, 6 aa, synthetic construct
  REGION 1..6: note = Synthetic Construct
AKNAHK

SEQ ID NO: 7949 - protein, 6 aa, synthetic construct
  REGION 1..6: note = Synthetic Construct
AKNAIK

SEQ ID NO: 7950 - protein, 6 aa, synthetic construct
  REGION 1..6: note = Synthetic Construct
AKNALK

SEQ ID NO: 7951 - protein, 6 aa, synthetic construct
  REGION 1..6: note = Synthetic Construct
AKNANK

SEQ ID NO: 7952 - protein, 6 aa, synthetic construct
  REGION 1..6: note = Synthetic Construct
AKNAQK

SEQ ID NO: 7953 - protein, 6 aa, synthetic construct
  REGION 1..6: note = Synthetic Construct
AKNARK

SEQ ID NO: 7954 - protein, 6 aa, synthetic construct
  REGION 1..6: note = Synthetic Construct
AKNASK

SEQ ID NO: 7955 - protein, 6 aa, synthetic construct
  REGION 1..6: note = Synthetic Construct
AKNATK

SEQ ID NO: 7956 - protein, 6 aa, synthetic construct
  REGION 1..6: note = Synthetic Construct
AKNAYK

SEQ ID NO: 7957 - protein, 6 aa, synthetic construct
  REGION 1..6: note = Synthetic Construct
AKNDAK

SEQ ID NO: 7958 - protein, 6 aa, synthetic construct
  REGION 1..6: note = Synthetic Construct
AKNDDK

SEQ ID NO: 7959 - protein, 6 aa, synthetic construct
  REGION 1..6: note = Synthetic Construct
AKNDEK

SEQ ID NO: 7960 - protein, 6 aa, synthetic construct
  REGION 1..6: note = Synthetic Construct
AKNDFK

SEQ ID NO: 7961 - protein, 6 aa, synthetic construct
  REGION 1..6: note = Synthetic Construct
AKNDGK

SEQ ID NO: 7962 - protein, 6 aa, synthetic construct
  REGION 1..6: note = Synthetic Construct
AKNDHK

SEQ ID NO: 7963 - protein, 6 aa, synthetic construct
  REGION 1..6: note = Synthetic Construct
AKNDIK

SEQ ID NO: 7964 - protein, 6 aa, synthetic construct
  REGION 1..6: note = Synthetic Construct
AKNDLK

SEQ ID NO: 7965 - protein, 6 aa, synthetic construct
  REGION 1..6: note = Synthetic Construct
AKNDNK

SEQ ID NO: 7966 - protein, 6 aa, synthetic construct
  REGION 1..6: note = Synthetic Construct
AKNDQK

SEQ ID NO: 7967 - protein, 6 aa, synthetic construct
  REGION 1..6: note = Synthetic Construct
AKNDRK

SEQ ID NO: 7968 - protein, 6 aa, synthetic construct
  REGION 1..6: note = Synthetic Construct
AKNDSK

SEQ ID NO: 7969 - protein, 6 aa, synthetic construct
  REGION 1..6: note = Synthetic Construct
AKNDTK

SEQ ID NO: 7970 - protein, 6 aa, synthetic construct
  REGION 1..6: note = Synthetic Construct
AKNDYK

SEQ ID NO: 7971 - protein, 6 aa, synthetic construct
  REGION 1..6: note = Synthetic Construct
AKNEAK

SEQ ID NO: 7972 - protein, 6 aa, synthetic construct
  REGION 1..6: note = Synthetic Construct
AKNEDK

SEQ ID NO: 7973 - protein, 6 aa, synthetic construct
  REGION 1..6: note = Synthetic Construct
AKNEEK

SEQ ID NO: 7974 - protein, 6 aa, synthetic construct
  REGION 1..6: note = Synthetic Construct
AKNEFK

SEQ ID NO: 7975 - protein, 6 aa, synthetic construct
  REGION 1..6: note = Synthetic Construct
AKNEGK

SEQ ID NO: 7976 - protein, 6 aa, synthetic construct
  REGION 1..6: note = Synthetic Construct
AKNEHK

SEQ ID NO: 7977 - protein, 6 aa, synthetic construct
  REGION 1..6: note = Synthetic Construct
AKNEIK

SEQ ID NO: 7978 - protein, 6 aa, synthetic construct
  REGION 1..6: note = Synthetic Construct
AKNELK

SEQ ID NO: 7979 - protein, 6 aa, synthetic construct
  REGION 1..6: note = Synthetic Construct
AKNENK

SEQ ID NO: 7980 - protein, 6 aa, synthetic construct
  REGION 1..6: note = Synthetic Construct
AKNEQK

SEQ ID NO: 7981 - protein, 6 aa, synthetic construct
  REGION 1..6: note = Synthetic Construct
AKNERK

SEQ ID NO: 7982 - protein, 6 aa, synthetic construct
  REGION 1..6: note = Synthetic Construct
AKNESK

SEQ ID NO: 7983 - protein, 6 aa, synthetic construct
  REGION 1..6: note = Synthetic Construct
AKNETK

SEQ ID NO: 7984 - protein, 6 aa, synthetic construct
  REGION 1..6: note = Synthetic Construct
AKNEYK

SEQ ID NO: 7985 - protein, 6 aa, synthetic construct
  REGION 1..6: note = Synthetic Construct
AKNFAK

SEQ ID NO: 7986 - protein, 6 aa, synthetic construct
  REGION 1..6: note = Synthetic Construct
AKNFDK

SEQ ID NO: 7987 - protein, 6 aa, synthetic construct
  REGION 1..6: note = Synthetic Construct
AKNFEK

SEQ ID NO: 7988 - protein, 6 aa, synthetic construct
  REGION 1..6: note = Synthetic Construct
AKNFFK

SEQ ID NO: 7989 - protein, 6 aa, synthetic construct
  REGION 1..6: note = Synthetic Construct
AKNFGK

SEQ ID NO: 7990 - protein, 6 aa, synthetic construct
  REGION 1..6: note = Synthetic Construct
AKNFHK

SEQ ID NO: 7991 - protein, 6 aa, synthetic construct
  REGION 1..6: note = Synthetic Construct
AKNFIK

SEQ ID NO: 7992 - protein, 6 aa, synthetic construct
  REGION 1..6: note = Synthetic Construct
AKNFLK

SEQ ID NO: 7993 - protein, 6 aa, synthetic construct
  REGION 1..6: note = Synthetic Construct
AKNFNK

SEQ ID NO: 7994 - protein, 6 aa, synthetic construct
  REGION 1..6: note = Synthetic Construct
AKNFQK

SEQ ID NO: 7995 - protein, 6 aa, synthetic construct
  REGION 1..6: note = Synthetic Construct
AKNFRK

SEQ ID NO: 7996 - protein, 6 aa, synthetic construct
  REGION 1..6: note = Synthetic Construct
AKNFSK

SEQ ID NO: 7997 - protein, 6 aa, synthetic construct
  REGION 1..6: note = Synthetic Construct
AKNFTK

SEQ ID NO: 7998 - protein, 6 aa, synthetic construct
  REGION 1..6: note = Synthetic Construct
AKNFYK

SEQ ID NO: 7999 - protein, 6 aa, synthetic construct
  REGION 1..6: note = Synthetic Construct
AKNGAK

SEQ ID NO: 8000 - protein, 6 aa, synthetic construct
  REGION 1..6: note = Synthetic Construct
AKNGDK

SEQ ID NO: 8001 - protein, 6 aa, synthetic construct
  REGION 1..6: note = Synthetic Construct
AKNGEK

SEQ ID NO: 8002 - protein, 6 aa, synthetic construct
  REGION 1..6: note = Synthetic Construct
AKNGFK

SEQ ID NO: 8003 - protein, 6 aa, synthetic construct
  REGION 1..6: note = Synthetic Construct
AKNGGK

SEQ ID NO: 8004 - protein, 6 aa, synthetic construct
  REGION 1..6: note = Synthetic Construct
AKNGHK

SEQ ID NO: 8005 - protein, 6 aa, synthetic construct
  REGION 1..6: note = Synthetic Construct
AKNGIK

SEQ ID NO: 8006 - protein, 6 aa, synthetic construct
  REGION 1..6: note = Synthetic Construct
AKNGLK

SEQ ID NO: 8007 - protein, 6 aa, synthetic construct
  REGION 1..6: note = Synthetic Construct
AKNGNK

SEQ ID NO: 8008 - protein, 6 aa, synthetic construct
  REGION 1..6: note = Synthetic Construct
AKNGQK

SEQ ID NO: 8009 - protein, 6 aa, synthetic construct
  REGION 1..6: note = Synthetic Construct
AKNGRK

SEQ ID NO: 8010 - protein, 6 aa, synthetic construct
  REGION 1..6: note = Synthetic Construct
AKNGSK

SEQ ID NO: 8011 - protein, 6 aa, synthetic construct
  REGION 1..6: note = Synthetic Construct
AKNGTK

SEQ ID NO: 8012 - protein, 6 aa, synthetic construct
  REGION 1..6: note = Synthetic Construct
AKNGYK

SEQ ID NO: 8013 - protein, 6 aa, synthetic construct
  REGION 1..6: note = Synthetic Construct
AKNHAK

SEQ ID NO: 8014 - protein, 6 aa, synthetic construct
  REGION 1..6: note = Synthetic Construct
AKNHDK

SEQ ID NO: 8015 - protein, 6 aa, synthetic construct
  REGION 1..6: note = Synthetic Construct
AKNHEK

SEQ ID NO: 8016 - protein, 6 aa, synthetic construct
  REGION 1..6: note = Synthetic Construct
AKNHFK

SEQ ID NO: 8017 - protein, 6 aa, synthetic construct
  REGION 1..6: note = Synthetic Construct
AKNHGK

SEQ ID NO: 8018 - protein, 6 aa, synthetic construct
  REGION 1..6: note = Synthetic Construct
AKNHHK

SEQ ID NO: 8019 - protein, 6 aa, synthetic construct
  REGION 1..6: note = Synthetic Construct
AKNHIK

SEQ ID NO: 8020 - protein, 6 aa, synthetic construct
  REGION 1..6: note = Synthetic Construct
AKNHLK

SEQ ID NO: 8021 - protein, 6 aa, synthetic construct
  REGION 1..6: note = Synthetic Construct
AKNHNK

SEQ ID NO: 8022 - protein, 6 aa, synthetic construct
  REGION 1..6: note = Synthetic Construct
AKNHQK

SEQ ID NO: 8023 - protein, 6 aa, synthetic construct
  REGION 1..6: note = Synthetic Construct
AKNHRK

SEQ ID NO: 8024 - protein, 6 aa, synthetic construct
  REGION 1..6: note = Synthetic Construct
AKNHSK

SEQ ID NO: 8025 - protein, 6 aa, synthetic construct
  REGION 1..6: note = Synthetic Construct
AKNHTK

SEQ ID NO: 8026 - protein, 6 aa, synthetic construct
  REGION 1..6: note = Synthetic Construct
AKNHYK

SEQ ID NO: 8027 - protein, 6 aa, synthetic construct
  REGION 1..6: note = Synthetic Construct
AKNIAK

SEQ ID NO: 8028 - protein, 6 aa, synthetic construct
  REGION 1..6: note = Synthetic Construct
AKNIDK

SEQ ID NO: 8029 - protein, 6 aa, synthetic construct
  REGION 1..6: note = Synthetic Construct
AKNIEK

SEQ ID NO: 8030 - protein, 6 aa, synthetic construct
  REGION 1..6: note = Synthetic Construct
AKNIFK

SEQ ID NO: 8031 - protein, 6 aa, synthetic construct
  REGION 1..6: note = Synthetic Construct
AKNIGK

SEQ ID NO: 8032 - protein, 6 aa, synthetic construct
  REGION 1..6: note = Synthetic Construct
AKNIHK

SEQ ID NO: 8033 - protein, 6 aa, synthetic construct
  REGION 1..6: note = Synthetic Construct
AKNIIK

SEQ ID NO: 8034 - protein, 6 aa, synthetic construct
  REGION 1..6: note = Synthetic Construct
AKNILK

SEQ ID NO: 8035 - protein, 6 aa, synthetic construct
  REGION 1..6: note = Synthetic Construct
AKNINK

SEQ ID NO: 8036 - protein, 6 aa, synthetic construct
  REGION 1..6: note = Synthetic Construct
AKNIQK

SEQ ID NO: 8037 - protein, 6 aa, synthetic construct
  REGION 1..6: note = Synthetic Construct
AKNIRK

SEQ ID NO: 8038 - protein, 6 aa, synthetic construct
  REGION 1..6: note = Synthetic Construct
AKNISK

SEQ ID NO: 8039 - protein, 6 aa, synthetic construct
  REGION 1..6: note = Synthetic Construct
AKNITK

SEQ ID NO: 8040 - protein, 6 aa, synthetic construct
  REGION 1..6: note = Synthetic Construct
AKNIYK

SEQ ID NO: 8041 - protein, 6 aa, synthetic construct
  REGION 1..6: note = Synthetic Construct
AKNLAK

SEQ ID NO: 8042 - protein, 6 aa, synthetic construct
  REGION 1..6: note = Synthetic Construct
AKNLDK

SEQ ID NO: 8043 - protein, 6 aa, synthetic construct
  REGION 1..6: note = Synthetic Construct
AKNLEK

SEQ ID NO: 8044 - protein, 6 aa, synthetic construct
  REGION 1..6: note = Synthetic Construct
AKNLFK

SEQ ID NO: 8045 - protein, 6 aa, synthetic construct
  REGION 1..6: note = Synthetic Construct
AKNLGK

SEQ ID NO: 8046 - protein, 6 aa, synthetic construct
  REGION 1..6: note = Synthetic Construct
AKNLHK

SEQ ID NO: 8047 - protein, 6 aa, synthetic construct
  REGION 1..6: note = Synthetic Construct
AKNLIK

SEQ ID NO: 8048 - protein, 6 aa, synthetic construct
  REGION 1..6: note = Synthetic Construct
AKNLLK

SEQ ID NO: 8049 - protein, 6 aa, synthetic construct
  REGION 1..6: note = Synthetic Construct
AKNLNK

SEQ ID NO: 8050 - protein, 6 aa, synthetic construct
  REGION 1..6: note = Synthetic Construct
AKNLQK

SEQ ID NO: 8051 - protein, 6 aa, synthetic construct
  REGION 1..6: note = Synthetic Construct
AKNLRK

SEQ ID NO: 8052 - protein, 6 aa, synthetic construct
  REGION 1..6: note = Synthetic Construct
AKNLSK

SEQ ID NO: 8053 - protein, 6 aa, synthetic construct
  REGION 1..6: note = Synthetic Construct
AKNLTK

SEQ ID NO: 8054 - protein, 6 aa, synthetic construct
  REGION 1..6: note = Synthetic Construct
AKNLYK

SEQ ID NO: 8055 - protein, 6 aa, synthetic construct
  REGION 1..6: note = Synthetic Construct
AKNNAK

SEQ ID NO: 8056 - protein, 6 aa, synthetic construct
  REGION 1..6: note = Synthetic Construct
AKNNDK

SEQ ID NO: 8057 - protein, 6 aa, synthetic construct
  REGION 1..6: note = Synthetic Construct
AKNNEK

SEQ ID NO: 8058 - protein, 6 aa, synthetic construct
  REGION 1..6: note = Synthetic Construct
AKNNFK

SEQ ID NO: 8059 - protein, 6 aa, synthetic construct
  REGION 1..6: note = Synthetic Construct
AKNNGK

SEQ ID NO: 8060 - protein, 6 aa, synthetic construct
  REGION 1..6: note = Synthetic Construct
AKNNHK

SEQ ID NO: 8061 - protein, 6 aa, synthetic construct
  REGION 1..6: note = Synthetic Construct
AKNNIK

SEQ ID NO: 8062 - protein, 6 aa, synthetic construct
  REGION 1..6: note = Synthetic Construct
AKNNLK

SEQ ID NO: 8063 - protein, 6 aa, synthetic construct
  REGION 1..6: note = Synthetic Construct
AKNNNK

SEQ ID NO: 8064 - protein, 6 aa, synthetic construct
  REGION 1..6: note = Synthetic Construct
AKNNQK

SEQ ID NO: 8065 - protein, 6 aa, synthetic construct
  REGION 1..6: note = Synthetic Construct
AKNNRK

SEQ ID NO: 8066 - protein, 6 aa, synthetic construct
  REGION 1..6: note = Synthetic Construct
AKNNSK

SEQ ID NO: 8067 - protein, 6 aa, synthetic construct
  REGION 1..6: note = Synthetic Construct
AKNNTK

SEQ ID NO: 8068 - protein, 6 aa, synthetic construct
  REGION 1..6: note = Synthetic Construct
AKNNYK

SEQ ID NO: 8069 - protein, 6 aa, synthetic construct
  REGION 1..6: note = Synthetic Construct
AKNQAK

SEQ ID NO: 8070 - protein, 6 aa, synthetic construct
  REGION 1..6: note = Synthetic Construct
AKNQDK

SEQ ID NO: 8071 - protein, 6 aa, synthetic construct
  REGION 1..6: note = Synthetic Construct
AKNQEK

SEQ ID NO: 8072 - protein, 6 aa, synthetic construct
  REGION 1..6: note = Synthetic Construct
AKNQFK

SEQ ID NO: 8073 - protein, 6 aa, synthetic construct
  REGION 1..6: note = Synthetic Construct
AKNQGK

SEQ ID NO: 8074 - protein, 6 aa, synthetic construct
  REGION 1..6: note = Synthetic Construct
AKNQHK

SEQ ID NO: 8075 - protein, 6 aa, synthetic construct
  REGION 1..6: note = Synthetic Construct
AKNQIK

SEQ ID NO: 8076 - protein, 6 aa, synthetic construct
  REGION 1..6: note = Synthetic Construct
AKNQLK

SEQ ID NO: 8077 - protein, 6 aa, synthetic construct
  REGION 1..6: note = Synthetic Construct
AKNQNK

SEQ ID NO: 8078 - protein, 6 aa, synthetic construct
  REGION 1..6: note = Synthetic Construct
AKNQQK

SEQ ID NO: 8079 - protein, 6 aa, synthetic construct
  REGION 1..6: note = Synthetic Construct
AKNQRK

SEQ ID NO: 8080 - protein, 6 aa, synthetic construct
  REGION 1..6: note = Synthetic Construct
AKNQSK

SEQ ID NO: 8081 - protein, 6 aa, synthetic construct
  REGION 1..6: note = Synthetic Construct
AKNQTK

SEQ ID NO: 8082 - protein, 6 aa, synthetic construct
  REGION 1..6: note = Synthetic Construct
AKNQYK

SEQ ID NO: 8083 - protein, 6 aa, synthetic construct
  REGION 1..6: note = Synthetic Construct
AKNRAK

SEQ ID NO: 8084 - protein, 6 aa, synthetic construct
  REGION 1..6: note = Synthetic Construct
AKNRDK

SEQ ID NO: 8085 - protein, 6 aa, synthetic construct
  REGION 1..6: note = Synthetic Construct
AKNREK

SEQ ID NO: 8086 - protein, 6 aa, synthetic construct
  REGION 1..6: note = Synthetic Construct
AKNRFK

SEQ ID NO: 8087 - protein, 6 aa, synthetic construct
  REGION 1..6: note = Synthetic Construct
AKNRGK

SEQ ID NO: 8088 - protein, 6 aa, synthetic construct
  REGION 1..6: note = Synthetic Construct
AKNRHK

SEQ ID NO: 8089 - protein, 6 aa, synthetic construct
  REGION 1..6: note = Synthetic Construct
AKNRIK

SEQ ID NO: 8090 - protein, 6 aa, synthetic construct
  REGION 1..6: note = Synthetic Construct
AKNRLK

SEQ ID NO: 8091 - protein, 6 aa, synthetic construct
  REGION 1..6: note = Synthetic Construct
AKNRNK

SEQ ID NO: 8092 - protein, 6 aa, synthetic construct
  REGION 1..6: note = Synthetic Construct
AKNRQK

SEQ ID NO: 8093 - protein, 6 aa, synthetic construct
  REGION 1..6: note = Synthetic Construct
AKNRRK

SEQ ID NO: 8094 - protein, 6 aa, synthetic construct
  REGION 1..6: note = Synthetic Construct
AKNRSK

SEQ ID NO: 8095 - protein, 6 aa, synthetic construct
  REGION 1..6: note = Synthetic Construct
AKNRTK

SEQ ID NO: 8096 - protein, 6 aa, synthetic construct
  REGION 1..6: note = Synthetic Construct
AKNRYK

SEQ ID NO: 8097 - protein, 6 aa, synthetic construct
  REGION 1..6: note = Synthetic Construct
AKNSAK

SEQ ID NO: 8098 - protein, 6 aa, synthetic construct
  REGION 1..6: note = Synthetic Construct
AKNSDK

SEQ ID NO: 8099 - protein, 6 aa, synthetic construct
  REGION 1..6: note = Synthetic Construct
AKNSEK

SEQ ID NO: 8100 - protein, 6 aa, synthetic construct
  REGION 1..6: note = Synthetic Construct
AKNSFK

SEQ ID NO: 8101 - protein, 6 aa, synthetic construct
  REGION 1..6: note = Synthetic Construct
AKNSGK

SEQ ID NO: 8102 - protein, 6 aa, synthetic construct
  REGION 1..6: note = Synthetic Construct
AKNSHK

SEQ ID NO: 8103 - protein, 6 aa, synthetic construct
  REGION 1..6: note = Synthetic Construct
AKNSIK

SEQ ID NO: 8104 - protein, 6 aa, synthetic construct
  REGION 1..6: note = Synthetic Construct
AKNSLK

SEQ ID NO: 8105 - protein, 6 aa, synthetic construct
  REGION 1..6: note = Synthetic Construct
AKNSNK

SEQ ID NO: 8106 - protein, 6 aa, synthetic construct
  REGION 1..6: note = Synthetic Construct
AKNSQK

SEQ ID NO: 8107 - protein, 6 aa, synthetic construct
  REGION 1..6: note = Synthetic Construct
AKNSRK

SEQ ID NO: 8108 - protein, 6 aa, synthetic construct
  REGION 1..6: note = Synthetic Construct
AKNSSK

SEQ ID NO: 8109 - protein, 6 aa, synthetic construct
  REGION 1..6: note = Synthetic Construct
AKNSTK

SEQ ID NO: 8110 - protein, 6 aa, synthetic construct
  REGION 1..6: note = Synthetic Construct
AKNSYK

SEQ ID NO: 8111 - protein, 6 aa, synthetic construct
  REGION 1..6: note = Synthetic Construct
AKNTAK

SEQ ID NO: 8112 - protein, 6 aa, synthetic construct
  REGION 1..6: note = Synthetic Construct
AKNTDK

SEQ ID NO: 8113 - protein, 6 aa, synthetic construct
  REGION 1..6: note = Synthetic Construct
AKNTEK

SEQ ID NO: 8114 - protein, 6 aa, synthetic construct
  REGION 1..6: note = Synthetic Construct
AKNTFK

SEQ ID NO: 8115 - protein, 6 aa, synthetic construct
  REGION 1..6: note = Synthetic Construct
AKNTGK

SEQ ID NO: 8116 - protein, 6 aa, synthetic construct
  REGION 1..6: note = Synthetic Construct
AKNTHK

SEQ ID NO: 8117 - protein, 6 aa, synthetic construct
  REGION 1..6: note = Synthetic Construct
AKNTIK

SEQ ID NO: 8118 - protein, 6 aa, synthetic construct
  REGION 1..6: note = Synthetic Construct
AKNTLK

SEQ ID NO: 8119 - protein, 6 aa, synthetic construct
  REGION 1..6: note = Synthetic Construct
AKNTNK

SEQ ID NO: 8120 - protein, 6 aa, synthetic construct
  REGION 1..6: note = Synthetic Construct
AKNTQK

SEQ ID NO: 8121 - protein, 6 aa, synthetic construct
  REGION 1..6: note = Synthetic Construct
AKNTRK

SEQ ID NO: 8122 - protein, 6 aa, synthetic construct
  REGION 1..6: note = Synthetic Construct
AKNTSK

SEQ ID NO: 8123 - protein, 6 aa, synthetic construct
  REGION 1..6: note = Synthetic Construct
AKNTTK

SEQ ID NO: 8124 - protein, 6 aa, synthetic construct
  REGION 1..6: note = Synthetic Construct
AKNTYK

SEQ ID NO: 8125 - protein, 6 aa, synthetic construct
  REGION 1..6: note = Synthetic Construct
AKNYAK

SEQ ID NO: 8126 - protein, 6 aa, synthetic construct
  REGION 1..6: note = Synthetic Construct
AKNYDK

SEQ ID NO: 8127 - protein, 6 aa, synthetic construct
  REGION 1..6: note = Synthetic Construct
AKNYEK

SEQ ID NO: 8128 - protein, 6 aa, synthetic construct
  REGION 1..6: note = Synthetic Construct
AKNYFK

SEQ ID NO: 8129 - protein, 6 aa, synthetic construct
  REGION 1..6: note = Synthetic Construct
AKNYGK

SEQ ID NO: 8130 - protein, 6 aa, synthetic construct
  REGION 1..6: note = Synthetic Construct
AKNYHK

SEQ ID NO: 8131 - protein, 6 aa, synthetic construct
  REGION 1..6: note = Synthetic Construct
AKNYIK

SEQ ID NO: 8132 - protein, 6 aa, synthetic construct
  REGION 1..6: note = Synthetic Construct
AKNYLK

SEQ ID NO: 8133 - protein, 6 aa, synthetic construct
  REGION 1..6: note = Synthetic Construct
AKNYNK

SEQ ID NO: 8134 - protein, 6 aa, synthetic construct
  REGION 1..6: note = Synthetic Construct
AKNYQK

SEQ ID NO: 8135 - protein, 6 aa, synthetic construct
  REGION 1..6: note = Synthetic Construct
AKNYRK

SEQ ID NO: 8136 - protein, 6 aa, synthetic construct
  REGION 1..6: note = Synthetic Construct
AKNYSK

SEQ ID NO: 8137 - protein, 6 aa, synthetic construct
  REGION 1..6: note = Synthetic Construct
AKNYTK

SEQ ID NO: 8138 - protein, 6 aa, synthetic construct
  REGION 1..6: note = Synthetic Construct
AKNYYK

SEQ ID NO: 8139 - protein, 6 aa, synthetic construct
  REGION 1..6: note = Synthetic Construct
AKPAAK

SEQ ID NO: 8140 - protein, 6 aa, synthetic construct
  REGION 1..6: note = Synthetic Construct
AKPADK

SEQ ID NO: 8141 - protein, 6 aa, synthetic construct
  REGION 1..6: note = Synthetic Construct
AKPAEK

SEQ ID NO: 8142 - protein, 6 aa, synthetic construct
  REGION 1..6: note = Synthetic Construct
AKPAFK

SEQ ID NO: 8143 - protein, 6 aa, synthetic construct
  REGION 1..6: note = Synthetic Construct
AKPAGK

SEQ ID NO: 8144 - protein, 6 aa, synthetic construct
  REGION 1..6: note = Synthetic Construct
AKPAHK

SEQ ID NO: 8145 - protein, 6 aa, synthetic construct
  REGION 1..6: note = Synthetic Construct
AKPAIK

SEQ ID NO: 8146 - protein, 6 aa, synthetic construct
  REGION 1..6: note = Synthetic Construct
AKPALK

SEQ ID NO: 8147 - protein, 6 aa, synthetic construct
  REGION 1..6: note = Synthetic Construct
AKPANK

SEQ ID NO: 8148 - protein, 6 aa, synthetic construct
  REGION 1..6: note = Synthetic Construct
AKPAQK

SEQ ID NO: 8149 - protein, 6 aa, synthetic construct
  REGION 1..6: note = Synthetic Construct
AKPARK

SEQ ID NO: 8150 - protein, 6 aa, synthetic construct
  REGION 1..6: note = Synthetic Construct
AKPASK

SEQ ID NO: 8151 - protein, 6 aa, synthetic construct
  REGION 1..6: note = Synthetic Construct
AKPATK

SEQ ID NO: 8152 - protein, 6 aa, synthetic construct
  REGION 1..6: note = Synthetic Construct
AKPAYK

SEQ ID NO: 8153 - protein, 6 aa, synthetic construct
  REGION 1..6: note = Synthetic Construct
AKPDAK

SEQ ID NO: 8154 - protein, 6 aa, synthetic construct
  REGION 1..6: note = Synthetic Construct
AKPDDK

SEQ ID NO: 8155 - protein, 6 aa, synthetic construct
  REGION 1..6: note = Synthetic Construct
AKPDEK

SEQ ID NO: 8156 - protein, 6 aa, synthetic construct
  REGION 1..6: note = Synthetic Construct
AKPDFK

SEQ ID NO: 8157 - protein, 6 aa, synthetic construct
  REGION 1..6: note = Synthetic Construct
AKPDGK

SEQ ID NO: 8158 - protein, 6 aa, synthetic construct
  REGION 1..6: note = Synthetic Construct
AKPDHK

SEQ ID NO: 8159 - protein, 6 aa, synthetic construct
  REGION 1..6: note = Synthetic Construct
AKPDIK

SEQ ID NO: 8160 - protein, 6 aa, synthetic construct
  REGION 1..6: note = Synthetic Construct
AKPDLK

SEQ ID NO: 8161 - protein, 6 aa, synthetic construct
  REGION 1..6: note = Synthetic Construct
AKPDNK

SEQ ID NO: 8162 - protein, 6 aa, synthetic construct
  REGION 1..6: note = Synthetic Construct
AKPDQK

SEQ ID NO: 8163 - protein, 6 aa, synthetic construct
  REGION 1..6: note = Synthetic Construct
AKPDRK

SEQ ID NO: 8164 - protein, 6 aa, synthetic construct
  REGION 1..6: note = Synthetic Construct
AKPDSK

SEQ ID NO: 8165 - protein, 6 aa, synthetic construct
  REGION 1..6: note = Synthetic Construct
AKPDTK

SEQ ID NO: 8166 - protein, 6 aa, synthetic construct
  REGION 1..6: note = Synthetic Construct
AKPDYK

SEQ ID NO: 8167 - protein, 6 aa, synthetic construct
  REGION 1..6: note = Synthetic Construct
AKPEAK

SEQ ID NO: 8168 - protein, 6 aa, synthetic construct
  REGION 1..6: note = Synthetic Construct
AKPEDK

SEQ ID NO: 8169 - protein, 6 aa, synthetic construct
  REGION 1..6: note = Synthetic Construct
AKPEEK

SEQ ID NO: 8170 - protein, 6 aa, synthetic construct
  REGION 1..6: note = Synthetic Construct
AKPEFK

SEQ ID NO: 8171 - protein, 6 aa, synthetic construct
  REGION 1..6: note = Synthetic Construct
AKPEGK

SEQ ID NO: 8172 - protein, 6 aa, synthetic construct
  REGION 1..6: note = Synthetic Construct
AKPEHK

SEQ ID NO: 8173 - protein, 6 aa, synthetic construct
  REGION 1..6: note = Synthetic Construct
AKPEIK

SEQ ID NO: 8174 - protein, 6 aa, synthetic construct
  REGION 1..6: note = Synthetic Construct
AKPELK

SEQ ID NO: 8175 - protein, 6 aa, synthetic construct
  REGION 1..6: note = Synthetic Construct
AKPENK

SEQ ID NO: 8176 - protein, 6 aa, synthetic construct
  REGION 1..6: note = Synthetic Construct
AKPEQK

SEQ ID NO: 8177 - protein, 6 aa, synthetic construct
  REGION 1..6: note = Synthetic Construct
AKPERK

SEQ ID NO: 8178 - protein, 6 aa, synthetic construct
  REGION 1..6: note = Synthetic Construct
AKPESK

SEQ ID NO: 8179 - protein, 6 aa, synthetic construct
  REGION 1..6: note = Synthetic Construct
AKPETK

SEQ ID NO: 8180 - protein, 6 aa, synthetic construct
  REGION 1..6: note = Synthetic Construct
AKPEYK

SEQ ID NO: 8181 - protein, 6 aa, synthetic construct
  REGION 1..6: note = Synthetic Construct
AKPFAK

SEQ ID NO: 8182 - protein, 6 aa, synthetic construct
  REGION 1..6: note = Synthetic Construct
AKPFDK

SEQ ID NO: 8183 - protein, 6 aa, synthetic construct
  REGION 1..6: note = Synthetic Construct
AKPFEK

SEQ ID NO: 8184 - protein, 6 aa, synthetic construct
  REGION 1..6: note = Synthetic Construct
AKPFFK

SEQ ID NO: 8185 - protein, 6 aa, synthetic construct
  REGION 1..6: note = Synthetic Construct
AKPFGK

SEQ ID NO: 8186 - protein, 6 aa, synthetic construct
  REGION 1..6: note = Synthetic Construct
AKPFHK

SEQ ID NO: 8187 - protein, 6 aa, synthetic construct
  REGION 1..6: note = Synthetic Construct
AKPFIK

SEQ ID NO: 8188 - protein, 6 aa, synthetic construct
  REGION 1..6: note = Synthetic Construct
AKPFLK

SEQ ID NO: 8189 - protein, 6 aa, synthetic construct
  REGION 1..6: note = Synthetic Construct
AKPFNK

SEQ ID NO: 8190 - protein, 6 aa, synthetic construct
  REGION 1..6: note = Synthetic Construct
AKPFQK

SEQ ID NO: 8191 - protein, 6 aa, synthetic construct
  REGION 1..6: note = Synthetic Construct
AKPFRK

SEQ ID NO: 8192 - protein, 6 aa, synthetic construct
  REGION 1..6: note = Synthetic Construct
AKPFSK

SEQ ID NO: 8193 - protein, 6 aa, synthetic construct
  REGION 1..6: note = Synthetic Construct
AKPFTK

SEQ ID NO: 8194 - protein, 6 aa, synthetic construct
  REGION 1..6: note = Synthetic Construct
AKPFYK

SEQ ID NO: 8195 - protein, 6 aa, synthetic construct
  REGION 1..6: note = Synthetic Construct
AKPGAK

SEQ ID NO: 8196 - protein, 6 aa, synthetic construct
  REGION 1..6: note = Synthetic Construct
AKPGDK

SEQ ID NO: 8197 - protein, 6 aa, synthetic construct
  REGION 1..6: note = Synthetic Construct
AKPGEK

SEQ ID NO: 8198 - protein, 6 aa, synthetic construct
  REGION 1..6: note = Synthetic Construct
AKPGFK

SEQ ID NO: 8199 - protein, 6 aa, synthetic construct
  REGION 1..6: note = Synthetic Construct
AKPGGK

SEQ ID NO: 8200 - protein, 6 aa, synthetic construct
  REGION 1..6: note = Synthetic Construct
AKPGHK

SEQ ID NO: 8201 - protein, 6 aa, synthetic construct
  REGION 1..6: note = Synthetic Construct
AKPGIK

SEQ ID NO: 8202 - protein, 6 aa, synthetic construct
  REGION 1..6: note = Synthetic Construct
AKPGLK

SEQ ID NO: 8203 - protein, 6 aa, synthetic construct
  REGION 1..6: note = Synthetic Construct
AKPGNK

SEQ ID NO: 8204 - protein, 6 aa, synthetic construct
  REGION 1..6: note = Synthetic Construct
AKPGQK

SEQ ID NO: 8205 - protein, 6 aa, synthetic construct
  REGION 1..6: note = Synthetic Construct
AKPGRK

SEQ ID NO: 8206 - protein, 6 aa, synthetic construct
  REGION 1..6: note = Synthetic Construct
AKPGSK

SEQ ID NO: 8207 - protein, 6 aa, synthetic construct
  REGION 1..6: note = Synthetic Construct
AKPGTK

SEQ ID NO: 8208 - protein, 6 aa, synthetic construct
  REGION 1..6: note = Synthetic Construct
AKPGYK

SEQ ID NO: 8209 - protein, 6 aa, synthetic construct
  REGION 1..6: note = Synthetic Construct
AKPHAK

SEQ ID NO: 8210 - protein, 6 aa, synthetic construct
  REGION 1..6: note = Synthetic Construct
AKPHDK

SEQ ID NO: 8211 - protein, 6 aa, synthetic construct
  REGION 1..6: note = Synthetic Construct
AKPHEK

SEQ ID NO: 8212 - protein, 6 aa, synthetic construct
  REGION 1..6: note = Synthetic Construct
AKPHFK

SEQ ID NO: 8213 - protein, 6 aa, synthetic construct
  REGION 1..6: note = Synthetic Construct
AKPHGK

SEQ ID NO: 8214 - protein, 6 aa, synthetic construct
  REGION 1..6: note = Synthetic Construct
AKPHHK

SEQ ID NO: 8215 - protein, 6 aa, synthetic construct
  REGION 1..6: note = Synthetic Construct
AKPHIK

SEQ ID NO: 8216 - protein, 6 aa, synthetic construct
  REGION 1..6: note = Synthetic Construct
AKPHLK

SEQ ID NO: 8217 - protein, 6 aa, synthetic construct
  REGION 1..6: note = Synthetic Construct
AKPHNK

SEQ ID NO: 8218 - protein, 6 aa, synthetic construct
  REGION 1..6: note = Synthetic Construct
AKPHQK

SEQ ID NO: 8219 - protein, 6 aa, synthetic construct
  REGION 1..6: note = Synthetic Construct
AKPHRK

SEQ ID NO: 8220 - protein, 6 aa, synthetic construct
  REGION 1..6: note = Synthetic Construct
AKPHSK

SEQ ID NO: 8221 - protein, 6 aa, synthetic construct
  REGION 1..6: note = Synthetic Construct
AKPHTK

SEQ ID NO: 8222 - protein, 6 aa, synthetic construct
  REGION 1..6: note = Synthetic Construct
AKPHYK

SEQ ID NO: 8223 - protein, 6 aa, synthetic construct
  REGION 1..6: note = Synthetic Construct
AKPIAK

SEQ ID NO: 8224 - protein, 6 aa, synthetic construct
  REGION 1..6: note = Synthetic Construct
AKPIDK

SEQ ID NO: 8225 - protein, 6 aa, synthetic construct
  REGION 1..6: note = Synthetic Construct
AKPIEK

SEQ ID NO: 8226 - protein, 6 aa, synthetic construct
  REGION 1..6: note = Synthetic Construct
AKPIFK

SEQ ID NO: 8227 - protein, 6 aa, synthetic construct
  REGION 1..6: note = Synthetic Construct
AKPIGK

SEQ ID NO: 8228 - protein, 6 aa, synthetic construct
  REGION 1..6: note = Synthetic Construct
AKPIHK

SEQ ID NO: 8229 - protein, 6 aa, synthetic construct
  REGION 1..6: note = Synthetic Construct
AKPIIK

SEQ ID NO: 8230 - protein, 6 aa, synthetic construct
  REGION 1..6: note = Synthetic Construct
AKPILK

SEQ ID NO: 8231 - protein, 6 aa, synthetic construct
  REGION 1..6: note = Synthetic Construct
AKPINK

SEQ ID NO: 8232 - protein, 6 aa, synthetic construct
  REGION 1..6: note = Synthetic Construct
AKPIQK

SEQ ID NO: 8233 - protein, 6 aa, synthetic construct
  REGION 1..6: note = Synthetic Construct
AKPIRK

SEQ ID NO: 8234 - protein, 6 aa, synthetic construct
  REGION 1..6: note = Synthetic Construct
AKPISK

SEQ ID NO: 8235 - protein, 6 aa, synthetic construct
  REGION 1..6: note = Synthetic Construct
AKPITK

SEQ ID NO: 8236 - protein, 6 aa, synthetic construct
  REGION 1..6: note = Synthetic Construct
AKPIYK

SEQ ID NO: 8237 - protein, 6 aa, synthetic construct
  REGION 1..6: note = Synthetic Construct
AKPLAK

SEQ ID NO: 8238 - protein, 6 aa, synthetic construct
  REGION 1..6: note = Synthetic Construct
AKPLDK

SEQ ID NO: 8239 - protein, 6 aa, synthetic construct
  REGION 1..6: note = Synthetic Construct
AKPLEK

SEQ ID NO: 8240 - protein, 6 aa, synthetic construct
  REGION 1..6: note = Synthetic Construct
AKPLFK

SEQ ID NO: 8241 - protein, 6 aa, synthetic construct
  REGION 1..6: note = Synthetic Construct
AKPLGK

SEQ ID NO: 8242 - protein, 6 aa, synthetic construct
  REGION 1..6: note = Synthetic Construct
AKPLHK

SEQ ID NO: 8243 - protein, 6 aa, synthetic construct
  REGION 1..6: note = Synthetic Construct
AKPLIK

SEQ ID NO: 8244 - protein, 6 aa, synthetic construct
  REGION 1..6: note = Synthetic Construct
AKPLLK

SEQ ID NO: 8245 - protein, 6 aa, synthetic construct
  REGION 1..6: note = Synthetic Construct
AKPLNK

SEQ ID NO: 8246 - protein, 6 aa, synthetic construct
  REGION 1..6: note = Synthetic Construct
AKPLQK

SEQ ID NO: 8247 - protein, 6 aa, synthetic construct
  REGION 1..6: note = Synthetic Construct
AKPLRK

SEQ ID NO: 8248 - protein, 6 aa, synthetic construct
  REGION 1..6: note = Synthetic Construct
AKPLSK

SEQ ID NO: 8249 - protein, 6 aa, synthetic construct
  REGION 1..6: note = Synthetic Construct
AKPLTK

SEQ ID NO: 8250 - protein, 6 aa, synthetic construct
  REGION 1..6: note = Synthetic Construct
AKPLYK

SEQ ID NO: 8251 - protein, 6 aa, synthetic construct
  REGION 1..6: note = Synthetic Construct
AKPNAK

SEQ ID NO: 8252 - protein, 6 aa, synthetic construct
  REGION 1..6: note = Synthetic Construct
AKPNDK

SEQ ID NO: 8253 - protein, 6 aa, synthetic construct
  REGION 1..6: note = Synthetic Construct
AKPNEK

SEQ ID NO: 8254 - protein, 6 aa, synthetic construct
  REGION 1..6: note = Synthetic Construct
AKPNFK

SEQ ID NO: 8255 - protein, 6 aa, synthetic construct
  REGION 1..6: note = Synthetic Construct
AKPNGK

SEQ ID NO: 8256 - protein, 6 aa, synthetic construct
  REGION 1..6: note = Synthetic Construct
AKPNHK

SEQ ID NO: 8257 - protein, 6 aa, synthetic construct
  REGION 1..6: note = Synthetic Construct
AKPNIK

SEQ ID NO: 8258 - protein, 6 aa, synthetic construct
  REGION 1..6: note = Synthetic Construct
AKPNLK

SEQ ID NO: 8259 - protein, 6 aa, synthetic construct
  REGION 1..6: note = Synthetic Construct
AKPNNK

SEQ ID NO: 8260 - protein, 6 aa, synthetic construct
  REGION 1..6: note = Synthetic Construct
AKPNQK

SEQ ID NO: 8261 - protein, 6 aa, synthetic construct
  REGION 1..6: note = Synthetic Construct
AKPNRK

SEQ ID NO: 8262 - protein, 6 aa, synthetic construct
  REGION 1..6: note = Synthetic Construct
AKPNSK

SEQ ID NO: 8263 - protein, 6 aa, synthetic construct
  REGION 1..6: note = Synthetic Construct
AKPNTK

SEQ ID NO: 8264 - protein, 6 aa, synthetic construct
  REGION 1..6: note = Synthetic Construct
AKPNYK

SEQ ID NO: 8265 - protein, 6 aa, synthetic construct
  REGION 1..6: note = Synthetic Construct
AKPQAK

SEQ ID NO: 8266 - protein, 6 aa, synthetic construct
  REGION 1..6: note = Synthetic Construct
AKPQDK

SEQ ID NO: 8267 - protein, 6 aa, synthetic construct
  REGION 1..6: note = Synthetic Construct
AKPQEK

SEQ ID NO: 8268 - protein, 6 aa, synthetic construct
  REGION 1..6: note = Synthetic Construct
AKPQFK

SEQ ID NO: 8269 - protein, 6 aa, synthetic construct
  REGION 1..6: note = Synthetic Construct
AKPQGK

SEQ ID NO: 8270 - protein, 6 aa, synthetic construct
  REGION 1..6: note = Synthetic Construct
AKPQHK

SEQ ID NO: 8271 - protein, 6 aa, synthetic construct
  REGION 1..6: note = Synthetic Construct
AKPQIK

SEQ ID NO: 8272 - protein, 6 aa, synthetic construct
  REGION 1..6: note = Synthetic Construct
AKPQLK

SEQ ID NO: 8273 - protein, 6 aa, synthetic construct
  REGION 1..6: note = Synthetic Construct
AKPQNK

SEQ ID NO: 8274 - protein, 6 aa, synthetic construct
  REGION 1..6: note = Synthetic Construct
AKPQQK

SEQ ID NO: 8275 - protein, 6 aa, synthetic construct
  REGION 1..6: note = Synthetic Construct
AKPQRK

SEQ ID NO: 8276 - protein, 6 aa, synthetic construct
  REGION 1..6: note = Synthetic Construct
AKPQSK

SEQ ID NO: 8277 - protein, 6 aa, synthetic construct
  REGION 1..6: note = Synthetic Construct
AKPQTK

SEQ ID NO: 8278 - protein, 6 aa, synthetic construct
  REGION 1..6: note = Synthetic Construct
AKPQYK

SEQ ID NO: 8279 - protein, 6 aa, synthetic construct
  REGION 1..6: note = Synthetic Construct
AKPRAK

SEQ ID NO: 8280 - protein, 6 aa, synthetic construct
  REGION 1..6: note = Synthetic Construct
AKPRDK

SEQ ID NO: 8281 - protein, 6 aa, synthetic construct
  REGION 1..6: note = Synthetic Construct
AKPREK

SEQ ID NO: 8282 - protein, 6 aa, synthetic construct
  REGION 1..6: note = Synthetic Construct
AKPRFK

SEQ ID NO: 8283 - protein, 6 aa, synthetic construct
  REGION 1..6: note = Synthetic Construct
AKPRGK

SEQ ID NO: 8284 - protein, 6 aa, synthetic construct
  REGION 1..6: note = Synthetic Construct
AKPRHK

SEQ ID NO: 8285 - protein, 6 aa, synthetic construct
  REGION 1..6: note = Synthetic Construct
AKPRIK

SEQ ID NO: 8286 - protein, 6 aa, synthetic construct
  REGION 1..6: note = Synthetic Construct
AKPRLK

SEQ ID NO: 8287 - protein, 6 aa, synthetic construct
  REGION 1..6: note = Synthetic Construct
AKPRNK

SEQ ID NO: 8288 - protein, 6 aa, synthetic construct
  REGION 1..6: note = Synthetic Construct
AKPRQK

SEQ ID NO: 8289 - protein, 6 aa, synthetic construct
  REGION 1..6: note = Synthetic Construct
AKPRRK

SEQ ID NO: 8290 - protein, 6 aa, synthetic construct
  REGION 1..6: note = Synthetic Construct
AKPRSK

SEQ ID NO: 8291 - protein, 6 aa, synthetic construct
  REGION 1..6: note = Synthetic Construct
AKPRTK

SEQ ID NO: 8292 - protein, 6 aa, synthetic construct
  REGION 1..6: note = Synthetic Construct
AKPRYK

SEQ ID NO: 8293 - protein, 6 aa, synthetic construct
  REGION 1..6: note = Synthetic Construct
AKPSAK

SEQ ID NO: 8294 - protein, 6 aa, synthetic construct
  REGION 1..6: note = Synthetic Construct
AKPSDK

SEQ ID NO: 8295 - protein, 6 aa, synthetic construct
  REGION 1..6: note = Synthetic Construct
AKPSEK

SEQ ID NO: 8296 - protein, 6 aa, synthetic construct
  REGION 1..6: note = Synthetic Construct
AKPSFK

SEQ ID NO: 8297 - protein, 6 aa, synthetic construct
  REGION 1..6: note = Synthetic Construct
AKPSGK

SEQ ID NO: 8298 - protein, 6 aa, synthetic construct
  REGION 1..6: note = Synthetic Construct
AKPSHK

SEQ ID NO: 8299 - protein, 6 aa, synthetic construct
  REGION 1..6: note = Synthetic Construct
AKPSIK

SEQ ID NO: 8300 - protein, 6 aa, synthetic construct
  REGION 1..6: note = Synthetic Construct
AKPSLK

SEQ ID NO: 8301 - protein, 6 aa, synthetic construct
  REGION 1..6: note = Synthetic Construct
AKPSNK

SEQ ID NO: 8302 - protein, 6 aa, synthetic construct
  REGION 1..6: note = Synthetic Construct
AKPSQK

SEQ ID NO: 8303 - protein, 6 aa, synthetic construct
  REGION 1..6: note = Synthetic Construct
AKPSRK

SEQ ID NO: 8304 - protein, 6 aa, synthetic construct
  REGION 1..6: note = Synthetic Construct
AKPSSK

SEQ ID NO: 8305 - protein, 6 aa, synthetic construct
  REGION 1..6: note = Synthetic Construct
AKPSTK

SEQ ID NO: 8306 - protein, 6 aa, synthetic construct
  REGION 1..6: note = Synthetic Construct
AKPSYK

SEQ ID NO: 8307 - protein, 6 aa, synthetic construct
  REGION 1..6: note = Synthetic Construct
AKPTAK

SEQ ID NO: 8308 - protein, 6 aa, synthetic construct
  REGION 1..6: note = Synthetic Construct
AKPTDK

SEQ ID NO: 8309 - protein, 6 aa, synthetic construct
  REGION 1..6: note = Synthetic Construct
AKPTEK

SEQ ID NO: 8310 - protein, 6 aa, synthetic construct
  REGION 1..6: note = Synthetic Construct
AKPTFK

SEQ ID NO: 8311 - protein, 6 aa, synthetic construct
  REGION 1..6: note = Synthetic Construct
AKPTGK

SEQ ID NO: 8312 - protein, 6 aa, synthetic construct
  REGION 1..6: note = Synthetic Construct
AKPTHK

SEQ ID NO: 8313 - protein, 6 aa, synthetic construct
  REGION 1..6: note = Synthetic Construct
AKPTIK

SEQ ID NO: 8314 - protein, 6 aa, synthetic construct
  REGION 1..6: note = Synthetic Construct
AKPTLK

SEQ ID NO: 8315 - protein, 6 aa, synthetic construct
  REGION 1..6: note = Synthetic Construct
AKPTNK

SEQ ID NO: 8316 - protein, 6 aa, synthetic construct
  REGION 1..6: note = Synthetic Construct
AKPTQK

SEQ ID NO: 8317 - protein, 6 aa, synthetic construct
  REGION 1..6: note = Synthetic Construct
AKPTRK

SEQ ID NO: 8318 - protein, 6 aa, synthetic construct
  REGION 1..6: note = Synthetic Construct
AKPTSK

SEQ ID NO: 8319 - protein, 6 aa, synthetic construct
  REGION 1..6: note = Synthetic Construct
AKPTTK

SEQ ID NO: 8320 - protein, 6 aa, synthetic construct
  REGION 1..6: note = Synthetic Construct
AKPTYK

SEQ ID NO: 8321 - protein, 6 aa, synthetic construct
  REGION 1..6: note = Synthetic Construct
AKPYAK

SEQ ID NO: 8322 - protein, 6 aa, synthetic construct
  REGION 1..6: note = Synthetic Construct
AKPYDK

SEQ ID NO: 8323 - protein, 6 aa, synthetic construct
  REGION 1..6: note = Synthetic Construct
AKPYEK

SEQ ID NO: 8324 - protein, 6 aa, synthetic construct
  REGION 1..6: note = Synthetic Construct
AKPYFK

SEQ ID NO: 8325 - protein, 6 aa, synthetic construct
  REGION 1..6: note = Synthetic Construct
AKPYGK

SEQ ID NO: 8326 - protein, 6 aa, synthetic construct
  REGION 1..6: note = Synthetic Construct
AKPYHK

SEQ ID NO: 8327 - protein, 6 aa, synthetic construct
  REGION 1..6: note = Synthetic Construct
AKPYIK

SEQ ID NO: 8328 - protein, 6 aa, synthetic construct
  REGION 1..6: note = Synthetic Construct
AKPYLK

SEQ ID NO: 8329 - protein, 6 aa, synthetic construct
  REGION 1..6: note = Synthetic Construct
AKPYNK

SEQ ID NO: 8330 - protein, 6 aa, synthetic construct
  REGION 1..6: note = Synthetic Construct
AKPYQK

SEQ ID NO: 8331 - protein, 6 aa, synthetic construct
  REGION 1..6: note = Synthetic Construct
AKPYRK

SEQ ID NO: 8332 - protein, 6 aa, synthetic construct
  REGION 1..6: note = Synthetic Construct
AKPYSK

SEQ ID NO: 8333 - protein, 6 aa, synthetic construct
  REGION 1..6: note = Synthetic Construct
AKPYTK

SEQ ID NO: 8334 - protein, 6 aa, synthetic construct
  REGION 1..6: note = Synthetic Construct
AKPYYK

SEQ ID NO: 8335 - protein, 6 aa, synthetic construct
  REGION 1..6: note = Synthetic Construct
AKQAAK

SEQ ID NO: 8336 - protein, 6 aa, synthetic construct
  REGION 1..6: note = Synthetic Construct
AKQADK

SEQ ID NO: 8337 - protein, 6 aa, synthetic construct
  REGION 1..6: note = Synthetic Construct
AKQAEK

SEQ ID NO: 8338 - protein, 6 aa, synthetic construct
  REGION 1..6: note = Synthetic Construct
AKQAFK

SEQ ID NO: 8339 - protein, 6 aa, synthetic construct
  REGION 1..6: note = Synthetic Construct
AKQAGK

SEQ ID NO: 8340 - protein, 6 aa, synthetic construct
  REGION 1..6: note = Synthetic Construct
AKQAHK

SEQ ID NO: 8341 - protein, 6 aa, synthetic construct
  REGION 1..6: note = Synthetic Construct
AKQAIK

SEQ ID NO: 8342 - protein, 6 aa, synthetic construct
  REGION 1..6: note = Synthetic Construct
AKQALK

SEQ ID NO: 8343 - protein, 6 aa, synthetic construct
  REGION 1..6: note = Synthetic Construct
AKQANK

SEQ ID NO: 8344 - protein, 6 aa, synthetic construct
  REGION 1..6: note = Synthetic Construct
AKQAQK

SEQ ID NO: 8345 - protein, 6 aa, synthetic construct
  REGION 1..6: note = Synthetic Construct
AKQARK

SEQ ID NO: 8346 - protein, 6 aa, synthetic construct
  REGION 1..6: note = Synthetic Construct
AKQASK

SEQ ID NO: 8347 - protein, 6 aa, synthetic construct
  REGION 1..6: note = Synthetic Construct
AKQATK

SEQ ID NO: 8348 - protein, 6 aa, synthetic construct
  REGION 1..6: note = Synthetic Construct
AKQAYK

SEQ ID NO: 8349 - protein, 6 aa, synthetic construct
  REGION 1..6: note = Synthetic Construct
AKQDAK

SEQ ID NO: 8350 - protein, 6 aa, synthetic construct
  REGION 1..6: note = Synthetic Construct
AKQDDK

SEQ ID NO: 8351 - protein, 6 aa, synthetic construct
  REGION 1..6: note = Synthetic Construct
AKQDEK

SEQ ID NO: 8352 - protein, 6 aa, synthetic construct
  REGION 1..6: note = Synthetic Construct
AKQDFK

SEQ ID NO: 8353 - protein, 6 aa, synthetic construct
  REGION 1..6: note = Synthetic Construct
AKQDGK

SEQ ID NO: 8354 - protein, 6 aa, synthetic construct
  REGION 1..6: note = Synthetic Construct
AKQDHK

SEQ ID NO: 8355 - protein, 6 aa, synthetic construct
  REGION 1..6: note = Synthetic Construct
AKQDIK

SEQ ID NO: 8356 - protein, 6 aa, synthetic construct
  REGION 1..6: note = Synthetic Construct
AKQDLK

SEQ ID NO: 8357 - protein, 6 aa, synthetic construct
  REGION 1..6: note = Synthetic Construct
AKQDNK

SEQ ID NO: 8358 - protein, 6 aa, synthetic construct
  REGION 1..6: note = Synthetic Construct
AKQDQK

SEQ ID NO: 8359 - protein, 6 aa, synthetic construct
  REGION 1..6: note = Synthetic Construct
AKQDRK

SEQ ID NO: 8360 - protein, 6 aa, synthetic construct
  REGION 1..6: note = Synthetic Construct
AKQDSK

SEQ ID NO: 8361 - protein, 6 aa, synthetic construct
  REGION 1..6: note = Synthetic Construct
AKQDTK

SEQ ID NO: 8362 - protein, 6 aa, synthetic construct
  REGION 1..6: note = Synthetic Construct
AKQDYK

SEQ ID NO: 8363 - protein, 6 aa, synthetic construct
  REGION 1..6: note = Synthetic Construct
AKQEAK

SEQ ID NO: 8364 - protein, 6 aa, synthetic construct
  REGION 1..6: note = Synthetic Construct
AKQEDK

SEQ ID NO: 8365 - protein, 6 aa, synthetic construct
  REGION 1..6: note = Synthetic Construct
AKQEEK

SEQ ID NO: 8366 - protein, 6 aa, synthetic construct
  REGION 1..6: note = Synthetic Construct
AKQEFK

SEQ ID NO: 8367 - protein, 6 aa, synthetic construct
  REGION 1..6: note = Synthetic Construct
AKQEGK

SEQ ID NO: 8368 - protein, 6 aa, synthetic construct
  REGION 1..6: note = Synthetic Construct
AKQEHK

SEQ ID NO: 8369 - protein, 6 aa, synthetic construct
  REGION 1..6: note = Synthetic Construct
AKQEIK

SEQ ID NO: 8370 - protein, 6 aa, synthetic construct
  REGION 1..6: note = Synthetic Construct
AKQELK

SEQ ID NO: 8371 - protein, 6 aa, synthetic construct
  REGION 1..6: note = Synthetic Construct
AKQENK

SEQ ID NO: 8372 - protein, 6 aa, synthetic construct
  REGION 1..6: note = Synthetic Construct
AKQEQK

SEQ ID NO: 8373 - protein, 6 aa, synthetic construct
  REGION 1..6: note = Synthetic Construct
AKQERK

SEQ ID NO: 8374 - protein, 6 aa, synthetic construct
  REGION 1..6: note = Synthetic Construct
AKQESK

SEQ ID NO: 8375 - protein, 6 aa, synthetic construct
  REGION 1..6: note = Synthetic Construct
AKQETK

SEQ ID NO: 8376 - protein, 6 aa, synthetic construct
  REGION 1..6: note = Synthetic Construct
AKQEYK

SEQ ID NO: 8377 - protein, 6 aa, synthetic construct
  REGION 1..6: note = Synthetic Construct
AKQFAK

SEQ ID NO: 8378 - protein, 6 aa, synthetic construct
  REGION 1..6: note = Synthetic Construct
AKQFDK

SEQ ID NO: 8379 - protein, 6 aa, synthetic construct
  REGION 1..6: note = Synthetic Construct
AKQFEK

SEQ ID NO: 8380 - protein, 6 aa, synthetic construct
  REGION 1..6: note = Synthetic Construct
AKQFFK

SEQ ID NO: 8381 - protein, 6 aa, synthetic construct
  REGION 1..6: note = Synthetic Construct
AKQFGK

SEQ ID NO: 8382 - protein, 6 aa, synthetic construct
  REGION 1..6: note = Synthetic Construct
AKQFHK

SEQ ID NO: 8383 - protein, 6 aa, synthetic construct
  REGION 1..6: note = Synthetic Construct
AKQFIK

SEQ ID NO: 8384 - protein, 6 aa, synthetic construct
  REGION 1..6: note = Synthetic Construct
AKQFLK

SEQ ID NO: 8385 - protein, 6 aa, synthetic construct
  REGION 1..6: note = Synthetic Construct
AKQFNK

SEQ ID NO: 8386 - protein, 6 aa, synthetic construct
  REGION 1..6: note = Synthetic Construct
AKQFQK

SEQ ID NO: 8387 - protein, 6 aa, synthetic construct
  REGION 1..6: note = Synthetic Construct
AKQFRK

SEQ ID NO: 8388 - protein, 6 aa, synthetic construct
  REGION 1..6: note = Synthetic Construct
AKQFSK

SEQ ID NO: 8389 - protein, 6 aa, synthetic construct
  REGION 1..6: note = Synthetic Construct
AKQFTK

SEQ ID NO: 8390 - protein, 6 aa, synthetic construct
  REGION 1..6: note = Synthetic Construct
AKQFYK

SEQ ID NO: 8391 - protein, 6 aa, synthetic construct
  REGION 1..6: note = Synthetic Construct
AKQGAK

SEQ ID NO: 8392 - protein, 6 aa, synthetic construct
  REGION 1..6: note = Synthetic Construct
AKQGDK

SEQ ID NO: 8393 - protein, 6 aa, synthetic construct
  REGION 1..6: note = Synthetic Construct
AKQGEK

SEQ ID NO: 8394 - protein, 6 aa, synthetic construct
  REGION 1..6: note = Synthetic Construct
AKQGFK

SEQ ID NO: 8395 - protein, 6 aa, synthetic construct
  REGION 1..6: note = Synthetic Construct
AKQGGK

SEQ ID NO: 8396 - protein, 6 aa, synthetic construct
  REGION 1..6: note = Synthetic Construct
AKQGHK

SEQ ID NO: 8397 - protein, 6 aa, synthetic construct
  REGION 1..6: note = Synthetic Construct
AKQGIK

SEQ ID NO: 8398 - protein, 6 aa, synthetic construct
  REGION 1..6: note = Synthetic Construct
AKQGLK

SEQ ID NO: 8399 - protein, 6 aa, synthetic construct
  REGION 1..6: note = Synthetic Construct
AKQGNK

SEQ ID NO: 8400 - protein, 6 aa, synthetic construct
  REGION 1..6: note = Synthetic Construct
AKQGQK

SEQ ID NO: 8401 - protein, 6 aa, synthetic construct
  REGION 1..6: note = Synthetic Construct
AKQGRK

SEQ ID NO: 8402 - protein, 6 aa, synthetic construct
  REGION 1..6: note = Synthetic Construct
AKQGSK

SEQ ID NO: 8403 - protein, 6 aa, synthetic construct
  REGION 1..6: note = Synthetic Construct
AKQGTK

SEQ ID NO: 8404 - protein, 6 aa, synthetic construct
  REGION 1..6: note = Synthetic Construct
AKQGYK

SEQ ID NO: 8405 - protein, 6 aa, synthetic construct
  REGION 1..6: note = Synthetic Construct
AKQHAK

SEQ ID NO: 8406 - protein, 6 aa, synthetic construct
  REGION 1..6: note = Synthetic Construct
AKQHDK

SEQ ID NO: 8407 - protein, 6 aa, synthetic construct
  REGION 1..6: note = Synthetic Construct
AKQHEK

SEQ ID NO: 8408 - protein, 6 aa, synthetic construct
  REGION 1..6: note = Synthetic Construct
AKQHFK

SEQ ID NO: 8409 - protein, 6 aa, synthetic construct
  REGION 1..6: note = Synthetic Construct
AKQHGK

SEQ ID NO: 8410 - protein, 6 aa, synthetic construct
  REGION 1..6: note = Synthetic Construct
AKQHHK

SEQ ID NO: 8411 - protein, 6 aa, synthetic construct
  REGION 1..6: note = Synthetic Construct
AKQHIK

SEQ ID NO: 8412 - protein, 6 aa, synthetic construct
  REGION 1..6: note = Synthetic Construct
AKQHLK

SEQ ID NO: 8413 - protein, 6 aa, synthetic construct
  REGION 1..6: note = Synthetic Construct
AKQHNK

SEQ ID NO: 8414 - protein, 6 aa, synthetic construct
  REGION 1..6: note = Synthetic Construct
AKQHQK

SEQ ID NO: 8415 - protein, 6 aa, synthetic construct
  REGION 1..6: note = Synthetic Construct
AKQHRK

SEQ ID NO: 8416 - protein, 6 aa, synthetic construct
  REGION 1..6: note = Synthetic Construct
AKQHSK

SEQ ID NO: 8417 - protein, 6 aa, synthetic construct
  REGION 1..6: note = Synthetic Construct
AKQHTK

SEQ ID NO: 8418 - protein, 6 aa, synthetic construct
  REGION 1..6: note = Synthetic Construct
AKQHYK

SEQ ID NO: 8419 - protein, 6 aa, synthetic construct
  REGION 1..6: note = Synthetic Construct
AKQIAK

SEQ ID NO: 8420 - protein, 6 aa, synthetic construct
  REGION 1..6: note = Synthetic Construct
AKQIDK

SEQ ID NO: 8421 - protein, 6 aa, synthetic construct
  REGION 1..6: note = Synthetic Construct
AKQIEK

SEQ ID NO: 8422 - protein, 6 aa, synthetic construct
  REGION 1..6: note = Synthetic Construct
AKQIFK

SEQ ID NO: 8423 - protein, 6 aa, synthetic construct
  REGION 1..6: note = Synthetic Construct
AKQIGK

SEQ ID NO: 8424 - protein, 6 aa, synthetic construct
  REGION 1..6: note = Synthetic Construct
AKQIHK

SEQ ID NO: 8425 - protein, 6 aa, synthetic construct
  REGION 1..6: note = Synthetic Construct
AKQIIK

SEQ ID NO: 8426 - protein, 6 aa, synthetic construct
  REGION 1..6: note = Synthetic Construct
AKQILK

SEQ ID NO: 8427 - protein, 6 aa, synthetic construct
  REGION 1..6: note = Synthetic Construct
AKQINK

SEQ ID NO: 8428 - protein, 6 aa, synthetic construct
  REGION 1..6: note = Synthetic Construct
AKQIQK

SEQ ID NO: 8429 - protein, 6 aa, synthetic construct
  REGION 1..6: note = Synthetic Construct
AKQIRK

SEQ ID NO: 8430 - protein, 6 aa, synthetic construct
  REGION 1..6: note = Synthetic Construct
AKQISK

SEQ ID NO: 8431 - protein, 6 aa, synthetic construct
  REGION 1..6: note = Synthetic Construct
AKQITK

SEQ ID NO: 8432 - protein, 6 aa, synthetic construct
  REGION 1..6: note = Synthetic Construct
AKQIYK

SEQ ID NO: 8433 - protein, 6 aa, synthetic construct
  REGION 1..6: note = Synthetic Construct
AKQLAK

SEQ ID NO: 8434 - protein, 6 aa, synthetic construct
  REGION 1..6: note = Synthetic Construct
AKQLDK

SEQ ID NO: 8435 - protein, 6 aa, synthetic construct
  REGION 1..6: note = Synthetic Construct
AKQLEK

SEQ ID NO: 8436 - protein, 6 aa, synthetic construct
  REGION 1..6: note = Synthetic Construct
AKQLFK

SEQ ID NO: 8437 - protein, 6 aa, synthetic construct
  REGION 1..6: note = Synthetic Construct
AKQLGK

SEQ ID NO: 8438 - protein, 6 aa, synthetic construct
  REGION 1..6: note = Synthetic Construct
AKQLHK

SEQ ID NO: 8439 - protein, 6 aa, synthetic construct
  REGION 1..6: note = Synthetic Construct
AKQLIK

SEQ ID NO: 8440 - protein, 6 aa, synthetic construct
  REGION 1..6: note = Synthetic Construct
AKQLLK

SEQ ID NO: 8441 - protein, 6 aa, synthetic construct
  REGION 1..6: note = Synthetic Construct
AKQLNK

SEQ ID NO: 8442 - protein, 6 aa, synthetic construct
  REGION 1..6: note = Synthetic Construct
AKQLQK

SEQ ID NO: 8443 - protein, 6 aa, synthetic construct
  REGION 1..6: note = Synthetic Construct
AKQLRK

SEQ ID NO: 8444 - protein, 6 aa, synthetic construct
  REGION 1..6: note = Synthetic Construct
AKQLSK

SEQ ID NO: 8445 - protein, 6 aa, synthetic construct
  REGION 1..6: note = Synthetic Construct
AKQLTK

SEQ ID NO: 8446 - protein, 6 aa, synthetic construct
  REGION 1..6: note = Synthetic Construct
AKQLYK

SEQ ID NO: 8447 - protein, 6 aa, synthetic construct
  REGION 1..6: note = Synthetic Construct
AKQNAK

SEQ ID NO: 8448 - protein, 6 aa, synthetic construct
  REGION 1..6: note = Synthetic Construct
AKQNDK

SEQ ID NO: 8449 - protein, 6 aa, synthetic construct
  REGION 1..6: note = Synthetic Construct
AKQNEK

SEQ ID NO: 8450 - protein, 6 aa, synthetic construct
  REGION 1..6: note = Synthetic Construct
AKQNFK

SEQ ID NO: 8451 - protein, 6 aa, synthetic construct
  REGION 1..6: note = Synthetic Construct
AKQNGK

SEQ ID NO: 8452 - protein, 6 aa, synthetic construct
  REGION 1..6: note = Synthetic Construct
AKQNHK

SEQ ID NO: 8453 - protein, 6 aa, synthetic construct
  REGION 1..6: note = Synthetic Construct
AKQNIK

SEQ ID NO: 8454 - protein, 6 aa, synthetic construct
  REGION 1..6: note = Synthetic Construct
AKQNLK

SEQ ID NO: 8455 - protein, 6 aa, synthetic construct
  REGION 1..6: note = Synthetic Construct
AKQNNK

SEQ ID NO: 8456 - protein, 6 aa, synthetic construct
  REGION 1..6: note = Synthetic Construct
AKQNQK

SEQ ID NO: 8457 - protein, 6 aa, synthetic construct
  REGION 1..6: note = Synthetic Construct
AKQNRK

SEQ ID NO: 8458 - protein, 6 aa, synthetic construct
  REGION 1..6: note = Synthetic Construct
AKQNSK

SEQ ID NO: 8459 - protein, 6 aa, synthetic construct
  REGION 1..6: note = Synthetic Construct
AKQNTK

SEQ ID NO: 8460 - protein, 6 aa, synthetic construct
  REGION 1..6: note = Synthetic Construct
AKQNYK

SEQ ID NO: 8461 - protein, 6 aa, synthetic construct
  REGION 1..6: note = Synthetic Construct
AKQQAK

SEQ ID NO: 8462 - protein, 6 aa, synthetic construct
  REGION 1..6: note = Synthetic Construct
AKQQDK

SEQ ID NO: 8463 - protein, 6 aa, synthetic construct
  REGION 1..6: note = Synthetic Construct
AKQQEK

SEQ ID NO: 8464 - protein, 6 aa, synthetic construct
  REGION 1..6: note = Synthetic Construct
AKQQFK

SEQ ID NO: 8465 - protein, 6 aa, synthetic construct
  REGION 1..6: note = Synthetic Construct
AKQQGK

SEQ ID NO: 8466 - protein, 6 aa, synthetic construct
  REGION 1..6: note = Synthetic Construct
AKQQHK

SEQ ID NO: 8467 - protein, 6 aa, synthetic construct
  REGION 1..6: note = Synthetic Construct
AKQQIK

SEQ ID NO: 8468 - protein, 6 aa, synthetic construct
  REGION 1..6: note = Synthetic Construct
AKQQLK

SEQ ID NO: 8469 - protein, 6 aa, synthetic construct
  REGION 1..6: note = Synthetic Construct
AKQQNK

SEQ ID NO: 8470 - protein, 6 aa, synthetic construct
  REGION 1..6: note = Synthetic Construct
AKQQQK

SEQ ID NO: 8471 - protein, 6 aa, synthetic construct
  REGION 1..6: note = Synthetic Construct
AKQQRK

SEQ ID NO: 8472 - protein, 6 aa, synthetic construct
  REGION 1..6: note = Synthetic Construct
AKQQSK

SEQ ID NO: 8473 - protein, 6 aa, synthetic construct
  REGION 1..6: note = Synthetic Construct
AKQQTK

SEQ ID NO: 8474 - protein, 6 aa, synthetic construct
  REGION 1..6: note = Synthetic Construct
AKQQYK

SEQ ID NO: 8475 - protein, 6 aa, synthetic construct
  REGION 1..6: note = Synthetic Construct
AKQRAK

SEQ ID NO: 8476 - protein, 6 aa, synthetic construct
  REGION 1..6: note = Synthetic Construct
AKQRDK

SEQ ID NO: 8477 - protein, 6 aa, synthetic construct
  REGION 1..6: note = Synthetic Construct
AKQREK

SEQ ID NO: 8478 - protein, 6 aa, synthetic construct
  REGION 1..6: note = Synthetic Construct
AKQRFK

SEQ ID NO: 8479 - protein, 6 aa, synthetic construct
  REGION 1..6: note = Synthetic Construct
AKQRGK

SEQ ID NO: 8480 - protein, 6 aa, synthetic construct
  REGION 1..6: note = Synthetic Construct
AKQRHK

SEQ ID NO: 8481 - protein, 6 aa, synthetic construct
  REGION 1..6: note = Synthetic Construct
AKQRIK

SEQ ID NO: 8482 - protein, 6 aa, synthetic construct
  REGION 1..6: note = Synthetic Construct
AKQRLK

SEQ ID NO: 8483 - protein, 6 aa, synthetic construct
  REGION 1..6: note = Synthetic Construct
AKQRNK

SEQ ID NO: 8484 - protein, 6 aa, synthetic construct
  REGION 1..6: note = Synthetic Construct
AKQRQK

SEQ ID NO: 8485 - protein, 6 aa, synthetic construct
  REGION 1..6: note = Synthetic Construct
AKQRRK

SEQ ID NO: 8486 - protein, 6 aa, synthetic construct
  REGION 1..6: note = Synthetic Construct
AKQRSK

SEQ ID NO: 8487 - protein, 6 aa, synthetic construct
  REGION 1..6: note = Synthetic Construct
AKQRTK

SEQ ID NO: 8488 - protein, 6 aa, synthetic construct
  REGION 1..6: note = Synthetic Construct
AKQRYK

SEQ ID NO: 8489 - protein, 6 aa, synthetic construct
  REGION 1..6: note = Synthetic Construct
AKQSAK

SEQ ID NO: 8490 - protein, 6 aa, synthetic construct
  REGION 1..6: note = Synthetic Construct
AKQSDK

SEQ ID NO: 8491 - protein, 6 aa, synthetic construct
  REGION 1..6: note = Synthetic Construct
AKQSEK

SEQ ID NO: 8492 - protein, 6 aa, synthetic construct
  REGION 1..6: note = Synthetic Construct
AKQSFK

SEQ ID NO: 8493 - protein, 6 aa, synthetic construct
  REGION 1..6: note = Synthetic Construct
AKQSGK

SEQ ID NO: 8494 - protein, 6 aa, synthetic construct
  REGION 1..6: note = Synthetic Construct
AKQSHK

SEQ ID NO: 8495 - protein, 6 aa, synthetic construct
  REGION 1..6: note = Synthetic Construct
AKQSIK

SEQ ID NO: 8496 - protein, 6 aa, synthetic construct
  REGION 1..6: note = Synthetic Construct
AKQSLK

SEQ ID NO: 8497 - protein, 6 aa, synthetic construct
  REGION 1..6: note = Synthetic Construct
AKQSNK

SEQ ID NO: 8498 - protein, 6 aa, synthetic construct
  REGION 1..6: note = Synthetic Construct
AKQSQK

SEQ ID NO: 8499 - protein, 6 aa, synthetic construct
  REGION 1..6: note = Synthetic Construct
AKQSRK

SEQ ID NO: 8500 - protein, 6 aa, synthetic construct
  REGION 1..6: note = Synthetic Construct
AKQSSK

SEQ ID NO: 8501 - protein, 6 aa, synthetic construct
  REGION 1..6: note = Synthetic Construct
AKQSTK

SEQ ID NO: 8502 - protein, 6 aa, synthetic construct
  REGION 1..6: note = Synthetic Construct
AKQSYK

SEQ ID NO: 8503 - protein, 6 aa, synthetic construct
  REGION 1..6: note = Synthetic Construct
AKQTAK

SEQ ID NO: 8504 - protein, 6 aa, synthetic construct
  REGION 1..6: note = Synthetic Construct
AKQTDK

SEQ ID NO: 8505 - protein, 6 aa, synthetic construct
  REGION 1..6: note = Synthetic Construct
AKQTEK

SEQ ID NO: 8506 - protein, 6 aa, synthetic construct
  REGION 1..6: note = Synthetic Construct
AKQTFK

SEQ ID NO: 8507 - protein, 6 aa, synthetic construct
  REGION 1..6: note = Synthetic Construct
AKQTGK

SEQ ID NO: 8508 - protein, 6 aa, synthetic construct
  REGION 1..6: note = Synthetic Construct
AKQTHK

SEQ ID NO: 8509 - protein, 6 aa, synthetic construct
  REGION 1..6: note = Synthetic Construct
AKQTIK

SEQ ID NO: 8510 - protein, 6 aa, synthetic construct
  REGION 1..6: note = Synthetic Construct
AKQTLK

SEQ ID NO: 8511 - protein, 6 aa, synthetic construct
  REGION 1..6: note = Synthetic Construct
AKQTNK

SEQ ID NO: 8512 - protein, 6 aa, synthetic construct
  REGION 1..6: note = Synthetic Construct
AKQTQK

SEQ ID NO: 8513 - protein, 6 aa, synthetic construct
  REGION 1..6: note = Synthetic Construct
AKQTRK

SEQ ID NO: 8514 - protein, 6 aa, synthetic construct
  REGION 1..6: note = Synthetic Construct
AKQTSK

SEQ ID NO: 8515 - protein, 6 aa, synthetic construct
  REGION 1..6: note = Synthetic Construct
AKQTTK

SEQ ID NO: 8516 - protein, 6 aa, synthetic construct
  REGION 1..6: note = Synthetic Construct
AKQTYK

SEQ ID NO: 8517 - protein, 6 aa, synthetic construct
  REGION 1..6: note = Synthetic Construct
AKQYAK

SEQ ID NO: 8518 - protein, 6 aa, synthetic construct
  REGION 1..6: note = Synthetic Construct
AKQYDK

SEQ ID NO: 8519 - protein, 6 aa, synthetic construct
  REGION 1..6: note = Synthetic Construct
AKQYEK

SEQ ID NO: 8520 - protein, 6 aa, synthetic construct
  REGION 1..6: note = Synthetic Construct
AKQYFK

SEQ ID NO: 8521 - protein, 6 aa, synthetic construct
  REGION 1..6: note = Synthetic Construct
AKQYGK

SEQ ID NO: 8522 - protein, 6 aa, synthetic construct
  REGION 1..6: note = Synthetic Construct
AKQYHK

SEQ ID NO: 8523 - protein, 6 aa, synthetic construct
  REGION 1..6: note = Synthetic Construct
AKQYIK

SEQ ID NO: 8524 - protein, 6 aa, synthetic construct
  REGION 1..6: note = Synthetic Construct
AKQYLK

SEQ ID NO: 8525 - protein, 6 aa, synthetic construct
  REGION 1..6: note = Synthetic Construct
AKQYNK

SEQ ID NO: 8526 - protein, 6 aa, synthetic construct
  REGION 1..6: note = Synthetic Construct
AKQYQK

SEQ ID NO: 8527 - protein, 6 aa, synthetic construct
  REGION 1..6: note = Synthetic Construct
AKQYRK

SEQ ID NO: 8528 - protein, 6 aa, synthetic construct
  REGION 1..6: note = Synthetic Construct
AKQYSK

SEQ ID NO: 8529 - protein, 6 aa, synthetic construct
  REGION 1..6: note = Synthetic Construct
AKQYTK

SEQ ID NO: 8530 - protein, 6 aa, synthetic construct
  REGION 1..6: note = Synthetic Construct
AKQYYK

SEQ ID NO: 8531 - protein, 6 aa, synthetic construct
  REGION 1..6: note = Synthetic Construct
AKRAAK

SEQ ID NO: 8532 - protein, 6 aa, synthetic construct
  REGION 1..6: note = Synthetic Construct
AKRADK

SEQ ID NO: 8533 - protein, 6 aa, synthetic construct
  REGION 1..6: note = Synthetic Construct
AKRAEK

SEQ ID NO: 8534 - protein, 6 aa, synthetic construct
  REGION 1..6: note = Synthetic Construct
AKRAFK

SEQ ID NO: 8535 - protein, 6 aa, synthetic construct
  REGION 1..6: note = Synthetic Construct
AKRAGK

SEQ ID NO: 8536 - protein, 6 aa, synthetic construct
  REGION 1..6: note = Synthetic Construct
AKRAHK

SEQ ID NO: 8537 - protein, 6 aa, synthetic construct
  REGION 1..6: note = Synthetic Construct
AKRAIK

SEQ ID NO: 8538 - protein, 6 aa, synthetic construct
  REGION 1..6: note = Synthetic Construct
AKRALK

SEQ ID NO: 8539 - protein, 6 aa, synthetic construct
  REGION 1..6: note = Synthetic Construct
AKRANK

SEQ ID NO: 8540 - protein, 6 aa, synthetic construct
  REGION 1..6: note = Synthetic Construct
AKRAQK

SEQ ID NO: 8541 - protein, 6 aa, synthetic construct
  REGION 1..6: note = Synthetic Construct
AKRARK

SEQ ID NO: 8542 - protein, 6 aa, synthetic construct
  REGION 1..6: note = Synthetic Construct
AKRASK

SEQ ID NO: 8543 - protein, 6 aa, synthetic construct
  REGION 1..6: note = Synthetic Construct
AKRATK

SEQ ID NO: 8544 - protein, 6 aa, synthetic construct
  REGION 1..6: note = Synthetic Construct
AKRAYK

SEQ ID NO: 8545 - protein, 6 aa, synthetic construct
  REGION 1..6: note = Synthetic Construct
AKRDAK

SEQ ID NO: 8546 - protein, 6 aa, synthetic construct
  REGION 1..6: note = Synthetic Construct
AKRDDK

SEQ ID NO: 8547 - protein, 6 aa, synthetic construct
  REGION 1..6: note = Synthetic Construct
AKRDEK

SEQ ID NO: 8548 - protein, 6 aa, synthetic construct
  REGION 1..6: note = Synthetic Construct
AKRDFK

SEQ ID NO: 8549 - protein, 6 aa, synthetic construct
  REGION 1..6: note = Synthetic Construct
AKRDGK

SEQ ID NO: 8550 - protein, 6 aa, synthetic construct
  REGION 1..6: note = Synthetic Construct
AKRDHK

SEQ ID NO: 8551 - protein, 6 aa, synthetic construct
  REGION 1..6: note = Synthetic Construct
AKRDIK

SEQ ID NO: 8552 - protein, 6 aa, synthetic construct
  REGION 1..6: note = Synthetic Construct
AKRDLK

SEQ ID NO: 8553 - protein, 6 aa, synthetic construct
  REGION 1..6: note = Synthetic Construct
AKRDNK

SEQ ID NO: 8554 - protein, 6 aa, synthetic construct
  REGION 1..6: note = Synthetic Construct
AKRDQK

SEQ ID NO: 8555 - protein, 6 aa, synthetic construct
  REGION 1..6: note = Synthetic Construct
AKRDRK

SEQ ID NO: 8556 - protein, 6 aa, synthetic construct
  REGION 1..6: note = Synthetic Construct
AKRDSK

SEQ ID NO: 8557 - protein, 6 aa, synthetic construct
  REGION 1..6: note = Synthetic Construct
AKRDTK

SEQ ID NO: 8558 - protein, 6 aa, synthetic construct
  REGION 1..6: note = Synthetic Construct
AKRDYK

SEQ ID NO: 8559 - protein, 6 aa, synthetic construct
  REGION 1..6: note = Synthetic Construct
AKREAK

SEQ ID NO: 8560 - protein, 6 aa, synthetic construct
  REGION 1..6: note = Synthetic Construct
AKREDK

SEQ ID NO: 8561 - protein, 6 aa, synthetic construct
  REGION 1..6: note = Synthetic Construct
AKREEK

SEQ ID NO: 8562 - protein, 6 aa, synthetic construct
  REGION 1..6: note = Synthetic Construct
AKREFK

SEQ ID NO: 8563 - protein, 6 aa, synthetic construct
  REGION 1..6: note = Synthetic Construct
AKREGK

SEQ ID NO: 8564 - protein, 6 aa, synthetic construct
  REGION 1..6: note = Synthetic Construct
AKREHK

SEQ ID NO: 8565 - protein, 6 aa, synthetic construct
  REGION 1..6: note = Synthetic Construct
AKREIK

SEQ ID NO: 8566 - protein, 6 aa, synthetic construct
  REGION 1..6: note = Synthetic Construct
AKRELK

SEQ ID NO: 8567 - protein, 6 aa, synthetic construct
  REGION 1..6: note = Synthetic Construct
AKRENK

SEQ ID NO: 8568 - protein, 6 aa, synthetic construct
  REGION 1..6: note = Synthetic Construct
AKREQK

SEQ ID NO: 8569 - protein, 6 aa, synthetic construct
  REGION 1..6: note = Synthetic Construct
AKRERK

SEQ ID NO: 8570 - protein, 6 aa, synthetic construct
  REGION 1..6: note = Synthetic Construct
AKRESK

SEQ ID NO: 8571 - protein, 6 aa, synthetic construct
  REGION 1..6: note = Synthetic Construct
AKRETK

SEQ ID NO: 8572 - protein, 6 aa, synthetic construct
  REGION 1..6: note = Synthetic Construct
AKREYK

SEQ ID NO: 8573 - protein, 6 aa, synthetic construct
  REGION 1..6: note = Synthetic Construct
AKRFAK

SEQ ID NO: 8574 - protein, 6 aa, synthetic construct
  REGION 1..6: note = Synthetic Construct
AKRFDK

SEQ ID NO: 8575 - protein, 6 aa, synthetic construct
  REGION 1..6: note = Synthetic Construct
AKRFEK

SEQ ID NO: 8576 - protein, 6 aa, synthetic construct
  REGION 1..6: note = Synthetic Construct
AKRFFK

SEQ ID NO: 8577 - protein, 6 aa, synthetic construct
  REGION 1..6: note = Synthetic Construct
AKRFGK

SEQ ID NO: 8578 - protein, 6 aa, synthetic construct
  REGION 1..6: note = Synthetic Construct
AKRFHK

SEQ ID NO: 8579 - protein, 6 aa, synthetic construct
  REGION 1..6: note = Synthetic Construct
AKRFIK

SEQ ID NO: 8580 - protein, 6 aa, synthetic construct
  REGION 1..6: note = Synthetic Construct
AKRFLK

SEQ ID NO: 8581 - protein, 6 aa, synthetic construct
  REGION 1..6: note = Synthetic Construct
AKRFNK

SEQ ID NO: 8582 - protein, 6 aa, synthetic construct
  REGION 1..6: note = Synthetic Construct
AKRFQK

SEQ ID NO: 8583 - protein, 6 aa, synthetic construct
  REGION 1..6: note = Synthetic Construct
AKRFRK

SEQ ID NO: 8584 - protein, 6 aa, synthetic construct
  REGION 1..6: note = Synthetic Construct
AKRFSK

SEQ ID NO: 8585 - protein, 6 aa, synthetic construct
  REGION 1..6: note = Synthetic Construct
AKRFTK

SEQ ID NO: 8586 - protein, 6 aa, synthetic construct
  REGION 1..6: note = Synthetic Construct
AKRFYK

SEQ ID NO: 8587 - protein, 6 aa, synthetic construct
  REGION 1..6: note = Synthetic Construct
AKRGAK

SEQ ID NO: 8588 - protein, 6 aa, synthetic construct
  REGION 1..6: note = Synthetic Construct
AKRGDK

SEQ ID NO: 8589 - protein, 6 aa, synthetic construct
  REGION 1..6: note = Synthetic Construct
AKRGEK

SEQ ID NO: 8590 - protein, 6 aa, synthetic construct
  REGION 1..6: note = Synthetic Construct
AKRGFK

SEQ ID NO: 8591 - protein, 6 aa, synthetic construct
  REGION 1..6: note = Synthetic Construct
AKRGGK

SEQ ID NO: 8592 - protein, 6 aa, synthetic construct
  REGION 1..6: note = Synthetic Construct
AKRGHK

SEQ ID NO: 8593 - protein, 6 aa, synthetic construct
  REGION 1..6: note = Synthetic Construct
AKRGIK

SEQ ID NO: 8594 - protein, 6 aa, synthetic construct
  REGION 1..6: note = Synthetic Construct
AKRGLK

SEQ ID NO: 8595 - protein, 6 aa, synthetic construct
  REGION 1..6: note = Synthetic Construct
AKRGNK

SEQ ID NO: 8596 - protein, 6 aa, synthetic construct
  REGION 1..6: note = Synthetic Construct
AKRGQK

SEQ ID NO: 8597 - protein, 6 aa, synthetic construct
  REGION 1..6: note = Synthetic Construct
AKRGRK

SEQ ID NO: 8598 - protein, 6 aa, synthetic construct
  REGION 1..6: note = Synthetic Construct
AKRGSK

SEQ ID NO: 8599 - protein, 6 aa, synthetic construct
  REGION 1..6: note = Synthetic Construct
AKRGTK

SEQ ID NO: 8600 - protein, 6 aa, synthetic construct
  REGION 1..6: note = Synthetic Construct
AKRGYK

SEQ ID NO: 8601 - protein, 6 aa, synthetic construct
  REGION 1..6: note = Synthetic Construct
AKRHAK

SEQ ID NO: 8602 - protein, 6 aa, synthetic construct
  REGION 1..6: note = Synthetic Construct
AKRHDK

SEQ ID NO: 8603 - protein, 6 aa, synthetic construct
  REGION 1..6: note = Synthetic Construct
AKRHEK

SEQ ID NO: 8604 - protein, 6 aa, synthetic construct
  REGION 1..6: note = Synthetic Construct
AKRHFK

SEQ ID NO: 8605 - protein, 6 aa, synthetic construct
  REGION 1..6: note = Synthetic Construct
AKRHGK

SEQ ID NO: 8606 - protein, 6 aa, synthetic construct
  REGION 1..6: note = Synthetic Construct
AKRHHK

SEQ ID NO: 8607 - protein, 6 aa, synthetic construct
  REGION 1..6: note = Synthetic Construct
AKRHIK

SEQ ID NO: 8608 - protein, 6 aa, synthetic construct
  REGION 1..6: note = Synthetic Construct
AKRHLK

SEQ ID NO: 8609 - protein, 6 aa, synthetic construct
  REGION 1..6: note = Synthetic Construct
AKRHNK

SEQ ID NO: 8610 - protein, 6 aa, synthetic construct
  REGION 1..6: note = Synthetic Construct
AKRHQK

SEQ ID NO: 8611 - protein, 6 aa, synthetic construct
  REGION 1..6: note = Synthetic Construct
AKRHRK

SEQ ID NO: 8612 - protein, 6 aa, synthetic construct
  REGION 1..6: note = Synthetic Construct
AKRHSK

SEQ ID NO: 8613 - protein, 6 aa, synthetic construct
  REGION 1..6: note = Synthetic Construct
AKRHTK

SEQ ID NO: 8614 - protein, 6 aa, synthetic construct
  REGION 1..6: note = Synthetic Construct
AKRHYK

SEQ ID NO: 8615 - protein, 6 aa, synthetic construct
  REGION 1..6: note = Synthetic Construct
AKRIAK

SEQ ID NO: 8616 - protein, 6 aa, synthetic construct
  REGION 1..6: note = Synthetic Construct
AKRIDK

SEQ ID NO: 8617 - protein, 6 aa, synthetic construct
  REGION 1..6: note = Synthetic Construct
AKRIEK

SEQ ID NO: 8618 - protein, 6 aa, synthetic construct
  REGION 1..6: note = Synthetic Construct
AKRIFK

SEQ ID NO: 8619 - protein, 6 aa, synthetic construct
  REGION 1..6: note = Synthetic Construct
AKRIGK

SEQ ID NO: 8620 - protein, 6 aa, synthetic construct
  REGION 1..6: note = Synthetic Construct
AKRIHK

SEQ ID NO: 8621 - protein, 6 aa, synthetic construct
  REGION 1..6: note = Synthetic Construct
AKRIIK

SEQ ID NO: 8622 - protein, 6 aa, synthetic construct
  REGION 1..6: note = Synthetic Construct
AKRILK

SEQ ID NO: 8623 - protein, 6 aa, synthetic construct
  REGION 1..6: note = Synthetic Construct
AKRINK

SEQ ID NO: 8624 - protein, 6 aa, synthetic construct
  REGION 1..6: note = Synthetic Construct
AKRIQK

SEQ ID NO: 8625 - protein, 6 aa, synthetic construct
  REGION 1..6: note = Synthetic Construct
AKRIRK

SEQ ID NO: 8626 - protein, 6 aa, synthetic construct
  REGION 1..6: note = Synthetic Construct
AKRISK

SEQ ID NO: 8627 - protein, 6 aa, synthetic construct
  REGION 1..6: note = Synthetic Construct
AKRITK

SEQ ID NO: 8628 - protein, 6 aa, synthetic construct
  REGION 1..6: note = Synthetic Construct
AKRIYK

SEQ ID NO: 8629 - protein, 6 aa, synthetic construct
  REGION 1..6: note = Synthetic Construct
AKRLAK

SEQ ID NO: 8630 - protein, 6 aa, synthetic construct
  REGION 1..6: note = Synthetic Construct
AKRLDK

SEQ ID NO: 8631 - protein, 6 aa, synthetic construct
  REGION 1..6: note = Synthetic Construct
AKRLEK

SEQ ID NO: 8632 - protein, 6 aa, synthetic construct
  REGION 1..6: note = Synthetic Construct
AKRLFK

SEQ ID NO: 8633 - protein, 6 aa, synthetic construct
  REGION 1..6: note = Synthetic Construct
AKRLGK

SEQ ID NO: 8634 - protein, 6 aa, synthetic construct
  REGION 1..6: note = Synthetic Construct
AKRLHK

SEQ ID NO: 8635 - protein, 6 aa, synthetic construct
  REGION 1..6: note = Synthetic Construct
AKRLIK

SEQ ID NO: 8636 - protein, 6 aa, synthetic construct
  REGION 1..6: note = Synthetic Construct
AKRLLK

SEQ ID NO: 8637 - protein, 6 aa, synthetic construct
  REGION 1..6: note = Synthetic Construct
AKRLNK

SEQ ID NO: 8638 - protein, 6 aa, synthetic construct
  REGION 1..6: note = Synthetic Construct
AKRLQK

SEQ ID NO: 8639 - protein, 6 aa, synthetic construct
  REGION 1..6: note = Synthetic Construct
AKRLRK

SEQ ID NO: 8640 - protein, 6 aa, synthetic construct
  REGION 1..6: note = Synthetic Construct
AKRLSK

SEQ ID NO: 8641 - protein, 6 aa, synthetic construct
  REGION 1..6: note = Synthetic Construct
AKRLTK

SEQ ID NO: 8642 - protein, 6 aa, synthetic construct
  REGION 1..6: note = Synthetic Construct
AKRLYK

SEQ ID NO: 8643 - protein, 6 aa, synthetic construct
  REGION 1..6: note = Synthetic Construct
AKRNAK

SEQ ID NO: 8644 - protein, 6 aa, synthetic construct
  REGION 1..6: note = Synthetic Construct
AKRNDK

SEQ ID NO: 8645 - protein, 6 aa, synthetic construct
  REGION 1..6: note = Synthetic Construct
AKRNEK

SEQ ID NO: 8646 - protein, 6 aa, synthetic construct
  REGION 1..6: note = Synthetic Construct
AKRNFK

SEQ ID NO: 8647 - protein, 6 aa, synthetic construct
  REGION 1..6: note = Synthetic Construct
AKRNGK

SEQ ID NO: 8648 - protein, 6 aa, synthetic construct
  REGION 1..6: note = Synthetic Construct
AKRNHK

SEQ ID NO: 8649 - protein, 6 aa, synthetic construct
  REGION 1..6: note = Synthetic Construct
AKRNIK

SEQ ID NO: 8650 - protein, 6 aa, synthetic construct
  REGION 1..6: note = Synthetic Construct
AKRNLK

SEQ ID NO: 8651 - protein, 6 aa, synthetic construct
  REGION 1..6: note = Synthetic Construct
AKRNNK

SEQ ID NO: 8652 - protein, 6 aa, synthetic construct
  REGION 1..6: note = Synthetic Construct
AKRNQK

SEQ ID NO: 8653 - protein, 6 aa, synthetic construct
  REGION 1..6: note = Synthetic Construct
AKRNRK

SEQ ID NO: 8654 - protein, 6 aa, synthetic construct
  REGION 1..6: note = Synthetic Construct
AKRNSK

SEQ ID NO: 8655 - protein, 6 aa, synthetic construct
  REGION 1..6: note = Synthetic Construct
AKRNTK

SEQ ID NO: 8656 - protein, 6 aa, synthetic construct
  REGION 1..6: note = Synthetic Construct
AKRNYK

SEQ ID NO: 8657 - protein, 6 aa, synthetic construct
  REGION 1..6: note = Synthetic Construct
AKRQAK

SEQ ID NO: 8658 - protein, 6 aa, synthetic construct
  REGION 1..6: note = Synthetic Construct
AKRQDK

SEQ ID NO: 8659 - protein, 6 aa, synthetic construct
  REGION 1..6: note = Synthetic Construct
AKRQEK

SEQ ID NO: 8660 - protein, 6 aa, synthetic construct
  REGION 1..6: note = Synthetic Construct
AKRQFK

SEQ ID NO: 8661 - protein, 6 aa, synthetic construct
  REGION 1..6: note = Synthetic Construct
AKRQGK

SEQ ID NO: 8662 - protein, 6 aa, synthetic construct
  REGION 1..6: note = Synthetic Construct
AKRQHK

SEQ ID NO: 8663 - protein, 6 aa, synthetic construct
  REGION 1..6: note = Synthetic Construct
AKRQIK

SEQ ID NO: 8664 - protein, 6 aa, synthetic construct
  REGION 1..6: note = Synthetic Construct
AKRQLK

SEQ ID NO: 8665 - protein, 6 aa, synthetic construct
  REGION 1..6: note = Synthetic Construct
AKRQNK

SEQ ID NO: 8666 - protein, 6 aa, synthetic construct
  REGION 1..6: note = Synthetic Construct
AKRQQK

SEQ ID NO: 8667 - protein, 6 aa, synthetic construct
  REGION 1..6: note = Synthetic Construct
AKRQRK

SEQ ID NO: 8668 - protein, 6 aa, synthetic construct
  REGION 1..6: note = Synthetic Construct
AKRQSK

SEQ ID NO: 8669 - protein, 6 aa, synthetic construct
  REGION 1..6: note = Synthetic Construct
AKRQTK

SEQ ID NO: 8670 - protein, 6 aa, synthetic construct
  REGION 1..6: note = Synthetic Construct
AKRQYK

SEQ ID NO: 8671 - protein, 6 aa, synthetic construct
  REGION 1..6: note = Synthetic Construct
AKRRAK

SEQ ID NO: 8672 - protein, 6 aa, synthetic construct
  REGION 1..6: note = Synthetic Construct
AKRRDK

SEQ ID NO: 8673 - protein, 6 aa, synthetic construct
  REGION 1..6: note = Synthetic Construct
AKRREK

SEQ ID NO: 8674 - protein, 6 aa, synthetic construct
  REGION 1..6: note = Synthetic Construct
AKRRFK

SEQ ID NO: 8675 - protein, 6 aa, synthetic construct
  REGION 1..6: note = Synthetic Construct
AKRRGK

SEQ ID NO: 8676 - protein, 6 aa, synthetic construct
  REGION 1..6: note = Synthetic Construct
AKRRHK

SEQ ID NO: 8677 - protein, 6 aa, synthetic construct
  REGION 1..6: note = Synthetic Construct
AKRRIK

SEQ ID NO: 8678 - protein, 6 aa, synthetic construct
  REGION 1..6: note = Synthetic Construct
AKRRLK

SEQ ID NO: 8679 - protein, 6 aa, synthetic construct
  REGION 1..6: note = Synthetic Construct
AKRRNK

SEQ ID NO: 8680 - protein, 6 aa, synthetic construct
  REGION 1..6: note = Synthetic Construct
AKRRQK

SEQ ID NO: 8681 - protein, 6 aa, synthetic construct
  REGION 1..6: note = Synthetic Construct
AKRRRK

SEQ ID NO: 8682 - protein, 6 aa, synthetic construct
  REGION 1..6: note = Synthetic Construct
AKRRSK

SEQ ID NO: 8683 - protein, 6 aa, synthetic construct
  REGION 1..6: note = Synthetic Construct
AKRRTK

SEQ ID NO: 8684 - protein, 6 aa, synthetic construct
  REGION 1..6: note = Synthetic Construct
AKRRYK

SEQ ID NO: 8685 - protein, 6 aa, synthetic construct
  REGION 1..6: note = Synthetic Construct
AKRSAK

SEQ ID NO: 8686 - protein, 6 aa, synthetic construct
  REGION 1..6: note = Synthetic Construct
AKRSDK

SEQ ID NO: 8687 - protein, 6 aa, synthetic construct
  REGION 1..6: note = Synthetic Construct
AKRSEK

SEQ ID NO: 8688 - protein, 6 aa, synthetic construct
  REGION 1..6: note = Synthetic Construct
AKRSFK

SEQ ID NO: 8689 - protein, 6 aa, synthetic construct
  REGION 1..6: note = Synthetic Construct
AKRSGK

SEQ ID NO: 8690 - protein, 6 aa, synthetic construct
  REGION 1..6: note = Synthetic Construct
AKRSHK

SEQ ID NO: 8691 - protein, 6 aa, synthetic construct
  REGION 1..6: note = Synthetic Construct
AKRSIK

SEQ ID NO: 8692 - protein, 6 aa, synthetic construct
  REGION 1..6: note = Synthetic Construct
AKRSLK

SEQ ID NO: 8693 - protein, 6 aa, synthetic construct
  REGION 1..6: note = Synthetic Construct
AKRSNK

SEQ ID NO: 8694 - protein, 6 aa, synthetic construct
  REGION 1..6: note = Synthetic Construct
AKRSQK

SEQ ID NO: 8695 - protein, 6 aa, synthetic construct
  REGION 1..6: note = Synthetic Construct
AKRSRK

SEQ ID NO: 8696 - protein, 6 aa, synthetic construct
  REGION 1..6: note = Synthetic Construct
AKRSSK

SEQ ID NO: 8697 - protein, 6 aa, synthetic construct
  REGION 1..6: note = Synthetic Construct
AKRSTK

SEQ ID NO: 8698 - protein, 6 aa, synthetic construct
  REGION 1..6: note = Synthetic Construct
AKRSYK

SEQ ID NO: 8699 - protein, 6 aa, synthetic construct
  REGION 1..6: note = Synthetic Construct
AKRTAK

SEQ ID NO: 8700 - protein, 6 aa, synthetic construct
  REGION 1..6: note = Synthetic Construct
AKRTDK

SEQ ID NO: 8701 - protein, 6 aa, synthetic construct
  REGION 1..6: note = Synthetic Construct
AKRTEK

SEQ ID NO: 8702 - protein, 6 aa, synthetic construct
  REGION 1..6: note = Synthetic Construct
AKRTFK

SEQ ID NO: 8703 - protein, 6 aa, synthetic construct
  REGION 1..6: note = Synthetic Construct
AKRTGK

SEQ ID NO: 8704 - protein, 6 aa, synthetic construct
  REGION 1..6: note = Synthetic Construct
AKRTHK

SEQ ID NO: 8705 - protein, 6 aa, synthetic construct
  REGION 1..6: note = Synthetic Construct
AKRTIK

SEQ ID NO: 8706 - protein, 6 aa, synthetic construct
  REGION 1..6: note = Synthetic Construct
AKRTLK

SEQ ID NO: 8707 - protein, 6 aa, synthetic construct
  REGION 1..6: note = Synthetic Construct
AKRTNK

SEQ ID NO: 8708 - protein, 6 aa, synthetic construct
  REGION 1..6: note = Synthetic Construct
AKRTQK

SEQ ID NO: 8709 - protein, 6 aa, synthetic construct
  REGION 1..6: note = Synthetic Construct
AKRTRK

SEQ ID NO: 8710 - protein, 6 aa, synthetic construct
  REGION 1..6: note = Synthetic Construct
AKRTSK

SEQ ID NO: 8711 - protein, 6 aa, synthetic construct
  REGION 1..6: note = Synthetic Construct
AKRTTK

SEQ ID NO: 8712 - protein, 6 aa, synthetic construct
  REGION 1..6: note = Synthetic Construct
AKRTYK

SEQ ID NO: 8713 - protein, 6 aa, synthetic construct
  REGION 1..6: note = Synthetic Construct
AKRYAK

SEQ ID NO: 8714 - protein, 6 aa, synthetic construct
  REGION 1..6: note = Synthetic Construct
AKRYDK

SEQ ID NO: 8715 - protein, 6 aa, synthetic construct
  REGION 1..6: note = Synthetic Construct
AKRYEK

SEQ ID NO: 8716 - protein, 6 aa, synthetic construct
  REGION 1..6: note = Synthetic Construct
AKRYFK

SEQ ID NO: 8717 - protein, 6 aa, synthetic construct
  REGION 1..6: note = Synthetic Construct
AKRYGK

SEQ ID NO: 8718 - protein, 6 aa, synthetic construct
  REGION 1..6: note = Synthetic Construct
AKRYHK

SEQ ID NO: 8719 - protein, 6 aa, synthetic construct
  REGION 1..6: note = Synthetic Construct
AKRYIK

SEQ ID NO: 8720 - protein, 6 aa, synthetic construct
  REGION 1..6: note = Synthetic Construct
AKRYLK

SEQ ID NO: 8721 - protein, 6 aa, synthetic construct
  REGION 1..6: note = Synthetic Construct
AKRYNK

SEQ ID NO: 8722 - protein, 6 aa, synthetic construct
  REGION 1..6: note = Synthetic Construct
AKRYQK

SEQ ID NO: 8723 - protein, 6 aa, synthetic construct
  REGION 1..6: note = Synthetic Construct
AKRYRK

SEQ ID NO: 8724 - protein, 6 aa, synthetic construct
  REGION 1..6: note = Synthetic Construct
AKRYSK

SEQ ID NO: 8725 - protein, 6 aa, synthetic construct
  REGION 1..6: note = Synthetic Construct
AKRYTK

SEQ ID NO: 8726 - protein, 6 aa, synthetic construct
  REGION 1..6: note = Synthetic Construct
AKRYYK

SEQ ID NO: 8727 - protein, 6 aa, synthetic construct
  REGION 1..6: note = Synthetic Construct
AKSAAK

SEQ ID NO: 8728 - protein, 6 aa, synthetic construct
  REGION 1..6: note = Synthetic Construct
AKSADK

SEQ ID NO: 8729 - protein, 6 aa, synthetic construct
  REGION 1..6: note = Synthetic Construct
AKSAEK

SEQ ID NO: 8730 - protein, 6 aa, synthetic construct
  REGION 1..6: note = Synthetic Construct
AKSAFK

SEQ ID NO: 8731 - protein, 6 aa, synthetic construct
  REGION 1..6: note = Synthetic Construct
AKSAGK

SEQ ID NO: 8732 - protein, 6 aa, synthetic construct
  REGION 1..6: note = Synthetic Construct
AKSAHK

SEQ ID NO: 8733 - protein, 6 aa, synthetic construct
  REGION 1..6: note = Synthetic Construct
AKSAIK

SEQ ID NO: 8734 - protein, 6 aa, synthetic construct
  REGION 1..6: note = Synthetic Construct
AKSALK

SEQ ID NO: 8735 - protein, 6 aa, synthetic construct
  REGION 1..6: note = Synthetic Construct
AKSANK

SEQ ID NO: 8736 - protein, 6 aa, synthetic construct
  REGION 1..6: note = Synthetic Construct
AKSAQK

SEQ ID NO: 8737 - protein, 6 aa, synthetic construct
  REGION 1..6: note = Synthetic Construct
AKSARK

SEQ ID NO: 8738 - protein, 6 aa, synthetic construct
  REGION 1..6: note = Synthetic Construct
AKSASK

SEQ ID NO: 8739 - protein, 6 aa, synthetic construct
  REGION 1..6: note = Synthetic Construct
AKSATK

SEQ ID NO: 8740 - protein, 6 aa, synthetic construct
  REGION 1..6: note = Synthetic Construct
AKSAYK

SEQ ID NO: 8741 - protein, 6 aa, synthetic construct
  REGION 1..6: note = Synthetic Construct
AKSDAK

SEQ ID NO: 8742 - protein, 6 aa, synthetic construct
  REGION 1..6: note = Synthetic Construct
AKSDDK

SEQ ID NO: 8743 - protein, 6 aa, synthetic construct
  REGION 1..6: note = Synthetic Construct
AKSDEK

SEQ ID NO: 8744 - protein, 6 aa, synthetic construct
  REGION 1..6: note = Synthetic Construct
AKSDFK

SEQ ID NO: 8745 - protein, 6 aa, synthetic construct
  REGION 1..6: note = Synthetic Construct
AKSDGK

SEQ ID NO: 8746 - protein, 6 aa, synthetic construct
  REGION 1..6: note = Synthetic Construct
AKSDHK

SEQ ID NO: 8747 - protein, 6 aa, synthetic construct
  REGION 1..6: note = Synthetic Construct
AKSDIK

SEQ ID NO: 8748 - protein, 6 aa, synthetic construct
  REGION 1..6: note = Synthetic Construct
AKSDLK

SEQ ID NO: 8749 - protein, 6 aa, synthetic construct
  REGION 1..6: note = Synthetic Construct
AKSDNK

SEQ ID NO: 8750 - protein, 6 aa, synthetic construct
  REGION 1..6: note = Synthetic Construct
AKSDQK

SEQ ID NO: 8751 - protein, 6 aa, synthetic construct
  REGION 1..6: note = Synthetic Construct
AKSDRK

SEQ ID NO: 8752 - protein, 6 aa, synthetic construct
  REGION 1..6: note = Synthetic Construct
AKSDSK

SEQ ID NO: 8753 - protein, 6 aa, synthetic construct
  REGION 1..6: note = Synthetic Construct
AKSDTK

SEQ ID NO: 8754 - protein, 6 aa, synthetic construct
  REGION 1..6: note = Synthetic Construct
AKSDYK

SEQ ID NO: 8755 - protein, 6 aa, synthetic construct
  REGION 1..6: note = Synthetic Construct
AKSEAK

SEQ ID NO: 8756 - protein, 6 aa, synthetic construct
  REGION 1..6: note = Synthetic Construct
AKSEDK

SEQ ID NO: 8757 - protein, 6 aa, synthetic construct
  REGION 1..6: note = Synthetic Construct
AKSEEK

SEQ ID NO: 8758 - protein, 6 aa, synthetic construct
  REGION 1..6: note = Synthetic Construct
AKSEFK

SEQ ID NO: 8759 - protein, 6 aa, synthetic construct
  REGION 1..6: note = Synthetic Construct
AKSEGK

SEQ ID NO: 8760 - protein, 6 aa, synthetic construct
  REGION 1..6: note = Synthetic Construct
AKSEHK

SEQ ID NO: 8761 - protein, 6 aa, synthetic construct
  REGION 1..6: note = Synthetic Construct
AKSEIK

SEQ ID NO: 8762 - protein, 6 aa, synthetic construct
  REGION 1..6: note = Synthetic Construct
AKSELK

SEQ ID NO: 8763 - protein, 6 aa, synthetic construct
  REGION 1..6: note = Synthetic Construct
AKSENK

SEQ ID NO: 8764 - protein, 6 aa, synthetic construct
  REGION 1..6: note = Synthetic Construct
AKSEQK

SEQ ID NO: 8765 - protein, 6 aa, synthetic construct
  REGION 1..6: note = Synthetic Construct
AKSERK

SEQ ID NO: 8766 - protein, 6 aa, synthetic construct
  REGION 1..6: note = Synthetic Construct
AKSESK

SEQ ID NO: 8767 - protein, 6 aa, synthetic construct
  REGION 1..6: note = Synthetic Construct
AKSETK

SEQ ID NO: 8768 - protein, 6 aa, synthetic construct
  REGION 1..6: note = Synthetic Construct
AKSEYK

SEQ ID NO: 8769 - protein, 6 aa, synthetic construct
  REGION 1..6: note = Synthetic Construct
AKSFAK

SEQ ID NO: 8770 - protein, 6 aa, synthetic construct
  REGION 1..6: note = Synthetic Construct
AKSFDK

SEQ ID NO: 8771 - protein, 6 aa, synthetic construct
  REGION 1..6: note = Synthetic Construct
AKSFEK

SEQ ID NO: 8772 - protein, 6 aa, synthetic construct
  REGION 1..6: note = Synthetic Construct
AKSFFK

SEQ ID NO: 8773 - protein, 6 aa, synthetic construct
  REGION 1..6: note = Synthetic Construct
AKSFGK

SEQ ID NO: 8774 - protein, 6 aa, synthetic construct
  REGION 1..6: note = Synthetic Construct
AKSFHK

SEQ ID NO: 8775 - protein, 6 aa, synthetic construct
  REGION 1..6: note = Synthetic Construct
AKSFIK

SEQ ID NO: 8776 - protein, 6 aa, synthetic construct
  REGION 1..6: note = Synthetic Construct
AKSFLK

SEQ ID NO: 8777 - protein, 6 aa, synthetic construct
  REGION 1..6: note = Synthetic Construct
AKSFNK

SEQ ID NO: 8778 - protein, 6 aa, synthetic construct
  REGION 1..6: note = Synthetic Construct
AKSFQK

SEQ ID NO: 8779 - protein, 6 aa, synthetic construct
  REGION 1..6: note = Synthetic Construct
AKSFRK

SEQ ID NO: 8780 - protein, 6 aa, synthetic construct
  REGION 1..6: note = Synthetic Construct
AKSFSK

SEQ ID NO: 8781 - protein, 6 aa, synthetic construct
  REGION 1..6: note = Synthetic Construct
AKSFTK

SEQ ID NO: 8782 - protein, 6 aa, synthetic construct
  REGION 1..6: note = Synthetic Construct
AKSFYK

SEQ ID NO: 8783 - protein, 6 aa, synthetic construct
  REGION 1..6: note = Synthetic Construct
AKSGAK

SEQ ID NO: 8784 - protein, 6 aa, synthetic construct
  REGION 1..6: note = Synthetic Construct
AKSGDK

SEQ ID NO: 8785 - protein, 6 aa, synthetic construct
  REGION 1..6: note = Synthetic Construct
AKSGEK

SEQ ID NO: 8786 - protein, 6 aa, synthetic construct
  REGION 1..6: note = Synthetic Construct
AKSGFK

SEQ ID NO: 8787 - protein, 6 aa, synthetic construct
  REGION 1..6: note = Synthetic Construct
AKSGGK

SEQ ID NO: 8788 - protein, 6 aa, synthetic construct
  REGION 1..6: note = Synthetic Construct
AKSGHK

SEQ ID NO: 8789 - protein, 6 aa, synthetic construct
  REGION 1..6: note = Synthetic Construct
AKSGIK

SEQ ID NO: 8790 - protein, 6 aa, synthetic construct
  REGION 1..6: note = Synthetic Construct
AKSGLK

SEQ ID NO: 8791 - protein, 6 aa, synthetic construct
  REGION 1..6: note = Synthetic Construct
AKSGNK

SEQ ID NO: 8792 - protein, 6 aa, synthetic construct
  REGION 1..6: note = Synthetic Construct
AKSGQK

SEQ ID NO: 8793 - protein, 6 aa, synthetic construct
  REGION 1..6: note = Synthetic Construct
AKSGRK

SEQ ID NO: 8794 - protein, 6 aa, synthetic construct
  REGION 1..6: note = Synthetic Construct
AKSGSK

SEQ ID NO: 8795 - protein, 6 aa, synthetic construct
  REGION 1..6: note = Synthetic Construct
AKSGTK

SEQ ID NO: 8796 - protein, 6 aa, synthetic construct
  REGION 1..6: note = Synthetic Construct
AKSGYK

SEQ ID NO: 8797 - protein, 6 aa, synthetic construct
  REGION 1..6: note = Synthetic Construct
AKSHAK

SEQ ID NO: 8798 - protein, 6 aa, synthetic construct
  REGION 1..6: note = Synthetic Construct
AKSHDK

SEQ ID NO: 8799 - protein, 6 aa, synthetic construct
  REGION 1..6: note = Synthetic Construct
AKSHEK

SEQ ID NO: 8800 - protein, 6 aa, synthetic construct
  REGION 1..6: note = Synthetic Construct
AKSHFK

SEQ ID NO: 8801 - protein, 6 aa, synthetic construct
  REGION 1..6: note = Synthetic Construct
AKSHGK

SEQ ID NO: 8802 - protein, 6 aa, synthetic construct
  REGION 1..6: note = Synthetic Construct
AKSHHK

SEQ ID NO: 8803 - protein, 6 aa, synthetic construct
  REGION 1..6: note = Synthetic Construct
AKSHIK

SEQ ID NO: 8804 - protein, 6 aa, synthetic construct
  REGION 1..6: note = Synthetic Construct
AKSHLK

SEQ ID NO: 8805 - protein, 6 aa, synthetic construct
  REGION 1..6: note = Synthetic Construct
AKSHNK

SEQ ID NO: 8806 - protein, 6 aa, synthetic construct
  REGION 1..6: note = Synthetic Construct
AKSHQK

SEQ ID NO: 8807 - protein, 6 aa, synthetic construct
  REGION 1..6: note = Synthetic Construct
AKSHRK

SEQ ID NO: 8808 - protein, 6 aa, synthetic construct
  REGION 1..6: note = Synthetic Construct
AKSHSK

SEQ ID NO: 8809 - protein, 6 aa, synthetic construct
  REGION 1..6: note = Synthetic Construct
AKSHTK

SEQ ID NO: 8810 - protein, 6 aa, synthetic construct
  REGION 1..6: note = Synthetic Construct
AKSHYK

SEQ ID NO: 8811 - protein, 6 aa, synthetic construct
  REGION 1..6: note = Synthetic Construct
AKSIAK

SEQ ID NO: 8812 - protein, 6 aa, synthetic construct
  REGION 1..6: note = Synthetic Construct
AKSIDK

SEQ ID NO: 8813 - protein, 6 aa, synthetic construct
  REGION 1..6: note = Synthetic Construct
AKSIEK

SEQ ID NO: 8814 - protein, 6 aa, synthetic construct
  REGION 1..6: note = Synthetic Construct
AKSIFK

SEQ ID NO: 8815 - protein, 6 aa, synthetic construct
  REGION 1..6: note = Synthetic Construct
AKSIGK

SEQ ID NO: 8816 - protein, 6 aa, synthetic construct
  REGION 1..6: note = Synthetic Construct
AKSIHK

SEQ ID NO: 8817 - protein, 6 aa, synthetic construct
  REGION 1..6: note = Synthetic Construct
AKSIIK

SEQ ID NO: 8818 - protein, 6 aa, synthetic construct
  REGION 1..6: note = Synthetic Construct
AKSILK

SEQ ID NO: 8819 - protein, 6 aa, synthetic construct
  REGION 1..6: note = Synthetic Construct
AKSINK

SEQ ID NO: 8820 - protein, 6 aa, synthetic construct
  REGION 1..6: note = Synthetic Construct
AKSIQK

SEQ ID NO: 8821 - protein, 6 aa, synthetic construct
  REGION 1..6: note = Synthetic Construct
AKSIRK

SEQ ID NO: 8822 - protein, 6 aa, synthetic construct
  REGION 1..6: note = Synthetic Construct
AKSISK

SEQ ID NO: 8823 - protein, 6 aa, synthetic construct
  REGION 1..6: note = Synthetic Construct
AKSITK

SEQ ID NO: 8824 - protein, 6 aa, synthetic construct
  REGION 1..6: note = Synthetic Construct
AKSIYK

SEQ ID NO: 8825 - protein, 6 aa, synthetic construct
  REGION 1..6: note = Synthetic Construct
AKSLAK

SEQ ID NO: 8826 - protein, 6 aa, synthetic construct
  REGION 1..6: note = Synthetic Construct
AKSLDK

SEQ ID NO: 8827 - protein, 6 aa, synthetic construct
  REGION 1..6: note = Synthetic Construct
AKSLEK

SEQ ID NO: 8828 - protein, 6 aa, synthetic construct
  REGION 1..6: note = Synthetic Construct
AKSLFK

SEQ ID NO: 8829 - protein, 6 aa, synthetic construct
  REGION 1..6: note = Synthetic Construct
AKSLGK

SEQ ID NO: 8830 - protein, 6 aa, synthetic construct
  REGION 1..6: note = Synthetic Construct
AKSLHK

SEQ ID NO: 8831 - protein, 6 aa, synthetic construct
  REGION 1..6: note = Synthetic Construct
AKSLIK

SEQ ID NO: 8832 - protein, 6 aa, synthetic construct
  REGION 1..6: note = Synthetic Construct
AKSLLK

SEQ ID NO: 8833 - protein, 6 aa, synthetic construct
  REGION 1..6: note = Synthetic Construct
AKSLNK

SEQ ID NO: 8834 - protein, 6 aa, synthetic construct
  REGION 1..6: note = Synthetic Construct
AKSLQK

SEQ ID NO: 8835 - protein, 6 aa, synthetic construct
  REGION 1..6: note = Synthetic Construct
AKSLRK

SEQ ID NO: 8836 - protein, 6 aa, synthetic construct
  REGION 1..6: note = Synthetic Construct
AKSLSK

SEQ ID NO: 8837 - protein, 6 aa, synthetic construct
  REGION 1..6: note = Synthetic Construct
AKSLTK

SEQ ID NO: 8838 - protein, 6 aa, synthetic construct
  REGION 1..6: note = Synthetic Construct
AKSLYK

SEQ ID NO: 8839 - protein, 6 aa, synthetic construct
  REGION 1..6: note = Synthetic Construct
AKSNAK

SEQ ID NO: 8840 - protein, 6 aa, synthetic construct
  REGION 1..6: note = Synthetic Construct
AKSNDK

SEQ ID NO: 8841 - protein, 6 aa, synthetic construct
  REGION 1..6: note = Synthetic Construct
AKSNEK

SEQ ID NO: 8842 - protein, 6 aa, synthetic construct
  REGION 1..6: note = Synthetic Construct
AKSNFK

SEQ ID NO: 8843 - protein, 6 aa, synthetic construct
  REGION 1..6: note = Synthetic Construct
AKSNGK

SEQ ID NO: 8844 - protein, 6 aa, synthetic construct
  REGION 1..6: note = Synthetic Construct
AKSNHK

SEQ ID NO: 8845 - protein, 6 aa, synthetic construct
  REGION 1..6: note = Synthetic Construct
AKSNIK

SEQ ID NO: 8846 - protein, 6 aa, synthetic construct
  REGION 1..6: note = Synthetic Construct
AKSNLK

SEQ ID NO: 8847 - protein, 6 aa, synthetic construct
  REGION 1..6: note = Synthetic Construct
AKSNNK

SEQ ID NO: 8848 - protein, 6 aa, synthetic construct
  REGION 1..6: note = Synthetic Construct
AKSNQK

SEQ ID NO: 8849 - protein, 6 aa, synthetic construct
  REGION 1..6: note = Synthetic Construct
AKSNRK

SEQ ID NO: 8850 - protein, 6 aa, synthetic construct
  REGION 1..6: note = Synthetic Construct
AKSNSK

SEQ ID NO: 8851 - protein, 6 aa, synthetic construct
  REGION 1..6: note = Synthetic Construct
AKSNTK

SEQ ID NO: 8852 - protein, 6 aa, synthetic construct
  REGION 1..6: note = Synthetic Construct
AKSNYK

SEQ ID NO: 8853 - protein, 6 aa, synthetic construct
  REGION 1..6: note = Synthetic Construct
AKSQAK

SEQ ID NO: 8854 - protein, 6 aa, synthetic construct
  REGION 1..6: note = Synthetic Construct
AKSQDK

SEQ ID NO: 8855 - protein, 6 aa, synthetic construct
  REGION 1..6: note = Synthetic Construct
AKSQEK

SEQ ID NO: 8856 - protein, 6 aa, synthetic construct
  REGION 1..6: note = Synthetic Construct
AKSQFK

SEQ ID NO: 8857 - protein, 6 aa, synthetic construct
  REGION 1..6: note = Synthetic Construct
AKSQGK

SEQ ID NO: 8858 - protein, 6 aa, synthetic construct
  REGION 1..6: note = Synthetic Construct
AKSQHK

SEQ ID NO: 8859 - protein, 6 aa, synthetic construct
  REGION 1..6: note = Synthetic Construct
AKSQIK

SEQ ID NO: 8860 - protein, 6 aa, synthetic construct
  REGION 1..6: note = Synthetic Construct
AKSQLK

SEQ ID NO: 8861 - protein, 6 aa, synthetic construct
  REGION 1..6: note = Synthetic Construct
AKSQNK

SEQ ID NO: 8862 - protein, 6 aa, synthetic construct
  REGION 1..6: note = Synthetic Construct
AKSQQK

SEQ ID NO: 8863 - protein, 6 aa, synthetic construct
  REGION 1..6: note = Synthetic Construct
AKSQRK

SEQ ID NO: 8864 - protein, 6 aa, synthetic construct
  REGION 1..6: note = Synthetic Construct
AKSQSK

SEQ ID NO: 8865 - protein, 6 aa, synthetic construct
  REGION 1..6: note = Synthetic Construct
AKSQTK

SEQ ID NO: 8866 - protein, 6 aa, synthetic construct
  REGION 1..6: note = Synthetic Construct
AKSQYK

SEQ ID NO: 8867 - protein, 6 aa, synthetic construct
  REGION 1..6: note = Synthetic Construct
AKSRAK

SEQ ID NO: 8868 - protein, 6 aa, synthetic construct
  REGION 1..6: note = Synthetic Construct
AKSRDK

SEQ ID NO: 8869 - protein, 6 aa, synthetic construct
  REGION 1..6: note = Synthetic Construct
AKSREK

SEQ ID NO: 8870 - protein, 6 aa, synthetic construct
  REGION 1..6: note = Synthetic Construct
AKSRFK

SEQ ID NO: 8871 - protein, 6 aa, synthetic construct
  REGION 1..6: note = Synthetic Construct
AKSRGK

SEQ ID NO: 8872 - protein, 6 aa, synthetic construct
  REGION 1..6: note = Synthetic Construct
AKSRHK

SEQ ID NO: 8873 - protein, 6 aa, synthetic construct
  REGION 1..6: note = Synthetic Construct
AKSRIK

SEQ ID NO: 8874 - protein, 6 aa, synthetic construct
  REGION 1..6: note = Synthetic Construct
AKSRLK

SEQ ID NO: 8875 - protein, 6 aa, synthetic construct
  REGION 1..6: note = Synthetic Construct
AKSRNK

SEQ ID NO: 8876 - protein, 6 aa, synthetic construct
  REGION 1..6: note = Synthetic Construct
AKSRQK

SEQ ID NO: 8877 - protein, 6 aa, synthetic construct
  REGION 1..6: note = Synthetic Construct
AKSRRK

SEQ ID NO: 8878 - protein, 6 aa, synthetic construct
  REGION 1..6: note = Synthetic Construct
AKSRSK

SEQ ID NO: 8879 - protein, 6 aa, synthetic construct
  REGION 1..6: note = Synthetic Construct
AKSRTK

SEQ ID NO: 8880 - protein, 6 aa, synthetic construct
  REGION 1..6: note = Synthetic Construct
AKSRYK

SEQ ID NO: 8881 - protein, 6 aa, synthetic construct
  REGION 1..6: note = Synthetic Construct
AKSSAK

SEQ ID NO: 8882 - protein, 6 aa, synthetic construct
  REGION 1..6: note = Synthetic Construct
AKSSDK

SEQ ID NO: 8883 - protein, 6 aa, synthetic construct
  REGION 1..6: note = Synthetic Construct
AKSSEK

SEQ ID NO: 8884 - protein, 6 aa, synthetic construct
  REGION 1..6: note = Synthetic Construct
AKSSFK

SEQ ID NO: 8885 - protein, 6 aa, synthetic construct
  REGION 1..6: note = Synthetic Construct
AKSSGK

SEQ ID NO: 8886 - protein, 6 aa, synthetic construct
  REGION 1..6: note = Synthetic Construct
AKSSHK

SEQ ID NO: 8887 - protein, 6 aa, synthetic construct
  REGION 1..6: note = Synthetic Construct
AKSSIK

SEQ ID NO: 8888 - protein, 6 aa, synthetic construct
  REGION 1..6: note = Synthetic Construct
AKSSLK

SEQ ID NO: 8889 - protein, 6 aa, synthetic construct
  REGION 1..6: note = Synthetic Construct
AKSSNK

SEQ ID NO: 8890 - protein, 6 aa, synthetic construct
  REGION 1..6: note = Synthetic Construct
AKSSQK

SEQ ID NO: 8891 - protein, 6 aa, synthetic construct
  REGION 1..6: note = Synthetic Construct
AKSSRK

SEQ ID NO: 8892 - protein, 6 aa, synthetic construct
  REGION 1..6: note = Synthetic Construct
AKSSSK

SEQ ID NO: 8893 - protein, 6 aa, synthetic construct
  REGION 1..6: note = Synthetic Construct
AKSSTK

SEQ ID NO: 8894 - protein, 6 aa, synthetic construct
  REGION 1..6: note = Synthetic Construct
AKSSYK

SEQ ID NO: 8895 - protein, 6 aa, synthetic construct
  REGION 1..6: note = Synthetic Construct
AKSTAK

SEQ ID NO: 8896 - protein, 6 aa, synthetic construct
  REGION 1..6: note = Synthetic Construct
AKSTDK

SEQ ID NO: 8897 - protein, 6 aa, synthetic construct
  REGION 1..6: note = Synthetic Construct
AKSTEK

SEQ ID NO: 8898 - protein, 6 aa, synthetic construct
  REGION 1..6: note = Synthetic Construct
AKSTFK

SEQ ID NO: 8899 - protein, 6 aa, synthetic construct
  REGION 1..6: note = Synthetic Construct
AKSTGK

SEQ ID NO: 8900 - protein, 6 aa, synthetic construct
  REGION 1..6: note = Synthetic Construct
AKSTHK

SEQ ID NO: 8901 - protein, 6 aa, synthetic construct
  REGION 1..6: note = Synthetic Construct
AKSTIK

SEQ ID NO: 8902 - protein, 6 aa, synthetic construct
  REGION 1..6: note = Synthetic Construct
AKSTLK

SEQ ID NO: 8903 - protein, 6 aa, synthetic construct
  REGION 1..6: note = Synthetic Construct
AKSTNK

SEQ ID NO: 8904 - protein, 6 aa, synthetic construct
  REGION 1..6: note = Synthetic Construct
AKSTQK

SEQ ID NO: 8905 - protein, 6 aa, synthetic construct
  REGION 1..6: note = Synthetic Construct
AKSTRK

SEQ ID NO: 8906 - protein, 6 aa, synthetic construct
  REGION 1..6: note = Synthetic Construct
AKSTSK

SEQ ID NO: 8907 - protein, 6 aa, synthetic construct
  REGION 1..6: note = Synthetic Construct
AKSTTK

SEQ ID NO: 8908 - protein, 6 aa, synthetic construct
  REGION 1..6: note = Synthetic Construct
AKSTYK

SEQ ID NO: 8909 - protein, 6 aa, synthetic construct
  REGION 1..6: note = Synthetic Construct
AKSYAK

SEQ ID NO: 8910 - protein, 6 aa, synthetic construct
  REGION 1..6: note = Synthetic Construct
AKSYDK

SEQ ID NO: 8911 - protein, 6 aa, synthetic construct
  REGION 1..6: note = Synthetic Construct
AKSYEK

SEQ ID NO: 8912 - protein, 6 aa, synthetic construct
  REGION 1..6: note = Synthetic Construct
AKSYFK

SEQ ID NO: 8913 - protein, 6 aa, synthetic construct
  REGION 1..6: note = Synthetic Construct
AKSYGK

SEQ ID NO: 8914 - protein, 6 aa, synthetic construct
  REGION 1..6: note = Synthetic Construct
AKSYHK

SEQ ID NO: 8915 - protein, 6 aa, synthetic construct
  REGION 1..6: note = Synthetic Construct
AKSYIK

SEQ ID NO: 8916 - protein, 6 aa, synthetic construct
  REGION 1..6: note = Synthetic Construct
AKSYLK

SEQ ID NO: 8917 - protein, 6 aa, synthetic construct
  REGION 1..6: note = Synthetic Construct
AKSYNK

SEQ ID NO: 8918 - protein, 6 aa, synthetic construct
  REGION 1..6: note = Synthetic Construct
AKSYQK

SEQ ID NO: 8919 - protein, 6 aa, synthetic construct
  REGION 1..6: note = Synthetic Construct
AKSYRK

SEQ ID NO: 8920 - protein, 6 aa, synthetic construct
  REGION 1..6: note = Synthetic Construct
AKSYSK

SEQ ID NO: 8921 - protein, 6 aa, synthetic construct
  REGION 1..6: note = Synthetic Construct
AKSYTK

SEQ ID NO: 8922 - protein, 6 aa, synthetic construct
  REGION 1..6: note = Synthetic Construct
AKSYYK

SEQ ID NO: 8923 - protein, 6 aa, synthetic construct
  REGION 1..6: note = Synthetic Construct
AKTAAK

SEQ ID NO: 8924 - protein, 6 aa, synthetic construct
  REGION 1..6: note = Synthetic Construct
AKTADK

SEQ ID NO: 8925 - protein, 6 aa, synthetic construct
  REGION 1..6: note = Synthetic Construct
AKTAEK

SEQ ID NO: 8926 - protein, 6 aa, synthetic construct
  REGION 1..6: note = Synthetic Construct
AKTAFK

SEQ ID NO: 8927 - protein, 6 aa, synthetic construct
  REGION 1..6: note = Synthetic Construct
AKTAGK

SEQ ID NO: 8928 - protein, 6 aa, synthetic construct
  REGION 1..6: note = Synthetic Construct
AKTAHK

SEQ ID NO: 8929 - protein, 6 aa, synthetic construct
  REGION 1..6: note = Synthetic Construct
AKTAIK

SEQ ID NO: 8930 - protein, 6 aa, synthetic construct
  REGION 1..6: note = Synthetic Construct
AKTALK

SEQ ID NO: 8931 - protein, 6 aa, synthetic construct
  REGION 1..6: note = Synthetic Construct
AKTANK

SEQ ID NO: 8932 - protein, 6 aa, synthetic construct
  REGION 1..6: note = Synthetic Construct
AKTAQK

SEQ ID NO: 8933 - protein, 6 aa, synthetic construct
  REGION 1..6: note = Synthetic Construct
AKTARK

SEQ ID NO: 8934 - protein, 6 aa, synthetic construct
  REGION 1..6: note = Synthetic Construct
AKTASK

SEQ ID NO: 8935 - protein, 6 aa, synthetic construct
  REGION 1..6: note = Synthetic Construct
AKTATK

SEQ ID NO: 8936 - protein, 6 aa, synthetic construct
  REGION 1..6: note = Synthetic Construct
AKTAYK

SEQ ID NO: 8937 - protein, 6 aa, synthetic construct
  REGION 1..6: note = Synthetic Construct
AKTDAK

SEQ ID NO: 8938 - protein, 6 aa, synthetic construct
  REGION 1..6: note = Synthetic Construct
AKTDDK

SEQ ID NO: 8939 - protein, 6 aa, synthetic construct
  REGION 1..6: note = Synthetic Construct
AKTDEK

SEQ ID NO: 8940 - protein, 6 aa, synthetic construct
  REGION 1..6: note = Synthetic Construct
AKTDFK

SEQ ID NO: 8941 - protein, 6 aa, synthetic construct
  REGION 1..6: note = Synthetic Construct
AKTDGK

SEQ ID NO: 8942 - protein, 6 aa, synthetic construct
  REGION 1..6: note = Synthetic Construct
AKTDHK

SEQ ID NO: 8943 - protein, 6 aa, synthetic construct
  REGION 1..6: note = Synthetic Construct
AKTDIK

SEQ ID NO: 8944 - protein, 6 aa, synthetic construct
  REGION 1..6: note = Synthetic Construct
AKTDLK

SEQ ID NO: 8945 - protein, 6 aa, synthetic construct
  REGION 1..6: note = Synthetic Construct
AKTDNK

SEQ ID NO: 8946 - protein, 6 aa, synthetic construct
  REGION 1..6: note = Synthetic Construct
AKTDQK

SEQ ID NO: 8947 - protein, 6 aa, synthetic construct
  REGION 1..6: note = Synthetic Construct
AKTDRK

SEQ ID NO: 8948 - protein, 6 aa, synthetic construct
  REGION 1..6: note = Synthetic Construct
AKTDSK

SEQ ID NO: 8949 - protein, 6 aa, synthetic construct
  REGION 1..6: note = Synthetic Construct
AKTDTK

SEQ ID NO: 8950 - protein, 6 aa, synthetic construct
  REGION 1..6: note = Synthetic Construct
AKTDYK

SEQ ID NO: 8951 - protein, 6 aa, synthetic construct
  REGION 1..6: note = Synthetic Construct
AKTEAK

SEQ ID NO: 8952 - protein, 6 aa, synthetic construct
  REGION 1..6: note = Synthetic Construct
AKTEDK

SEQ ID NO: 8953 - protein, 6 aa, synthetic construct
  REGION 1..6: note = Synthetic Construct
AKTEEK

SEQ ID NO: 8954 - protein, 6 aa, synthetic construct
  REGION 1..6: note = Synthetic Construct
AKTEFK

SEQ ID NO: 8955 - protein, 6 aa, synthetic construct
  REGION 1..6: note = Synthetic Construct
AKTEGK

SEQ ID NO: 8956 - protein, 6 aa, synthetic construct
  REGION 1..6: note = Synthetic Construct
AKTEHK

SEQ ID NO: 8957 - protein, 6 aa, synthetic construct
  REGION 1..6: note = Synthetic Construct
AKTEIK

SEQ ID NO: 8958 - protein, 6 aa, synthetic construct
  REGION 1..6: note = Synthetic Construct
AKTELK

SEQ ID NO: 8959 - protein, 6 aa, synthetic construct
  REGION 1..6: note = Synthetic Construct
AKTENK

SEQ ID NO: 8960 - protein, 6 aa, synthetic construct
  REGION 1..6: note = Synthetic Construct
AKTEQK

SEQ ID NO: 8961 - protein, 6 aa, synthetic construct
  REGION 1..6: note = Synthetic Construct
AKTERK

SEQ ID NO: 8962 - protein, 6 aa, synthetic construct
  REGION 1..6: note = Synthetic Construct
AKTESK

SEQ ID NO: 8963 - protein, 6 aa, synthetic construct
  REGION 1..6: note = Synthetic Construct
AKTETK

SEQ ID NO: 8964 - protein, 6 aa, synthetic construct
  REGION 1..6: note = Synthetic Construct
AKTEYK

SEQ ID NO: 8965 - protein, 6 aa, synthetic construct
  REGION 1..6: note = Synthetic Construct
AKTFAK

SEQ ID NO: 8966 - protein, 6 aa, synthetic construct
  REGION 1..6: note = Synthetic Construct
AKTFDK

SEQ ID NO: 8967 - protein, 6 aa, synthetic construct
  REGION 1..6: note = Synthetic Construct
AKTFEK

SEQ ID NO: 8968 - protein, 6 aa, synthetic construct
  REGION 1..6: note = Synthetic Construct
AKTFFK

SEQ ID NO: 8969 - protein, 6 aa, synthetic construct
  REGION 1..6: note = Synthetic Construct
AKTFGK

SEQ ID NO: 8970 - protein, 6 aa, synthetic construct
  REGION 1..6: note = Synthetic Construct
AKTFHK

SEQ ID NO: 8971 - protein, 6 aa, synthetic construct
  REGION 1..6: note = Synthetic Construct
AKTFIK

SEQ ID NO: 8972 - protein, 6 aa, synthetic construct
  REGION 1..6: note = Synthetic Construct
AKTFLK

SEQ ID NO: 8973 - protein, 6 aa, synthetic construct
  REGION 1..6: note = Synthetic Construct
AKTFNK

SEQ ID NO: 8974 - protein, 6 aa, synthetic construct
  REGION 1..6: note = Synthetic Construct
AKTFQK

SEQ ID NO: 8975 - protein, 6 aa, synthetic construct
  REGION 1..6: note = Synthetic Construct
AKTFRK

SEQ ID NO: 8976 - protein, 6 aa, synthetic construct
  REGION 1..6: note = Synthetic Construct
AKTFSK

SEQ ID NO: 8977 - protein, 6 aa, synthetic construct
  REGION 1..6: note = Synthetic Construct
AKTFTK

SEQ ID NO: 8978 - protein, 6 aa, synthetic construct
  REGION 1..6: note = Synthetic Construct
AKTFYK

SEQ ID NO: 8979 - protein, 6 aa, synthetic construct
  REGION 1..6: note = Synthetic Construct
AKTGAK

SEQ ID NO: 8980 - protein, 6 aa, synthetic construct
  REGION 1..6: note = Synthetic Construct
AKTGDK

SEQ ID NO: 8981 - protein, 6 aa, synthetic construct
  REGION 1..6: note = Synthetic Construct
AKTGEK

SEQ ID NO: 8982 - protein, 6 aa, synthetic construct
  REGION 1..6: note = Synthetic Construct
AKTGFK

SEQ ID NO: 8983 - protein, 6 aa, synthetic construct
  REGION 1..6: note = Synthetic Construct
AKTGGK

SEQ ID NO: 8984 - protein, 6 aa, synthetic construct
  REGION 1..6: note = Synthetic Construct
AKTGHK

SEQ ID NO: 8985 - protein, 6 aa, synthetic construct
  REGION 1..6: note = Synthetic Construct
AKTGIK

SEQ ID NO: 8986 - protein, 6 aa, synthetic construct
  REGION 1..6: note = Synthetic Construct
AKTGLK

SEQ ID NO: 8987 - protein, 6 aa, synthetic construct
  REGION 1..6: note = Synthetic Construct
AKTGNK

SEQ ID NO: 8988 - protein, 6 aa, synthetic construct
  REGION 1..6: note = Synthetic Construct
AKTGQK

SEQ ID NO: 8989 - protein, 6 aa, synthetic construct
  REGION 1..6: note = Synthetic Construct
AKTGRK

SEQ ID NO: 8990 - protein, 6 aa, synthetic construct
  REGION 1..6: note = Synthetic Construct
AKTGSK

SEQ ID NO: 8991 - protein, 6 aa, synthetic construct
  REGION 1..6: note = Synthetic Construct
AKTGTK

SEQ ID NO: 8992 - protein, 6 aa, synthetic construct
  REGION 1..6: note = Synthetic Construct
AKTGYK

SEQ ID NO: 8993 - protein, 6 aa, synthetic construct
  REGION 1..6: note = Synthetic Construct
AKTHAK

SEQ ID NO: 8994 - protein, 6 aa, synthetic construct
  REGION 1..6: note = Synthetic Construct
AKTHDK

SEQ ID NO: 8995 - protein, 6 aa, synthetic construct
  REGION 1..6: note = Synthetic Construct
AKTHEK

SEQ ID NO: 8996 - protein, 6 aa, synthetic construct
  REGION 1..6: note = Synthetic Construct
AKTHFK

SEQ ID NO: 8997 - protein, 6 aa, synthetic construct
  REGION 1..6: note = Synthetic Construct
AKTHGK

SEQ ID NO: 8998 - protein, 6 aa, synthetic construct
  REGION 1..6: note = Synthetic Construct
AKTHHK

SEQ ID NO: 8999 - protein, 6 aa, synthetic construct
  REGION 1..6: note = Synthetic Construct
AKTHIK

SEQ ID NO: 9000 - protein, 6 aa, synthetic construct
  REGION 1..6: note = Synthetic Construct
AKTHLK

SEQ ID NO: 9001 - protein, 6 aa, synthetic construct
  REGION 1..6: note = Synthetic Construct
AKTHNK

SEQ ID NO: 9002 - protein, 6 aa, synthetic construct
  REGION 1..6: note = Synthetic Construct
AKTHQK

SEQ ID NO: 9003 - protein, 6 aa, synthetic construct
  REGION 1..6: note = Synthetic Construct
AKTHRK

SEQ ID NO: 9004 - protein, 6 aa, synthetic construct
  REGION 1..6: note = Synthetic Construct
AKTHSK

SEQ ID NO: 9005 - protein, 6 aa, synthetic construct
  REGION 1..6: note = Synthetic Construct
AKTHTK

SEQ ID NO: 9006 - protein, 6 aa, synthetic construct
  REGION 1..6: note = Synthetic Construct
AKTHYK

SEQ ID NO: 9007 - protein, 6 aa, synthetic construct
  REGION 1..6: note = Synthetic Construct
AKTIAK

SEQ ID NO: 9008 - protein, 6 aa, synthetic construct
  REGION 1..6: note = Synthetic Construct
AKTIDK

SEQ ID NO: 9009 - protein, 6 aa, synthetic construct
  REGION 1..6: note = Synthetic Construct
AKTIEK

SEQ ID NO: 9010 - protein, 6 aa, synthetic construct
  REGION 1..6: note = Synthetic Construct
AKTIFK

SEQ ID NO: 9011 - protein, 6 aa, synthetic construct
  REGION 1..6: note = Synthetic Construct
AKTIGK

SEQ ID NO: 9012 - protein, 6 aa, synthetic construct
  REGION 1..6: note = Synthetic Construct
AKTIHK

SEQ ID NO: 9013 - protein, 6 aa, synthetic construct
  REGION 1..6: note = Synthetic Construct
AKTIIK

SEQ ID NO: 9014 - protein, 6 aa, synthetic construct
  REGION 1..6: note = Synthetic Construct
AKTILK

SEQ ID NO: 9015 - protein, 6 aa, synthetic construct
  REGION 1..6: note = Synthetic Construct
AKTINK

SEQ ID NO: 9016 - protein, 6 aa, synthetic construct
  REGION 1..6: note = Synthetic Construct
AKTIQK

SEQ ID NO: 9017 - protein, 6 aa, synthetic construct
  REGION 1..6: note = Synthetic Construct
AKTIRK

SEQ ID NO: 9018 - protein, 6 aa, synthetic construct
  REGION 1..6: note = Synthetic Construct
AKTISK

SEQ ID NO: 9019 - protein, 6 aa, synthetic construct
  REGION 1..6: note = Synthetic Construct
AKTITK

SEQ ID NO: 9020 - protein, 6 aa, synthetic construct
  REGION 1..6: note = Synthetic Construct
AKTIYK

SEQ ID NO: 9021 - protein, 6 aa, synthetic construct
  REGION 1..6: note = Synthetic Construct
AKTLAK

SEQ ID NO: 9022 - protein, 6 aa, synthetic construct
  REGION 1..6: note = Synthetic Construct
AKTLDK

SEQ ID NO: 9023 - protein, 6 aa, synthetic construct
  REGION 1..6: note = Synthetic Construct
AKTLEK

SEQ ID NO: 9024 - protein, 6 aa, synthetic construct
  REGION 1..6: note = Synthetic Construct
AKTLFK

SEQ ID NO: 9025 - protein, 6 aa, synthetic construct
  REGION 1..6: note = Synthetic Construct
AKTLGK

SEQ ID NO: 9026 - protein, 6 aa, synthetic construct
  REGION 1..6: note = Synthetic Construct
AKTLHK

SEQ ID NO: 9027 - protein, 6 aa, synthetic construct
  REGION 1..6: note = Synthetic Construct
AKTLIK

SEQ ID NO: 9028 - protein, 6 aa, synthetic construct
  REGION 1..6: note = Synthetic Construct
AKTLLK

SEQ ID NO: 9029 - protein, 6 aa, synthetic construct
  REGION 1..6: note = Synthetic Construct
AKTLNK

SEQ ID NO: 9030 - protein, 6 aa, synthetic construct
  REGION 1..6: note = Synthetic Construct
AKTLQK

SEQ ID NO: 9031 - protein, 6 aa, synthetic construct
  REGION 1..6: note = Synthetic Construct
AKTLRK

SEQ ID NO: 9032 - protein, 6 aa, synthetic construct
  REGION 1..6: note = Synthetic Construct
AKTLSK

SEQ ID NO: 9033 - protein, 6 aa, synthetic construct
  REGION 1..6: note = Synthetic Construct
AKTLTK

SEQ ID NO: 9034 - protein, 6 aa, synthetic construct
  REGION 1..6: note = Synthetic Construct
AKTLYK

SEQ ID NO: 9035 - protein, 6 aa, synthetic construct
  REGION 1..6: note = Synthetic Construct
AKTNAK

SEQ ID NO: 9036 - protein, 6 aa, synthetic construct
  REGION 1..6: note = Synthetic Construct
AKTNDK

SEQ ID NO: 9037 - protein, 6 aa, synthetic construct
  REGION 1..6: note = Synthetic Construct
AKTNEK

SEQ ID NO: 9038 - protein, 6 aa, synthetic construct
  REGION 1..6: note = Synthetic Construct
AKTNFK

SEQ ID NO: 9039 - protein, 6 aa, synthetic construct
  REGION 1..6: note = Synthetic Construct
AKTNGK

SEQ ID NO: 9040 - protein, 6 aa, synthetic construct
  REGION 1..6: note = Synthetic Construct
AKTNHK

SEQ ID NO: 9041 - protein, 6 aa, synthetic construct
  REGION 1..6: note = Synthetic Construct
AKTNIK

SEQ ID NO: 9042 - protein, 6 aa, synthetic construct
  REGION 1..6: note = Synthetic Construct
AKTNLK

SEQ ID NO: 9043 - protein, 6 aa, synthetic construct
  REGION 1..6: note = Synthetic Construct
AKTNNK

SEQ ID NO: 9044 - protein, 6 aa, synthetic construct
  REGION 1..6: note = Synthetic Construct
AKTNQK

SEQ ID NO: 9045 - protein, 6 aa, synthetic construct
  REGION 1..6: note = Synthetic Construct
AKTNRK

SEQ ID NO: 9046 - protein, 6 aa, synthetic construct
  REGION 1..6: note = Synthetic Construct
AKTNSK

SEQ ID NO: 9047 - protein, 6 aa, synthetic construct
  REGION 1..6: note = Synthetic Construct
AKTNTK

SEQ ID NO: 9048 - protein, 6 aa, synthetic construct
  REGION 1..6: note = Synthetic Construct
AKTNYK

SEQ ID NO: 9049 - protein, 6 aa, synthetic construct
  REGION 1..6: note = Synthetic Construct
AKTQAK

SEQ ID NO: 9050 - protein, 6 aa, synthetic construct
  REGION 1..6: note = Synthetic Construct
AKTQDK

SEQ ID NO: 9051 - protein, 6 aa, synthetic construct
  REGION 1..6: note = Synthetic Construct
AKTQEK

SEQ ID NO: 9052 - protein, 6 aa, synthetic construct
  REGION 1..6: note = Synthetic Construct
AKTQFK

SEQ ID NO: 9053 - protein, 6 aa, synthetic construct
  REGION 1..6: note = Synthetic Construct
AKTQGK

SEQ ID NO: 9054 - protein, 6 aa, synthetic construct
  REGION 1..6: note = Synthetic Construct
AKTQHK

SEQ ID NO: 9055 - protein, 6 aa, synthetic construct
  REGION 1..6: note = Synthetic Construct
AKTQIK

SEQ ID NO: 9056 - protein, 6 aa, synthetic construct
  REGION 1..6: note = Synthetic Construct
AKTQLK

SEQ ID NO: 9057 - protein, 6 aa, synthetic construct
  REGION 1..6: note = Synthetic Construct
AKTQNK

SEQ ID NO: 9058 - protein, 6 aa, synthetic construct
  REGION 1..6: note = Synthetic Construct
AKTQQK

SEQ ID NO: 9059 - protein, 6 aa, synthetic construct
  REGION 1..6: note = Synthetic Construct
AKTQRK

SEQ ID NO: 9060 - protein, 6 aa, synthetic construct
  REGION 1..6: note = Synthetic Construct
AKTQSK

SEQ ID NO: 9061 - protein, 6 aa, synthetic construct
  REGION 1..6: note = Synthetic Construct
AKTQTK

SEQ ID NO: 9062 - protein, 6 aa, synthetic construct
  REGION 1..6: note = Synthetic Construct
AKTQYK

SEQ ID NO: 9063 - protein, 6 aa, synthetic construct
  REGION 1..6: note = Synthetic Construct
AKTRAK

SEQ ID NO: 9064 - protein, 6 aa, synthetic construct
  REGION 1..6: note = Synthetic Construct
AKTRDK

SEQ ID NO: 9065 - protein, 6 aa, synthetic construct
  REGION 1..6: note = Synthetic Construct
AKTREK

SEQ ID NO: 9066 - protein, 6 aa, synthetic construct
  REGION 1..6: note = Synthetic Construct
AKTRFK

SEQ ID NO: 9067 - protein, 6 aa, synthetic construct
  REGION 1..6: note = Synthetic Construct
AKTRGK

SEQ ID NO: 9068 - protein, 6 aa, synthetic construct
  REGION 1..6: note = Synthetic Construct
AKTRHK

SEQ ID NO: 9069 - protein, 6 aa, synthetic construct
  REGION 1..6: note = Synthetic Construct
AKTRIK

SEQ ID NO: 9070 - protein, 6 aa, synthetic construct
  REGION 1..6: note = Synthetic Construct
AKTRLK

SEQ ID NO: 9071 - protein, 6 aa, synthetic construct
  REGION 1..6: note = Synthetic Construct
AKTRNK

SEQ ID NO: 9072 - protein, 6 aa, synthetic construct
  REGION 1..6: note = Synthetic Construct
AKTRQK

SEQ ID NO: 9073 - protein, 6 aa, synthetic construct
  REGION 1..6: note = Synthetic Construct
AKTRRK

SEQ ID NO: 9074 - protein, 6 aa, synthetic construct
  REGION 1..6: note = Synthetic Construct
AKTRSK

SEQ ID NO: 9075 - protein, 6 aa, synthetic construct
  REGION 1..6: note = Synthetic Construct
AKTRTK

SEQ ID NO: 9076 - protein, 6 aa, synthetic construct
  REGION 1..6: note = Synthetic Construct
AKTRYK

SEQ ID NO: 9077 - protein, 6 aa, synthetic construct
  REGION 1..6: note = Synthetic Construct
AKTSAK

SEQ ID NO: 9078 - protein, 6 aa, synthetic construct
  REGION 1..6: note = Synthetic Construct
AKTSDK

SEQ ID NO: 9079 - protein, 6 aa, synthetic construct
  REGION 1..6: note = Synthetic Construct
AKTSEK

SEQ ID NO: 9080 - protein, 6 aa, synthetic construct
  REGION 1..6: note = Synthetic Construct
AKTSFK

SEQ ID NO: 9081 - protein, 6 aa, synthetic construct
  REGION 1..6: note = Synthetic Construct
AKTSGK

SEQ ID NO: 9082 - protein, 6 aa, synthetic construct
  REGION 1..6: note = Synthetic Construct
AKTSHK

SEQ ID NO: 9083 - protein, 6 aa, synthetic construct
  REGION 1..6: note = Synthetic Construct
AKTSIK

SEQ ID NO: 9084 - protein, 6 aa, synthetic construct
  REGION 1..6: note = Synthetic Construct
AKTSLK

SEQ ID NO: 9085 - protein, 6 aa, synthetic construct
  REGION 1..6: note = Synthetic Construct
AKTSNK

SEQ ID NO: 9086 - protein, 6 aa, synthetic construct
  REGION 1..6: note = Synthetic Construct
AKTSQK

SEQ ID NO: 9087 - protein, 6 aa, synthetic construct
  REGION 1..6: note = Synthetic Construct
AKTSRK

SEQ ID NO: 9088 - protein, 6 aa, synthetic construct
  REGION 1..6: note = Synthetic Construct
AKTSSK

SEQ ID NO: 9089 - protein, 6 aa, synthetic construct
  REGION 1..6: note = Synthetic Construct
AKTSTK

SEQ ID NO: 9090 - protein, 6 aa, synthetic construct
  REGION 1..6: note = Synthetic Construct
AKTSYK

SEQ ID NO: 9091 - protein, 6 aa, synthetic construct
  REGION 1..6: note = Synthetic Construct
AKTTAK

SEQ ID NO: 9092 - protein, 6 aa, synthetic construct
  REGION 1..6: note = Synthetic Construct
AKTTDK

SEQ ID NO: 9093 - protein, 6 aa, synthetic construct
  REGION 1..6: note = Synthetic Construct
AKTTEK

SEQ ID NO: 9094 - protein, 6 aa, synthetic construct
  REGION 1..6: note = Synthetic Construct
AKTTFK

SEQ ID NO: 9095 - protein, 6 aa, synthetic construct
  REGION 1..6: note = Synthetic Construct
AKTTGK

SEQ ID NO: 9096 - protein, 6 aa, synthetic construct
  REGION 1..6: note = Synthetic Construct
AKTTHK

SEQ ID NO: 9097 - protein, 6 aa, synthetic construct
  REGION 1..6: note = Synthetic Construct
AKTTIK

SEQ ID NO: 9098 - protein, 6 aa, synthetic construct
  REGION 1..6: note = Synthetic Construct
AKTTLK

SEQ ID NO: 9099 - protein, 6 aa, synthetic construct
  REGION 1..6: note = Synthetic Construct
AKTTNK

SEQ ID NO: 9100 - protein, 6 aa, synthetic construct
  REGION 1..6: note = Synthetic Construct
AKTTQK

SEQ ID NO: 9101 - protein, 6 aa, synthetic construct
  REGION 1..6: note = Synthetic Construct
AKTTRK

SEQ ID NO: 9102 - protein, 6 aa, synthetic construct
  REGION 1..6: note = Synthetic Construct
AKTTSK

SEQ ID NO: 9103 - protein, 6 aa, synthetic construct
  REGION 1..6: note = Synthetic Construct
AKTTTK

SEQ ID NO: 9104 - protein, 6 aa, synthetic construct
  REGION 1..6: note = Synthetic Construct
AKTTYK

SEQ ID NO: 9105 - protein, 6 aa, synthetic construct
  REGION 1..6: note = Synthetic Construct
AKTYAK

SEQ ID NO: 9106 - protein, 6 aa, synthetic construct
  REGION 1..6: note = Synthetic Construct
AKTYDK

SEQ ID NO: 9107 - protein, 6 aa, synthetic construct
  REGION 1..6: note = Synthetic Construct
AKTYEK

SEQ ID NO: 9108 - protein, 6 aa, synthetic construct
  REGION 1..6: note = Synthetic Construct
AKTYFK

SEQ ID NO: 9109 - protein, 6 aa, synthetic construct
  REGION 1..6: note = Synthetic Construct
AKTYGK

SEQ ID NO: 9110 - protein, 6 aa, synthetic construct
  REGION 1..6: note = Synthetic Construct
AKTYHK

SEQ ID NO: 9111 - protein, 6 aa, synthetic construct
  REGION 1..6: note = Synthetic Construct
AKTYIK

SEQ ID NO: 9112 - protein, 6 aa, synthetic construct
  REGION 1..6: note = Synthetic Construct
AKTYLK

SEQ ID NO: 9113 - protein, 6 aa, synthetic construct
  REGION 1..6: note = Synthetic Construct
AKTYNK

SEQ ID NO: 9114 - protein, 6 aa, synthetic construct
  REGION 1..6: note = Synthetic Construct
AKTYQK

SEQ ID NO: 9115 - protein, 6 aa, synthetic construct
  REGION 1..6: note = Synthetic Construct
AKTYRK

SEQ ID NO: 9116 - protein, 6 aa, synthetic construct
  REGION 1..6: note = Synthetic Construct
AKTYSK

SEQ ID NO: 9117 - protein, 6 aa, synthetic construct
  REGION 1..6: note = Synthetic Construct
AKTYTK

SEQ ID NO: 9118 - protein, 6 aa, synthetic construct
  REGION 1..6: note = Synthetic Construct
AKTYYK

SEQ ID NO: 9119 - protein, 6 aa, synthetic construct
  REGION 1..6: note = Synthetic Construct
AKYAAK

SEQ ID NO: 9120 - protein, 6 aa, synthetic construct
  REGION 1..6: note = Synthetic Construct
AKYADK

SEQ ID NO: 9121 - protein, 6 aa, synthetic construct
  REGION 1..6: note = Synthetic Construct
AKYAEK

SEQ ID NO: 9122 - protein, 6 aa, synthetic construct
  REGION 1..6: note = Synthetic Construct
AKYAFK

SEQ ID NO: 9123 - protein, 6 aa, synthetic construct
  REGION 1..6: note = Synthetic Construct
AKYAGK

SEQ ID NO: 9124 - protein, 6 aa, synthetic construct
  REGION 1..6: note = Synthetic Construct
AKYAHK

SEQ ID NO: 9125 - protein, 6 aa, synthetic construct
  REGION 1..6: note = Synthetic Construct
AKYAIK

SEQ ID NO: 9126 - protein, 6 aa, synthetic construct
  REGION 1..6: note = Synthetic Construct
AKYALK

SEQ ID NO: 9127 - protein, 6 aa, synthetic construct
  REGION 1..6: note = Synthetic Construct
AKYANK

SEQ ID NO: 9128 - protein, 6 aa, synthetic construct
  REGION 1..6: note = Synthetic Construct
AKYAQK

SEQ ID NO: 9129 - protein, 6 aa, synthetic construct
  REGION 1..6: note = Synthetic Construct
AKYARK

SEQ ID NO: 9130 - protein, 6 aa, synthetic construct
  REGION 1..6: note = Synthetic Construct
AKYASK

SEQ ID NO: 9131 - protein, 6 aa, synthetic construct
  REGION 1..6: note = Synthetic Construct
AKYATK

SEQ ID NO: 9132 - protein, 6 aa, synthetic construct
  REGION 1..6: note = Synthetic Construct
AKYAYK

SEQ ID NO: 9133 - protein, 6 aa, synthetic construct
  REGION 1..6: note = Synthetic Construct
AKYDAK

SEQ ID NO: 9134 - protein, 6 aa, synthetic construct
  REGION 1..6: note = Synthetic Construct
AKYDDK

SEQ ID NO: 9135 - protein, 6 aa, synthetic construct
  REGION 1..6: note = Synthetic Construct
AKYDEK

SEQ ID NO: 9136 - protein, 6 aa, synthetic construct
  REGION 1..6: note = Synthetic Construct
AKYDFK

SEQ ID NO: 9137 - protein, 6 aa, synthetic construct
  REGION 1..6: note = Synthetic Construct
AKYDGK

SEQ ID NO: 9138 - protein, 6 aa, synthetic construct
  REGION 1..6: note = Synthetic Construct
AKYDHK

SEQ ID NO: 9139 - protein, 6 aa, synthetic construct
  REGION 1..6: note = Synthetic Construct
AKYDIK

SEQ ID NO: 9140 - protein, 6 aa, synthetic construct
  REGION 1..6: note = Synthetic Construct
AKYDLK

SEQ ID NO: 9141 - protein, 6 aa, synthetic construct
  REGION 1..6: note = Synthetic Construct
AKYDNK

SEQ ID NO: 9142 - protein, 6 aa, synthetic construct
  REGION 1..6: note = Synthetic Construct
AKYDQK

SEQ ID NO: 9143 - protein, 6 aa, synthetic construct
  REGION 1..6: note = Synthetic Construct
AKYDRK

SEQ ID NO: 9144 - protein, 6 aa, synthetic construct
  REGION 1..6: note = Synthetic Construct
AKYDSK

SEQ ID NO: 9145 - protein, 6 aa, synthetic construct
  REGION 1..6: note = Synthetic Construct
AKYDTK

SEQ ID NO: 9146 - protein, 6 aa, synthetic construct
  REGION 1..6: note = Synthetic Construct
AKYDYK

SEQ ID NO: 9147 - protein, 6 aa, synthetic construct
  REGION 1..6: note = Synthetic Construct
AKYEAK

SEQ ID NO: 9148 - protein, 6 aa, synthetic construct
  REGION 1..6: note = Synthetic Construct
AKYEDK

SEQ ID NO: 9149 - protein, 6 aa, synthetic construct
  REGION 1..6: note = Synthetic Construct
AKYEEK

SEQ ID NO: 9150 - protein, 6 aa, synthetic construct
  REGION 1..6: note = Synthetic Construct
AKYEFK

SEQ ID NO: 9151 - protein, 6 aa, synthetic construct
  REGION 1..6: note = Synthetic Construct
AKYEGK

SEQ ID NO: 9152 - protein, 6 aa, synthetic construct
  REGION 1..6: note = Synthetic Construct
AKYEHK

SEQ ID NO: 9153 - protein, 6 aa, synthetic construct
  REGION 1..6: note = Synthetic Construct
AKYEIK

SEQ ID NO: 9154 - protein, 6 aa, synthetic construct
  REGION 1..6: note = Synthetic Construct
AKYELK

SEQ ID NO: 9155 - protein, 6 aa, synthetic construct
  REGION 1..6: note = Synthetic Construct
AKYENK

SEQ ID NO: 9156 - protein, 6 aa, synthetic construct
  REGION 1..6: note = Synthetic Construct
AKYEQK

SEQ ID NO: 9157 - protein, 6 aa, synthetic construct
  REGION 1..6: note = Synthetic Construct
AKYERK

SEQ ID NO: 9158 - protein, 6 aa, synthetic construct
  REGION 1..6: note = Synthetic Construct
AKYESK

SEQ ID NO: 9159 - protein, 6 aa, synthetic construct
  REGION 1..6: note = Synthetic Construct
AKYETK

SEQ ID NO: 9160 - protein, 6 aa, synthetic construct
  REGION 1..6: note = Synthetic Construct
AKYEYK

SEQ ID NO: 9161 - protein, 6 aa, synthetic construct
  REGION 1..6: note = Synthetic Construct
AKYFAK

SEQ ID NO: 9162 - protein, 6 aa, synthetic construct
  REGION 1..6: note = Synthetic Construct
AKYFDK

SEQ ID NO: 9163 - protein, 6 aa, synthetic construct
  REGION 1..6: note = Synthetic Construct
AKYFEK

SEQ ID NO: 9164 - protein, 6 aa, synthetic construct
  REGION 1..6: note = Synthetic Construct
AKYFFK

SEQ ID NO: 9165 - protein, 6 aa, synthetic construct
  REGION 1..6: note = Synthetic Construct
AKYFGK

SEQ ID NO: 9166 - protein, 6 aa, synthetic construct
  REGION 1..6: note = Synthetic Construct
AKYFHK

SEQ ID NO: 9167 - protein, 6 aa, synthetic construct
  REGION 1..6: note = Synthetic Construct
AKYFIK

SEQ ID NO: 9168 - protein, 6 aa, synthetic construct
  REGION 1..6: note = Synthetic Construct
AKYFLK

SEQ ID NO: 9169 - protein, 6 aa, synthetic construct
  REGION 1..6: note = Synthetic Construct
AKYFNK

SEQ ID NO: 9170 - protein, 6 aa, synthetic construct
  REGION 1..6: note = Synthetic Construct
AKYFQK

SEQ ID NO: 9171 - protein, 6 aa, synthetic construct
  REGION 1..6: note = Synthetic Construct
AKYFRK

SEQ ID NO: 9172 - protein, 6 aa, synthetic construct
  REGION 1..6: note = Synthetic Construct
AKYFSK

SEQ ID NO: 9173 - protein, 6 aa, synthetic construct
  REGION 1..6: note = Synthetic Construct
AKYFTK

SEQ ID NO: 9174 - protein, 6 aa, synthetic construct
  REGION 1..6: note = Synthetic Construct
AKYFYK

SEQ ID NO: 9175 - protein, 6 aa, synthetic construct
  REGION 1..6: note = Synthetic Construct
AKYGAK

SEQ ID NO: 9176 - protein, 6 aa, synthetic construct
  REGION 1..6: note = Synthetic Construct
AKYGDK

SEQ ID NO: 9177 - protein, 6 aa, synthetic construct
  REGION 1..6: note = Synthetic Construct
AKYGEK

SEQ ID NO: 9178 - protein, 6 aa, synthetic construct
  REGION 1..6: note = Synthetic Construct
AKYGFK

SEQ ID NO: 9179 - protein, 6 aa, synthetic construct
  REGION 1..6: note = Synthetic Construct
AKYGGK

SEQ ID NO: 9180 - protein, 6 aa, synthetic construct
  REGION 1..6: note = Synthetic Construct
AKYGHK

SEQ ID NO: 9181 - protein, 6 aa, synthetic construct
  REGION 1..6: note = Synthetic Construct
AKYGIK

SEQ ID NO: 9182 - protein, 6 aa, synthetic construct
  REGION 1..6: note = Synthetic Construct
AKYGLK

SEQ ID NO: 9183 - protein, 6 aa, synthetic construct
  REGION 1..6: note = Synthetic Construct
AKYGNK

SEQ ID NO: 9184 - protein, 6 aa, synthetic construct
  REGION 1..6: note = Synthetic Construct
AKYGQK

SEQ ID NO: 9185 - protein, 6 aa, synthetic construct
  REGION 1..6: note = Synthetic Construct
AKYGRK

SEQ ID NO: 9186 - protein, 6 aa, synthetic construct
  REGION 1..6: note = Synthetic Construct
AKYGSK

SEQ ID NO: 9187 - protein, 6 aa, synthetic construct
  REGION 1..6: note = Synthetic Construct
AKYGTK

SEQ ID NO: 9188 - protein, 6 aa, synthetic construct
  REGION 1..6: note = Synthetic Construct
AKYGYK

SEQ ID NO: 9189 - protein, 6 aa, synthetic construct
  REGION 1..6: note = Synthetic Construct
AKYHAK

SEQ ID NO: 9190 - protein, 6 aa, synthetic construct
  REGION 1..6: note = Synthetic Construct
AKYHDK

SEQ ID NO: 9191 - protein, 6 aa, synthetic construct
  REGION 1..6: note = Synthetic Construct
AKYHEK

SEQ ID NO: 9192 - protein, 6 aa, synthetic construct
  REGION 1..6: note = Synthetic Construct
AKYHFK

SEQ ID NO: 9193 - protein, 6 aa, synthetic construct
  REGION 1..6: note = Synthetic Construct
AKYHGK

SEQ ID NO: 9194 - protein, 6 aa, synthetic construct
  REGION 1..6: note = Synthetic Construct
AKYHHK

SEQ ID NO: 9195 - protein, 6 aa, synthetic construct
  REGION 1..6: note = Synthetic Construct
AKYHIK

SEQ ID NO: 9196 - protein, 6 aa, synthetic construct
  REGION 1..6: note = Synthetic Construct
AKYHLK

SEQ ID NO: 9197 - protein, 6 aa, synthetic construct
  REGION 1..6: note = Synthetic Construct
AKYHNK

SEQ ID NO: 9198 - protein, 6 aa, synthetic construct
  REGION 1..6: note = Synthetic Construct
AKYHQK

SEQ ID NO: 9199 - protein, 6 aa, synthetic construct
  REGION 1..6: note = Synthetic Construct
AKYHRK

SEQ ID NO: 9200 - protein, 6 aa, synthetic construct
  REGION 1..6: note = Synthetic Construct
AKYHSK

SEQ ID NO: 9201 - protein, 6 aa, synthetic construct
  REGION 1..6: note = Synthetic Construct
AKYHTK

SEQ ID NO: 9202 - protein, 6 aa, synthetic construct
  REGION 1..6: note = Synthetic Construct
AKYHYK

SEQ ID NO: 9203 - protein, 6 aa, synthetic construct
  REGION 1..6: note = Synthetic Construct
AKYIAK

SEQ ID NO: 9204 - protein, 6 aa, synthetic construct
  REGION 1..6: note = Synthetic Construct
AKYIDK

SEQ ID NO: 9205 - protein, 6 aa, synthetic construct
  REGION 1..6: note = Synthetic Construct
AKYIEK

SEQ ID NO: 9206 - protein, 6 aa, synthetic construct
  REGION 1..6: note = Synthetic Construct
AKYIFK

SEQ ID NO: 9207 - protein, 6 aa, synthetic construct
  REGION 1..6: note = Synthetic Construct
AKYIGK

SEQ ID NO: 9208 - protein, 6 aa, synthetic construct
  REGION 1..6: note = Synthetic Construct
AKYIHK

SEQ ID NO: 9209 - protein, 6 aa, synthetic construct
  REGION 1..6: note = Synthetic Construct
AKYIIK

SEQ ID NO: 9210 - protein, 6 aa, synthetic construct
  REGION 1..6: note = Synthetic Construct
AKYILK

SEQ ID NO: 9211 - protein, 6 aa, synthetic construct
  REGION 1..6: note = Synthetic Construct
AKYINK

SEQ ID NO: 9212 - protein, 6 aa, synthetic construct
  REGION 1..6: note = Synthetic Construct
AKYIQK

SEQ ID NO: 9213 - protein, 6 aa, synthetic construct
  REGION 1..6: note = Synthetic Construct
AKYIRK

SEQ ID NO: 9214 - protein, 6 aa, synthetic construct
  REGION 1..6: note = Synthetic Construct
AKYISK

SEQ ID NO: 9215 - protein, 6 aa, synthetic construct
  REGION 1..6: note = Synthetic Construct
AKYITK

SEQ ID NO: 9216 - protein, 6 aa, synthetic construct
  REGION 1..6: note = Synthetic Construct
AKYIYK

SEQ ID NO: 9217 - protein, 6 aa, synthetic construct
  REGION 1..6: note = Synthetic Construct
AKYLAK

SEQ ID NO: 9218 - protein, 6 aa, synthetic construct
  REGION 1..6: note = Synthetic Construct
AKYLDK

SEQ ID NO: 9219 - protein, 6 aa, synthetic construct
  REGION 1..6: note = Synthetic Construct
AKYLEK

SEQ ID NO: 9220 - protein, 6 aa, synthetic construct
  REGION 1..6: note = Synthetic Construct
AKYLFK

SEQ ID NO: 9221 - protein, 6 aa, synthetic construct
  REGION 1..6: note = Synthetic Construct
AKYLGK

SEQ ID NO: 9222 - protein, 6 aa, synthetic construct
  REGION 1..6: note = Synthetic Construct
AKYLHK

SEQ ID NO: 9223 - protein, 6 aa, synthetic construct
  REGION 1..6: note = Synthetic Construct
AKYLIK

SEQ ID NO: 9224 - protein, 6 aa, synthetic construct
  REGION 1..6: note = Synthetic Construct
AKYLLK

SEQ ID NO: 9225 - protein, 6 aa, synthetic construct
  REGION 1..6: note = Synthetic Construct
AKYLNK

SEQ ID NO: 9226 - protein, 6 aa, synthetic construct
  REGION 1..6: note = Synthetic Construct
AKYLQK

SEQ ID NO: 9227 - protein, 6 aa, synthetic construct
  REGION 1..6: note = Synthetic Construct
AKYLRK

SEQ ID NO: 9228 - protein, 6 aa, synthetic construct
  REGION 1..6: note = Synthetic Construct
AKYLSK

SEQ ID NO: 9229 - protein, 6 aa, synthetic construct
  REGION 1..6: note = Synthetic Construct
AKYLTK

SEQ ID NO: 9230 - protein, 6 aa, synthetic construct
  REGION 1..6: note = Synthetic Construct
AKYLYK

SEQ ID NO: 9231 - protein, 6 aa, synthetic construct
  REGION 1..6: note = Synthetic Construct
AKYNAK

SEQ ID NO: 9232 - protein, 6 aa, synthetic construct
  REGION 1..6: note = Synthetic Construct
AKYNDK

SEQ ID NO: 9233 - protein, 6 aa, synthetic construct
  REGION 1..6: note = Synthetic Construct
AKYNEK

SEQ ID NO: 9234 - protein, 6 aa, synthetic construct
  REGION 1..6: note = Synthetic Construct
AKYNFK

SEQ ID NO: 9235 - protein, 6 aa, synthetic construct
  REGION 1..6: note = Synthetic Construct
AKYNGK

SEQ ID NO: 9236 - protein, 6 aa, synthetic construct
  REGION 1..6: note = Synthetic Construct
AKYNHK

SEQ ID NO: 9237 - protein, 6 aa, synthetic construct
  REGION 1..6: note = Synthetic Construct
AKYNIK

SEQ ID NO: 9238 - protein, 6 aa, synthetic construct
  REGION 1..6: note = Synthetic Construct
AKYNLK

SEQ ID NO: 9239 - protein, 6 aa, synthetic construct
  REGION 1..6: note = Synthetic Construct
AKYNNK

SEQ ID NO: 9240 - protein, 6 aa, synthetic construct
  REGION 1..6: note = Synthetic Construct
AKYNQK

SEQ ID NO: 9241 - protein, 6 aa, synthetic construct
  REGION 1..6: note = Synthetic Construct
AKYNRK

SEQ ID NO: 9242 - protein, 6 aa, synthetic construct
  REGION 1..6: note = Synthetic Construct
AKYNSK

SEQ ID NO: 9243 - protein, 6 aa, synthetic construct
  REGION 1..6: note = Synthetic Construct
AKYNTK

SEQ ID NO: 9244 - protein, 6 aa, synthetic construct
  REGION 1..6: note = Synthetic Construct
AKYNYK

SEQ ID NO: 9245 - protein, 6 aa, synthetic construct
  REGION 1..6: note = Synthetic Construct
AKYQAK

SEQ ID NO: 9246 - protein, 6 aa, synthetic construct
  REGION 1..6: note = Synthetic Construct
AKYQDK

SEQ ID NO: 9247 - protein, 6 aa, synthetic construct
  REGION 1..6: note = Synthetic Construct
AKYQEK

SEQ ID NO: 9248 - protein, 6 aa, synthetic construct
  REGION 1..6: note = Synthetic Construct
AKYQFK

SEQ ID NO: 9249 - protein, 6 aa, synthetic construct
  REGION 1..6: note = Synthetic Construct
AKYQGK

SEQ ID NO: 9250 - protein, 6 aa, synthetic construct
  REGION 1..6: note = Synthetic Construct
AKYQHK

SEQ ID NO: 9251 - protein, 6 aa, synthetic construct
  REGION 1..6: note = Synthetic Construct
AKYQIK

SEQ ID NO: 9252 - protein, 6 aa, synthetic construct
  REGION 1..6: note = Synthetic Construct
AKYQLK

SEQ ID NO: 9253 - protein, 6 aa, synthetic construct
  REGION 1..6: note = Synthetic Construct
AKYQNK

SEQ ID NO: 9254 - protein, 6 aa, synthetic construct
  REGION 1..6: note = Synthetic Construct
AKYQQK

SEQ ID NO: 9255 - protein, 6 aa, synthetic construct
  REGION 1..6: note = Synthetic Construct
AKYQRK

SEQ ID NO: 9256 - protein, 6 aa, synthetic construct
  REGION 1..6: note = Synthetic Construct
AKYQSK

SEQ ID NO: 9257 - protein, 6 aa, synthetic construct
  REGION 1..6: note = Synthetic Construct
AKYQTK

SEQ ID NO: 9258 - protein, 6 aa, synthetic construct
  REGION 1..6: note = Synthetic Construct
AKYQYK

SEQ ID NO: 9259 - protein, 6 aa, synthetic construct
  REGION 1..6: note = Synthetic Construct
AKYRAK

SEQ ID NO: 9260 - protein, 6 aa, synthetic construct
  REGION 1..6: note = Synthetic Construct
AKYRDK

SEQ ID NO: 9261 - protein, 6 aa, synthetic construct
  REGION 1..6: note = Synthetic Construct
AKYREK

SEQ ID NO: 9262 - protein, 6 aa, synthetic construct
  REGION 1..6: note = Synthetic Construct
AKYRFK

SEQ ID NO: 9263 - protein, 6 aa, synthetic construct
  REGION 1..6: note = Synthetic Construct
AKYRGK

SEQ ID NO: 9264 - protein, 6 aa, synthetic construct
  REGION 1..6: note = Synthetic Construct
AKYRHK

SEQ ID NO: 9265 - protein, 6 aa, synthetic construct
  REGION 1..6: note = Synthetic Construct
AKYRIK

SEQ ID NO: 9266 - protein, 6 aa, synthetic construct
  REGION 1..6: note = Synthetic Construct
AKYRLK

SEQ ID NO: 9267 - protein, 6 aa, synthetic construct
  REGION 1..6: note = Synthetic Construct
AKYRNK

SEQ ID NO: 9268 - protein, 6 aa, synthetic construct
  REGION 1..6: note = Synthetic Construct
AKYRQK

SEQ ID NO: 9269 - protein, 6 aa, synthetic construct
  REGION 1..6: note = Synthetic Construct
AKYRRK

SEQ ID NO: 9270 - protein, 6 aa, synthetic construct
  REGION 1..6: note = Synthetic Construct
AKYRSK

SEQ ID NO: 9271 - protein, 6 aa, synthetic construct
  REGION 1..6: note = Synthetic Construct
AKYRTK

SEQ ID NO: 9272 - protein, 6 aa, synthetic construct
  REGION 1..6: note = Synthetic Construct
AKYRYK

SEQ ID NO: 9273 - protein, 6 aa, synthetic construct
  REGION 1..6: note = Synthetic Construct
AKYSAK

SEQ ID NO: 9274 - protein, 6 aa, synthetic construct
  REGION 1..6: note = Synthetic Construct
AKYSDK

SEQ ID NO: 9275 - protein, 6 aa, synthetic construct
  REGION 1..6: note = Synthetic Construct
AKYSEK

SEQ ID NO: 9276 - protein, 6 aa, synthetic construct
  REGION 1..6: note = Synthetic Construct
AKYSFK

SEQ ID NO: 9277 - protein, 6 aa, synthetic construct
  REGION 1..6: note = Synthetic Construct
AKYSGK

SEQ ID NO: 9278 - protein, 6 aa, synthetic construct
  REGION 1..6: note = Synthetic Construct
AKYSHK

SEQ ID NO: 9279 - protein, 6 aa, synthetic construct
  REGION 1..6: note = Synthetic Construct
AKYSIK

SEQ ID NO: 9280 - protein, 6 aa, synthetic construct
  REGION 1..6: note = Synthetic Construct
AKYSLK

SEQ ID NO: 9281 - protein, 6 aa, synthetic construct
  REGION 1..6: note = Synthetic Construct
AKYSNK

SEQ ID NO: 9282 - protein, 6 aa, synthetic construct
  REGION 1..6: note = Synthetic Construct
AKYSQK

SEQ ID NO: 9283 - protein, 6 aa, synthetic construct
  REGION 1..6: note = Synthetic Construct
AKYSRK

SEQ ID NO: 9284 - protein, 6 aa, synthetic construct
  REGION 1..6: note = Synthetic Construct
AKYSSK

SEQ ID NO: 9285 - protein, 6 aa, synthetic construct
  REGION 1..6: note = Synthetic Construct
AKYSTK

SEQ ID NO: 9286 - protein, 6 aa, synthetic construct
  REGION 1..6: note = Synthetic Construct
AKYSYK

SEQ ID NO: 9287 - protein, 6 aa, synthetic construct
  REGION 1..6: note = Synthetic Construct
AKYTAK

SEQ ID NO: 9288 - protein, 6 aa, synthetic construct
  REGION 1..6: note = Synthetic Construct
AKYTDK

SEQ ID NO: 9289 - protein, 6 aa, synthetic construct
  REGION 1..6: note = Synthetic Construct
AKYTEK

SEQ ID NO: 9290 - protein, 6 aa, synthetic construct
  REGION 1..6: note = Synthetic Construct
AKYTFK

SEQ ID NO: 9291 - protein, 6 aa, synthetic construct
  REGION 1..6: note = Synthetic Construct
AKYTGK

SEQ ID NO: 9292 - protein, 6 aa, synthetic construct
  REGION 1..6: note = Synthetic Construct
AKYTHK

SEQ ID NO: 9293 - protein, 6 aa, synthetic construct
  REGION 1..6: note = Synthetic Construct
AKYTIK

SEQ ID NO: 9294 - protein, 6 aa, synthetic construct
  REGION 1..6: note = Synthetic Construct
AKYTLK

SEQ ID NO: 9295 - protein, 6 aa, synthetic construct
  REGION 1..6: note = Synthetic Construct
AKYTNK

SEQ ID NO: 9296 - protein, 6 aa, synthetic construct
  REGION 1..6: note = Synthetic Construct
AKYTQK

SEQ ID NO: 9297 - protein, 6 aa, synthetic construct
  REGION 1..6: note = Synthetic Construct
AKYTRK

SEQ ID NO: 9298 - protein, 6 aa, synthetic construct
  REGION 1..6: note = Synthetic Construct
AKYTSK

SEQ ID NO: 9299 - protein, 6 aa, synthetic construct
  REGION 1..6: note = Synthetic Construct
AKYTTK

SEQ ID NO: 9300 - protein, 6 aa, synthetic construct
  REGION 1..6: note = Synthetic Construct
AKYTYK

SEQ ID NO: 9301 - protein, 6 aa, synthetic construct
  REGION 1..6: note = Synthetic Construct
AKYYAK

SEQ ID NO: 9302 - protein, 6 aa, synthetic construct
  REGION 1..6: note = Synthetic Construct
AKYYDK

SEQ ID NO: 9303 - protein, 6 aa, synthetic construct
  REGION 1..6: note = Synthetic Construct
AKYYEK

SEQ ID NO: 9304 - protein, 6 aa, synthetic construct
  REGION 1..6: note = Synthetic Construct
AKYYFK

SEQ ID NO: 9305 - protein, 6 aa, synthetic construct
  REGION 1..6: note = Synthetic Construct
AKYYGK

SEQ ID NO: 9306 - protein, 6 aa, synthetic construct
  REGION 1..6: note = Synthetic Construct
AKYYHK

SEQ ID NO: 9307 - protein, 6 aa, synthetic construct
  REGION 1..6: note = Synthetic Construct
AKYYIK

SEQ ID NO: 9308 - protein, 6 aa, synthetic construct
  REGION 1..6: note = Synthetic Construct
AKYYLK

SEQ ID NO: 9309 - protein, 6 aa, synthetic construct
  REGION 1..6: note = Synthetic Construct
AKYYNK

SEQ ID NO: 9310 - protein, 6 aa, synthetic construct
  REGION 1..6: note = Synthetic Construct
AKYYQK

SEQ ID NO: 9311 - protein, 6 aa, synthetic construct
  REGION 1..6: note = Synthetic Construct
AKYYRK

SEQ ID NO: 9312 - protein, 6 aa, synthetic construct
  REGION 1..6: note = Synthetic Construct
AKYYSK

SEQ ID NO: 9313 - protein, 6 aa, synthetic construct
  REGION 1..6: note = Synthetic Construct
AKYYTK

SEQ ID NO: 9314 - protein, 6 aa, synthetic construct
  REGION 1..6: note = Synthetic Construct
AKYYYK

SEQ ID NO: 9315 - protein, 6 aa, synthetic construct
  REGION 1..6: note = Synthetic Construct
EKAAAK

SEQ ID NO: 9316 - protein, 6 aa, synthetic construct
  REGION 1..6: note = Synthetic Construct
EKAADK

SEQ ID NO: 9317 - protein, 6 aa, synthetic construct
  REGION 1..6: note = Synthetic Construct
EKAAEK

SEQ ID NO: 9318 - protein, 6 aa, synthetic construct
  REGION 1..6: note = Synthetic Construct
EKAAFK

SEQ ID NO: 9319 - protein, 6 aa, synthetic construct
  REGION 1..6: note = Synthetic Construct
EKAAGK

SEQ ID NO: 9320 - protein, 6 aa, synthetic construct
  REGION 1..6: note = Synthetic Construct
EKAAHK

SEQ ID NO: 9321 - protein, 6 aa, synthetic construct
  REGION 1..6: note = Synthetic Construct
EKAAIK

SEQ ID NO: 9322 - protein, 6 aa, synthetic construct
  REGION 1..6: note = Synthetic Construct
EKAALK

SEQ ID NO: 9323 - protein, 6 aa, synthetic construct
  REGION 1..6: note = Synthetic Construct
EKAANK

SEQ ID NO: 9324 - protein, 6 aa, synthetic construct
  REGION 1..6: note = Synthetic Construct
EKAAQK

SEQ ID NO: 9325 - protein, 6 aa, synthetic construct
  REGION 1..6: note = Synthetic Construct
EKAARK

SEQ ID NO: 9326 - protein, 6 aa, synthetic construct
  REGION 1..6: note = Synthetic Construct
EKAASK

SEQ ID NO: 9327 - protein, 6 aa, synthetic construct
  REGION 1..6: note = Synthetic Construct
EKAATK

SEQ ID NO: 9328 - protein, 6 aa, synthetic construct
  REGION 1..6: note = Synthetic Construct
EKAAYK

SEQ ID NO: 9329 - protein, 6 aa, synthetic construct
  REGION 1..6: note = Synthetic Construct
EKADAK

SEQ ID NO: 9330 - protein, 6 aa, synthetic construct
  REGION 1..6: note = Synthetic Construct
EKADDK

SEQ ID NO: 9331 - protein, 6 aa, synthetic construct
  REGION 1..6: note = Synthetic Construct
EKADEK

SEQ ID NO: 9332 - protein, 6 aa, synthetic construct
  REGION 1..6: note = Synthetic Construct
EKADFK

SEQ ID NO: 9333 - protein, 6 aa, synthetic construct
  REGION 1..6: note = Synthetic Construct
EKADGK

SEQ ID NO: 9334 - protein, 6 aa, synthetic construct
  REGION 1..6: note = Synthetic Construct
EKADHK

SEQ ID NO: 9335 - protein, 6 aa, synthetic construct
  REGION 1..6: note = Synthetic Construct
EKADIK

SEQ ID NO: 9336 - protein, 6 aa, synthetic construct
  REGION 1..6: note = Synthetic Construct
EKADLK

SEQ ID NO: 9337 - protein, 6 aa, synthetic construct
  REGION 1..6: note = Synthetic Construct
EKADNK

SEQ ID NO: 9338 - protein, 6 aa, synthetic construct
  REGION 1..6: note = Synthetic Construct
EKADQK

SEQ ID NO: 9339 - protein, 6 aa, synthetic construct
  REGION 1..6: note = Synthetic Construct
EKADRK

SEQ ID NO: 9340 - protein, 6 aa, synthetic construct
  REGION 1..6: note = Synthetic Construct
EKADSK

SEQ ID NO: 9341 - protein, 6 aa, synthetic construct
  REGION 1..6: note = Synthetic Construct
EKADTK

SEQ ID NO: 9342 - protein, 6 aa, synthetic construct
  REGION 1..6: note = Synthetic Construct
EKADYK

SEQ ID NO: 9343 - protein, 6 aa, synthetic construct
  REGION 1..6: note = Synthetic Construct
EKAEAK

SEQ ID NO: 9344 - protein, 6 aa, synthetic construct
  REGION 1..6: note = Synthetic Construct
EKAEDK

SEQ ID NO: 9345 - protein, 6 aa, synthetic construct
  REGION 1..6: note = Synthetic Construct
EKAEEK

SEQ ID NO: 9346 - protein, 6 aa, synthetic construct
  REGION 1..6: note = Synthetic Construct
EKAEFK

SEQ ID NO: 9347 - protein, 6 aa, synthetic construct
  REGION 1..6: note = Synthetic Construct
EKAEGK

SEQ ID NO: 9348 - protein, 6 aa, synthetic construct
  REGION 1..6: note = Synthetic Construct
EKAEHK

SEQ ID NO: 9349 - protein, 6 aa, synthetic construct
  REGION 1..6: note = Synthetic Construct
EKAEIK

SEQ ID NO: 9350 - protein, 6 aa, synthetic construct
  REGION 1..6: note = Synthetic Construct
EKAELK

SEQ ID NO: 9351 - protein, 6 aa, synthetic construct
  REGION 1..6: note = Synthetic Construct
EKAENK

SEQ ID NO: 9352 - protein, 6 aa, synthetic construct
  REGION 1..6: note = Synthetic Construct
EKAEQK

SEQ ID NO: 9353 - protein, 6 aa, synthetic construct
  REGION 1..6: note = Synthetic Construct
EKAERK

SEQ ID NO: 9354 - protein, 6 aa, synthetic construct
  REGION 1..6: note = Synthetic Construct
EKAESK

SEQ ID NO: 9355 - protein, 6 aa, synthetic construct
  REGION 1..6: note = Synthetic Construct
EKAETK

SEQ ID NO: 9356 - protein, 6 aa, synthetic construct
  REGION 1..6: note = Synthetic Construct
EKAEYK

SEQ ID NO: 9357 - protein, 6 aa, synthetic construct
  REGION 1..6: note = Synthetic Construct
EKAFAK

SEQ ID NO: 9358 - protein, 6 aa, synthetic construct
  REGION 1..6: note = Synthetic Construct
EKAFDK

SEQ ID NO: 9359 - protein, 6 aa, synthetic construct
  REGION 1..6: note = Synthetic Construct
EKAFEK

SEQ ID NO: 9360 - protein, 6 aa, synthetic construct
  REGION 1..6: note = Synthetic Construct
EKAFFK

SEQ ID NO: 9361 - protein, 6 aa, synthetic construct
  REGION 1..6: note = Synthetic Construct
EKAFGK

SEQ ID NO: 9362 - protein, 6 aa, synthetic construct
  REGION 1..6: note = Synthetic Construct
EKAFHK

SEQ ID NO: 9363 - protein, 6 aa, synthetic construct
  REGION 1..6: note = Synthetic Construct
EKAFIK

SEQ ID NO: 9364 - protein, 6 aa, synthetic construct
  REGION 1..6: note = Synthetic Construct
EKAFLK

SEQ ID NO: 9365 - protein, 6 aa, synthetic construct
  REGION 1..6: note = Synthetic Construct
EKAFNK

SEQ ID NO: 9366 - protein, 6 aa, synthetic construct
  REGION 1..6: note = Synthetic Construct
EKAFQK

SEQ ID NO: 9367 - protein, 6 aa, synthetic construct
  REGION 1..6: note = Synthetic Construct
EKAFRK

SEQ ID NO: 9368 - protein, 6 aa, synthetic construct
  REGION 1..6: note = Synthetic Construct
EKAFSK

SEQ ID NO: 9369 - protein, 6 aa, synthetic construct
  REGION 1..6: note = Synthetic Construct
EKAFTK

SEQ ID NO: 9370 - protein, 6 aa, synthetic construct
  REGION 1..6: note = Synthetic Construct
EKAFYK

SEQ ID NO: 9371 - protein, 6 aa, synthetic construct
  REGION 1..6: note = Synthetic Construct
EKAGAK

SEQ ID NO: 9372 - protein, 6 aa, synthetic construct
  REGION 1..6: note = Synthetic Construct
EKAGDK

SEQ ID NO: 9373 - protein, 6 aa, synthetic construct
  REGION 1..6: note = Synthetic Construct
EKAGEK

SEQ ID NO: 9374 - protein, 6 aa, synthetic construct
  REGION 1..6: note = Synthetic Construct
EKAGFK

SEQ ID NO: 9375 - protein, 6 aa, synthetic construct
  REGION 1..6: note = Synthetic Construct
EKAGGK

SEQ ID NO: 9376 - protein, 6 aa, synthetic construct
  REGION 1..6: note = Synthetic Construct
EKAGHK

SEQ ID NO: 9377 - protein, 6 aa, synthetic construct
  REGION 1..6: note = Synthetic Construct
EKAGIK

SEQ ID NO: 9378 - protein, 6 aa, synthetic construct
  REGION 1..6: note = Synthetic Construct
EKAGLK

SEQ ID NO: 9379 - protein, 6 aa, synthetic construct
  REGION 1..6: note = Synthetic Construct
EKAGNK

SEQ ID NO: 9380 - protein, 6 aa, synthetic construct
  REGION 1..6: note = Synthetic Construct
EKAGQK

SEQ ID NO: 9381 - protein, 6 aa, synthetic construct
  REGION 1..6: note = Synthetic Construct
EKAGRK

SEQ ID NO: 9382 - protein, 6 aa, synthetic construct
  REGION 1..6: note = Synthetic Construct
EKAGSK

SEQ ID NO: 9383 - protein, 6 aa, synthetic construct
  REGION 1..6: note = Synthetic Construct
EKAGTK

SEQ ID NO: 9384 - protein, 6 aa, synthetic construct
  REGION 1..6: note = Synthetic Construct
EKAGYK

SEQ ID NO: 9385 - protein, 6 aa, synthetic construct
  REGION 1..6: note = Synthetic Construct
EKAHAK

SEQ ID NO: 9386 - protein, 6 aa, synthetic construct
  REGION 1..6: note = Synthetic Construct
EKAHDK

SEQ ID NO: 9387 - protein, 6 aa, synthetic construct
  REGION 1..6: note = Synthetic Construct
EKAHEK

SEQ ID NO: 9388 - protein, 6 aa, synthetic construct
  REGION 1..6: note = Synthetic Construct
EKAHFK

SEQ ID NO: 9389 - protein, 6 aa, synthetic construct
  REGION 1..6: note = Synthetic Construct
EKAHGK

SEQ ID NO: 9390 - protein, 6 aa, synthetic construct
  REGION 1..6: note = Synthetic Construct
EKAHHK

SEQ ID NO: 9391 - protein, 6 aa, synthetic construct
  REGION 1..6: note = Synthetic Construct
EKAHIK

SEQ ID NO: 9392 - protein, 6 aa, synthetic construct
  REGION 1..6: note = Synthetic Construct
EKAHLK

SEQ ID NO: 9393 - protein, 6 aa, synthetic construct
  REGION 1..6: note = Synthetic Construct
EKAHNK

SEQ ID NO: 9394 - protein, 6 aa, synthetic construct
  REGION 1..6: note = Synthetic Construct
EKAHQK

SEQ ID NO: 9395 - protein, 6 aa, synthetic construct
  REGION 1..6: note = Synthetic Construct
EKAHRK

SEQ ID NO: 9396 - protein, 6 aa, synthetic construct
  REGION 1..6: note = Synthetic Construct
EKAHSK

SEQ ID NO: 9397 - protein, 6 aa, synthetic construct
  REGION 1..6: note = Synthetic Construct
EKAHTK

SEQ ID NO: 9398 - protein, 6 aa, synthetic construct
  REGION 1..6: note = Synthetic Construct
EKAHYK

SEQ ID NO: 9399 - protein, 6 aa, synthetic construct
  REGION 1..6: note = Synthetic Construct
EKAIAK

SEQ ID NO: 9400 - protein, 6 aa, synthetic construct
  REGION 1..6: note = Synthetic Construct
EKAIDK

SEQ ID NO: 9401 - protein, 6 aa, synthetic construct
  REGION 1..6: note = Synthetic Construct
EKAIEK

SEQ ID NO: 9402 - protein, 6 aa, synthetic construct
  REGION 1..6: note = Synthetic Construct
EKAIFK

SEQ ID NO: 9403 - protein, 6 aa, synthetic construct
  REGION 1..6: note = Synthetic Construct
EKAIGK

SEQ ID NO: 9404 - protein, 6 aa, synthetic construct
  REGION 1..6: note = Synthetic Construct
EKAIHK

SEQ ID NO: 9405 - protein, 6 aa, synthetic construct
  REGION 1..6: note = Synthetic Construct
EKAIIK

SEQ ID NO: 9406 - protein, 6 aa, synthetic construct
  REGION 1..6: note = Synthetic Construct
EKAILK

SEQ ID NO: 9407 - protein, 6 aa, synthetic construct
  REGION 1..6: note = Synthetic Construct
EKAINK

SEQ ID NO: 9408 - protein, 6 aa, synthetic construct
  REGION 1..6: note = Synthetic Construct
EKAIQK

SEQ ID NO: 9409 - protein, 6 aa, synthetic construct
  REGION 1..6: note = Synthetic Construct
EKAIRK

SEQ ID NO: 9410 - protein, 6 aa, synthetic construct
  REGION 1..6: note = Synthetic Construct
EKAISK

SEQ ID NO: 9411 - protein, 6 aa, synthetic construct
  REGION 1..6: note = Synthetic Construct
EKAITK

SEQ ID NO: 9412 - protein, 6 aa, synthetic construct
  REGION 1..6: note = Synthetic Construct
EKAIYK

SEQ ID NO: 9413 - protein, 6 aa, synthetic construct
  REGION 1..6: note = Synthetic Construct
EKALAK

SEQ ID NO: 9414 - protein, 6 aa, synthetic construct
  REGION 1..6: note = Synthetic Construct
EKALDK

SEQ ID NO: 9415 - protein, 6 aa, synthetic construct
  REGION 1..6: note = Synthetic Construct
EKALEK

SEQ ID NO: 9416 - protein, 6 aa, synthetic construct
  REGION 1..6: note = Synthetic Construct
EKALFK

SEQ ID NO: 9417 - protein, 6 aa, synthetic construct
  REGION 1..6: note = Synthetic Construct
EKALGK

SEQ ID NO: 9418 - protein, 6 aa, synthetic construct
  REGION 1..6: note = Synthetic Construct
EKALHK

SEQ ID NO: 9419 - protein, 6 aa, synthetic construct
  REGION 1..6: note = Synthetic Construct
EKALIK

SEQ ID NO: 9420 - protein, 6 aa, synthetic construct
  REGION 1..6: note = Synthetic Construct
EKALLK

SEQ ID NO: 9421 - protein, 6 aa, synthetic construct
  REGION 1..6: note = Synthetic Construct
EKALNK

SEQ ID NO: 9422 - protein, 6 aa, synthetic construct
  REGION 1..6: note = Synthetic Construct
EKALQK

SEQ ID NO: 9423 - protein, 6 aa, synthetic construct
  REGION 1..6: note = Synthetic Construct
EKALRK

SEQ ID NO: 9424 - protein, 6 aa, synthetic construct
  REGION 1..6: note = Synthetic Construct
EKALSK

SEQ ID NO: 9425 - protein, 6 aa, synthetic construct
  REGION 1..6: note = Synthetic Construct
EKALTK

SEQ ID NO: 9426 - protein, 6 aa, synthetic construct
  REGION 1..6: note = Synthetic Construct
EKALYK

SEQ ID NO: 9427 - protein, 6 aa, synthetic construct
  REGION 1..6: note = Synthetic Construct
EKANAK

SEQ ID NO: 9428 - protein, 6 aa, synthetic construct
  REGION 1..6: note = Synthetic Construct
EKANDK

SEQ ID NO: 9429 - protein, 6 aa, synthetic construct
  REGION 1..6: note = Synthetic Construct
EKANEK

SEQ ID NO: 9430 - protein, 6 aa, synthetic construct
  REGION 1..6: note = Synthetic Construct
EKANFK

SEQ ID NO: 9431 - protein, 6 aa, synthetic construct
  REGION 1..6: note = Synthetic Construct
EKANGK

SEQ ID NO: 9432 - protein, 6 aa, synthetic construct
  REGION 1..6: note = Synthetic Construct
EKANHK

SEQ ID NO: 9433 - protein, 6 aa, synthetic construct
  REGION 1..6: note = Synthetic Construct
EKANIK

SEQ ID NO: 9434 - protein, 6 aa, synthetic construct
  REGION 1..6: note = Synthetic Construct
EKANLK

SEQ ID NO: 9435 - protein, 6 aa, synthetic construct
  REGION 1..6: note = Synthetic Construct
EKANNK

SEQ ID NO: 9436 - protein, 6 aa, synthetic construct
  REGION 1..6: note = Synthetic Construct
EKANQK

SEQ ID NO: 9437 - protein, 6 aa, synthetic construct
  REGION 1..6: note = Synthetic Construct
EKANRK

SEQ ID NO: 9438 - protein, 6 aa, synthetic construct
  REGION 1..6: note = Synthetic Construct
EKANSK

SEQ ID NO: 9439 - protein, 6 aa, synthetic construct
  REGION 1..6: note = Synthetic Construct
EKANTK

SEQ ID NO: 9440 - protein, 6 aa, synthetic construct
  REGION 1..6: note = Synthetic Construct
EKANYK

SEQ ID NO: 9441 - protein, 6 aa, synthetic construct
  REGION 1..6: note = Synthetic Construct
EKAQAK

SEQ ID NO: 9442 - protein, 6 aa, synthetic construct
  REGION 1..6: note = Synthetic Construct
EKAQDK

SEQ ID NO: 9443 - protein, 6 aa, synthetic construct
  REGION 1..6: note = Synthetic Construct
EKAQEK

SEQ ID NO: 9444 - protein, 6 aa, synthetic construct
  REGION 1..6: note = Synthetic Construct
EKAQFK

SEQ ID NO: 9445 - protein, 6 aa, synthetic construct
  REGION 1..6: note = Synthetic Construct
EKAQGK

SEQ ID NO: 9446 - protein, 6 aa, synthetic construct
  REGION 1..6: note = Synthetic Construct
EKAQHK

SEQ ID NO: 9447 - protein, 6 aa, synthetic construct
  REGION 1..6: note = Synthetic Construct
EKAQIK

SEQ ID NO: 9448 - protein, 6 aa, synthetic construct
  REGION 1..6: note = Synthetic Construct
EKAQLK

SEQ ID NO: 9449 - protein, 6 aa, synthetic construct
  REGION 1..6: note = Synthetic Construct
EKAQNK

SEQ ID NO: 9450 - protein, 6 aa, synthetic construct
  REGION 1..6: note = Synthetic Construct
EKAQQK

SEQ ID NO: 9451 - protein, 6 aa, synthetic construct
  REGION 1..6: note = Synthetic Construct
EKAQRK

SEQ ID NO: 9452 - protein, 6 aa, synthetic construct
  REGION 1..6: note = Synthetic Construct
EKAQSK

SEQ ID NO: 9453 - protein, 6 aa, synthetic construct
  REGION 1..6: note = Synthetic Construct
EKAQTK

SEQ ID NO: 9454 - protein, 6 aa, synthetic construct
  REGION 1..6: note = Synthetic Construct
EKAQYK

SEQ ID NO: 9455 - protein, 6 aa, synthetic construct
  REGION 1..6: note = Synthetic Construct
EKARAK

SEQ ID NO: 9456 - protein, 6 aa, synthetic construct
  REGION 1..6: note = Synthetic Construct
EKARDK

SEQ ID NO: 9457 - protein, 6 aa, synthetic construct
  REGION 1..6: note = Synthetic Construct
EKAREK

SEQ ID NO: 9458 - protein, 6 aa, synthetic construct
  REGION 1..6: note = Synthetic Construct
EKARFK

SEQ ID NO: 9459 - protein, 6 aa, synthetic construct
  REGION 1..6: note = Synthetic Construct
EKARGK

SEQ ID NO: 9460 - protein, 6 aa, synthetic construct
  REGION 1..6: note = Synthetic Construct
EKARHK

SEQ ID NO: 9461 - protein, 6 aa, synthetic construct
  REGION 1..6: note = Synthetic Construct
EKARIK

SEQ ID NO: 9462 - protein, 6 aa, synthetic construct
  REGION 1..6: note = Synthetic Construct
EKARLK

SEQ ID NO: 9463 - protein, 6 aa, synthetic construct
  REGION 1..6: note = Synthetic Construct
EKARNK

SEQ ID NO: 9464 - protein, 6 aa, synthetic construct
  REGION 1..6: note = Synthetic Construct
EKARQK

SEQ ID NO: 9465 - protein, 6 aa, synthetic construct
  REGION 1..6: note = Synthetic Construct
EKARRK

SEQ ID NO: 9466 - protein, 6 aa, synthetic construct
  REGION 1..6: note = Synthetic Construct
EKARSK

SEQ ID NO: 9467 - protein, 6 aa, synthetic construct
  REGION 1..6: note = Synthetic Construct
EKARTK

SEQ ID NO: 9468 - protein, 6 aa, synthetic construct
  REGION 1..6: note = Synthetic Construct
EKARYK

SEQ ID NO: 9469 - protein, 6 aa, synthetic construct
  REGION 1..6: note = Synthetic Construct
EKASAK

SEQ ID NO: 9470 - protein, 6 aa, synthetic construct
  REGION 1..6: note = Synthetic Construct
EKASDK

SEQ ID NO: 9471 - protein, 6 aa, synthetic construct
  REGION 1..6: note = Synthetic Construct
EKASEK

SEQ ID NO: 9472 - protein, 6 aa, synthetic construct
  REGION 1..6: note = Synthetic Construct
EKASFK

SEQ ID NO: 9473 - protein, 6 aa, synthetic construct
  REGION 1..6: note = Synthetic Construct
EKASGK

SEQ ID NO: 9474 - protein, 6 aa, synthetic construct
  REGION 1..6: note = Synthetic Construct
EKASHK

SEQ ID NO: 9475 - protein, 6 aa, synthetic construct
  REGION 1..6: note = Synthetic Construct
EKASIK

SEQ ID NO: 9476 - protein, 6 aa, synthetic construct
  REGION 1..6: note = Synthetic Construct
EKASLK

SEQ ID NO: 9477 - protein, 6 aa, synthetic construct
  REGION 1..6: note = Synthetic Construct
EKASNK

SEQ ID NO: 9478 - protein, 6 aa, synthetic construct
  REGION 1..6: note = Synthetic Construct
EKASQK

SEQ ID NO: 9479 - protein, 6 aa, synthetic construct
  REGION 1..6: note = Synthetic Construct
EKASRK

SEQ ID NO: 9480 - protein, 6 aa, synthetic construct
  REGION 1..6: note = Synthetic Construct
EKASSK

SEQ ID NO: 9481 - protein, 6 aa, synthetic construct
  REGION 1..6: note = Synthetic Construct
EKASTK

SEQ ID NO: 9482 - protein, 6 aa, synthetic construct
  REGION 1..6: note = Synthetic Construct
EKASYK

SEQ ID NO: 9483 - protein, 6 aa, synthetic construct
  REGION 1..6: note = Synthetic Construct
EKATAK

SEQ ID NO: 9484 - protein, 6 aa, synthetic construct
  REGION 1..6: note = Synthetic Construct
EKATDK

SEQ ID NO: 9485 - protein, 6 aa, synthetic construct
  REGION 1..6: note = Synthetic Construct
EKATEK

SEQ ID NO: 9486 - protein, 6 aa, synthetic construct
  REGION 1..6: note = Synthetic Construct
EKATFK

SEQ ID NO: 9487 - protein, 6 aa, synthetic construct
  REGION 1..6: note = Synthetic Construct
EKATGK

SEQ ID NO: 9488 - protein, 6 aa, synthetic construct
  REGION 1..6: note = Synthetic Construct
EKATHK

SEQ ID NO: 9489 - protein, 6 aa, synthetic construct
  REGION 1..6: note = Synthetic Construct
EKATIK

SEQ ID NO: 9490 - protein, 6 aa, synthetic construct
  REGION 1..6: note = Synthetic Construct
EKATLK

SEQ ID NO: 9491 - protein, 6 aa, synthetic construct
  REGION 1..6: note = Synthetic Construct
EKATNK

SEQ ID NO: 9492 - protein, 6 aa, synthetic construct
  REGION 1..6: note = Synthetic Construct
EKATQK

SEQ ID NO: 9493 - protein, 6 aa, synthetic construct
  REGION 1..6: note = Synthetic Construct
EKATRK

SEQ ID NO: 9494 - protein, 6 aa, synthetic construct
  REGION 1..6: note = Synthetic Construct
EKATSK

SEQ ID NO: 9495 - protein, 6 aa, synthetic construct
  REGION 1..6: note = Synthetic Construct
EKATTK

SEQ ID NO: 9496 - protein, 6 aa, synthetic construct
  REGION 1..6: note = Synthetic Construct
EKATYK

SEQ ID NO: 9497 - protein, 6 aa, synthetic construct
  REGION 1..6: note = Synthetic Construct
EKAYAK

SEQ ID NO: 9498 - protein, 6 aa, synthetic construct
  REGION 1..6: note = Synthetic Construct
EKAYDK

SEQ ID NO: 9499 - protein, 6 aa, synthetic construct
  REGION 1..6: note = Synthetic Construct
EKAYEK

SEQ ID NO: 9500 - protein, 6 aa, synthetic construct
  REGION 1..6: note = Synthetic Construct
EKAYFK

SEQ ID NO: 9501 - protein, 6 aa, synthetic construct
  REGION 1..6: note = Synthetic Construct
EKAYGK

SEQ ID NO: 9502 - protein, 6 aa, synthetic construct
  REGION 1..6: note = Synthetic Construct
EKAYHK

SEQ ID NO: 9503 - protein, 6 aa, synthetic construct
  REGION 1..6: note = Synthetic Construct
EKAYIK

SEQ ID NO: 9504 - protein, 6 aa, synthetic construct
  REGION 1..6: note = Synthetic Construct
EKAYLK

SEQ ID NO: 9505 - protein, 6 aa, synthetic construct
  REGION 1..6: note = Synthetic Construct
EKAYNK

SEQ ID NO: 9506 - protein, 6 aa, synthetic construct
  REGION 1..6: note = Synthetic Construct
EKAYQK

SEQ ID NO: 9507 - protein, 6 aa, synthetic construct
  REGION 1..6: note = Synthetic Construct
EKAYRK

SEQ ID NO: 9508 - protein, 6 aa, synthetic construct
  REGION 1..6: note = Synthetic Construct
EKAYSK

SEQ ID NO: 9509 - protein, 6 aa, synthetic construct
  REGION 1..6: note = Synthetic Construct
EKAYTK

SEQ ID NO: 9510 - protein, 6 aa, synthetic construct
  REGION 1..6: note = Synthetic Construct
EKAYYK

SEQ ID NO: 9511 - protein, 6 aa, synthetic construct
  REGION 1..6: note = Synthetic Construct
EKDAAK

SEQ ID NO: 9512 - protein, 6 aa, synthetic construct
  REGION 1..6: note = Synthetic Construct
EKDADK

SEQ ID NO: 9513 - protein, 6 aa, synthetic construct
  REGION 1..6: note = Synthetic Construct
EKDAEK

SEQ ID NO: 9514 - protein, 6 aa, synthetic construct
  REGION 1..6: note = Synthetic Construct
EKDAFK

SEQ ID NO: 9515 - protein, 6 aa, synthetic construct
  REGION 1..6: note = Synthetic Construct
EKDAGK

SEQ ID NO: 9516 - protein, 6 aa, synthetic construct
  REGION 1..6: note = Synthetic Construct
EKDAHK

SEQ ID NO: 9517 - protein, 6 aa, synthetic construct
  REGION 1..6: note = Synthetic Construct
EKDAIK

SEQ ID NO: 9518 - protein, 6 aa, synthetic construct
  REGION 1..6: note = Synthetic Construct
EKDALK

SEQ ID NO: 9519 - protein, 6 aa, synthetic construct
  REGION 1..6: note = Synthetic Construct
EKDANK

SEQ ID NO: 9520 - protein, 6 aa, synthetic construct
  REGION 1..6: note = Synthetic Construct
EKDAQK

SEQ ID NO: 9521 - protein, 6 aa, synthetic construct
  REGION 1..6: note = Synthetic Construct
EKDARK

SEQ ID NO: 9522 - protein, 6 aa, synthetic construct
  REGION 1..6: note = Synthetic Construct
EKDASK

SEQ ID NO: 9523 - protein, 6 aa, synthetic construct
  REGION 1..6: note = Synthetic Construct
EKDATK

SEQ ID NO: 9524 - protein, 6 aa, synthetic construct
  REGION 1..6: note = Synthetic Construct
EKDAYK

SEQ ID NO: 9525 - protein, 6 aa, synthetic construct
  REGION 1..6: note = Synthetic Construct
EKDDAK

SEQ ID NO: 9526 - protein, 6 aa, synthetic construct
  REGION 1..6: note = Synthetic Construct
EKDDDK

SEQ ID NO: 9527 - protein, 6 aa, synthetic construct
  REGION 1..6: note = Synthetic Construct
EKDDEK

SEQ ID NO: 9528 - protein, 6 aa, synthetic construct
  REGION 1..6: note = Synthetic Construct
EKDDFK

SEQ ID NO: 9529 - protein, 6 aa, synthetic construct
  REGION 1..6: note = Synthetic Construct
EKDDGK

SEQ ID NO: 9530 - protein, 6 aa, synthetic construct
  REGION 1..6: note = Synthetic Construct
EKDDHK

SEQ ID NO: 9531 - protein, 6 aa, synthetic construct
  REGION 1..6: note = Synthetic Construct
EKDDIK

SEQ ID NO: 9532 - protein, 6 aa, synthetic construct
  REGION 1..6: note = Synthetic Construct
EKDDLK

SEQ ID NO: 9533 - protein, 6 aa, synthetic construct
  REGION 1..6: note = Synthetic Construct
EKDDNK

SEQ ID NO: 9534 - protein, 6 aa, synthetic construct
  REGION 1..6: note = Synthetic Construct
EKDDQK

SEQ ID NO: 9535 - protein, 6 aa, synthetic construct
  REGION 1..6: note = Synthetic Construct
EKDDRK

SEQ ID NO: 9536 - protein, 6 aa, synthetic construct
  REGION 1..6: note = Synthetic Construct
EKDDSK

SEQ ID NO: 9537 - protein, 6 aa, synthetic construct
  REGION 1..6: note = Synthetic Construct
EKDDTK

SEQ ID NO: 9538 - protein, 6 aa, synthetic construct
  REGION 1..6: note = Synthetic Construct
EKDDYK

SEQ ID NO: 9539 - protein, 6 aa, synthetic construct
  REGION 1..6: note = Synthetic Construct
EKDEAK

SEQ ID NO: 9540 - protein, 6 aa, synthetic construct
  REGION 1..6: note = Synthetic Construct
EKDEDK

SEQ ID NO: 9541 - protein, 6 aa, synthetic construct
  REGION 1..6: note = Synthetic Construct
EKDEEK

SEQ ID NO: 9542 - protein, 6 aa, synthetic construct
  REGION 1..6: note = Synthetic Construct
EKDEFK

SEQ ID NO: 9543 - protein, 6 aa, synthetic construct
  REGION 1..6: note = Synthetic Construct
EKDEGK

SEQ ID NO: 9544 - protein, 6 aa, synthetic construct
  REGION 1..6: note = Synthetic Construct
EKDEHK

SEQ ID NO: 9545 - protein, 6 aa, synthetic construct
  REGION 1..6: note = Synthetic Construct
EKDEIK

SEQ ID NO: 9546 - protein, 6 aa, synthetic construct
  REGION 1..6: note = Synthetic Construct
EKDELK

SEQ ID NO: 9547 - protein, 6 aa, synthetic construct
  REGION 1..6: note = Synthetic Construct
EKDENK

SEQ ID NO: 9548 - protein, 6 aa, synthetic construct
  REGION 1..6: note = Synthetic Construct
EKDEQK

SEQ ID NO: 9549 - protein, 6 aa, synthetic construct
  REGION 1..6: note = Synthetic Construct
EKDERK

SEQ ID NO: 9550 - protein, 6 aa, synthetic construct
  REGION 1..6: note = Synthetic Construct
EKDESK

SEQ ID NO: 9551 - protein, 6 aa, synthetic construct
  REGION 1..6: note = Synthetic Construct
EKDETK

SEQ ID NO: 9552 - protein, 6 aa, synthetic construct
  REGION 1..6: note = Synthetic Construct
EKDEYK

SEQ ID NO: 9553 - protein, 6 aa, synthetic construct
  REGION 1..6: note = Synthetic Construct
EKDFAK

SEQ ID NO: 9554 - protein, 6 aa, synthetic construct
  REGION 1..6: note = Synthetic Construct
EKDFDK

SEQ ID NO: 9555 - protein, 6 aa, synthetic construct
  REGION 1..6: note = Synthetic Construct
EKDFEK

SEQ ID NO: 9556 - protein, 6 aa, synthetic construct
  REGION 1..6: note = Synthetic Construct
EKDFFK

SEQ ID NO: 9557 - protein, 6 aa, synthetic construct
  REGION 1..6: note = Synthetic Construct
EKDFGK

SEQ ID NO: 9558 - protein, 6 aa, synthetic construct
  REGION 1..6: note = Synthetic Construct
EKDFHK

SEQ ID NO: 9559 - protein, 6 aa, synthetic construct
  REGION 1..6: note = Synthetic Construct
EKDFIK

SEQ ID NO: 9560 - protein, 6 aa, synthetic construct
  REGION 1..6: note = Synthetic Construct
EKDFLK

SEQ ID NO: 9561 - protein, 6 aa, synthetic construct
  REGION 1..6: note = Synthetic Construct
EKDFNK

SEQ ID NO: 9562 - protein, 6 aa, synthetic construct
  REGION 1..6: note = Synthetic Construct
EKDFQK

SEQ ID NO: 9563 - protein, 6 aa, synthetic construct
  REGION 1..6: note = Synthetic Construct
EKDFRK

SEQ ID NO: 9564 - protein, 6 aa, synthetic construct
  REGION 1..6: note = Synthetic Construct
EKDFSK

SEQ ID NO: 9565 - protein, 6 aa, synthetic construct
  REGION 1..6: note = Synthetic Construct
EKDFTK

SEQ ID NO: 9566 - protein, 6 aa, synthetic construct
  REGION 1..6: note = Synthetic Construct
EKDFYK

SEQ ID NO: 9567 - protein, 6 aa, synthetic construct
  REGION 1..6: note = Synthetic Construct
EKDGAK

SEQ ID NO: 9568 - protein, 6 aa, synthetic construct
  REGION 1..6: note = Synthetic Construct
EKDGDK

SEQ ID NO: 9569 - protein, 6 aa, synthetic construct
  REGION 1..6: note = Synthetic Construct
EKDGEK

SEQ ID NO: 9570 - protein, 6 aa, synthetic construct
  REGION 1..6: note = Synthetic Construct
EKDGFK

SEQ ID NO: 9571 - protein, 6 aa, synthetic construct
  REGION 1..6: note = Synthetic Construct
EKDGGK

SEQ ID NO: 9572 - protein, 6 aa, synthetic construct
  REGION 1..6: note = Synthetic Construct
EKDGHK

SEQ ID NO: 9573 - protein, 6 aa, synthetic construct
  REGION 1..6: note = Synthetic Construct
EKDGIK

SEQ ID NO: 9574 - protein, 6 aa, synthetic construct
  REGION 1..6: note = Synthetic Construct
EKDGLK

SEQ ID NO: 9575 - protein, 6 aa, synthetic construct
  REGION 1..6: note = Synthetic Construct
EKDGNK

SEQ ID NO: 9576 - protein, 6 aa, synthetic construct
  REGION 1..6: note = Synthetic Construct
EKDGQK

SEQ ID NO: 9577 - protein, 6 aa, synthetic construct
  REGION 1..6: note = Synthetic Construct
EKDGRK

SEQ ID NO: 9578 - protein, 6 aa, synthetic construct
  REGION 1..6: note = Synthetic Construct
EKDGSK

SEQ ID NO: 9579 - protein, 6 aa, synthetic construct
  REGION 1..6: note = Synthetic Construct
EKDGTK

SEQ ID NO: 9580 - protein, 6 aa, synthetic construct
  REGION 1..6: note = Synthetic Construct
EKDGYK

SEQ ID NO: 9581 - protein, 6 aa, synthetic construct
  REGION 1..6: note = Synthetic Construct
EKDHAK

SEQ ID NO: 9582 - protein, 6 aa, synthetic construct
  REGION 1..6: note = Synthetic Construct
EKDHDK

SEQ ID NO: 9583 - protein, 6 aa, synthetic construct
  REGION 1..6: note = Synthetic Construct
EKDHEK

SEQ ID NO: 9584 - protein, 6 aa, synthetic construct
  REGION 1..6: note = Synthetic Construct
EKDHFK

SEQ ID NO: 9585 - protein, 6 aa, synthetic construct
  REGION 1..6: note = Synthetic Construct
EKDHGK

SEQ ID NO: 9586 - protein, 6 aa, synthetic construct
  REGION 1..6: note = Synthetic Construct
EKDHHK

SEQ ID NO: 9587 - protein, 6 aa, synthetic construct
  REGION 1..6: note = Synthetic Construct
EKDHIK

SEQ ID NO: 9588 - protein, 6 aa, synthetic construct
  REGION 1..6: note = Synthetic Construct
EKDHLK

SEQ ID NO: 9589 - protein, 6 aa, synthetic construct
  REGION 1..6: note = Synthetic Construct
EKDHNK

SEQ ID NO: 9590 - protein, 6 aa, synthetic construct
  REGION 1..6: note = Synthetic Construct
EKDHQK

SEQ ID NO: 9591 - protein, 6 aa, synthetic construct
  REGION 1..6: note = Synthetic Construct
EKDHRK

SEQ ID NO: 9592 - protein, 6 aa, synthetic construct
  REGION 1..6: note = Synthetic Construct
EKDHSK

SEQ ID NO: 9593 - protein, 6 aa, synthetic construct
  REGION 1..6: note = Synthetic Construct
EKDHTK

SEQ ID NO: 9594 - protein, 6 aa, synthetic construct
  REGION 1..6: note = Synthetic Construct
EKDHYK

SEQ ID NO: 9595 - protein, 6 aa, synthetic construct
  REGION 1..6: note = Synthetic Construct
EKDIAK

SEQ ID NO: 9596 - protein, 6 aa, synthetic construct
  REGION 1..6: note = Synthetic Construct
EKDIDK

SEQ ID NO: 9597 - protein, 6 aa, synthetic construct
  REGION 1..6: note = Synthetic Construct
EKDIEK

SEQ ID NO: 9598 - protein, 6 aa, synthetic construct
  REGION 1..6: note = Synthetic Construct
EKDIFK

SEQ ID NO: 9599 - protein, 6 aa, synthetic construct
  REGION 1..6: note = Synthetic Construct
EKDIGK

SEQ ID NO: 9600 - protein, 6 aa, synthetic construct
  REGION 1..6: note = Synthetic Construct
EKDIHK

SEQ ID NO: 9601 - protein, 6 aa, synthetic construct
  REGION 1..6: note = Synthetic Construct
EKDIIK

SEQ ID NO: 9602 - protein, 6 aa, synthetic construct
  REGION 1..6: note = Synthetic Construct
EKDILK

SEQ ID NO: 9603 - protein, 6 aa, synthetic construct
  REGION 1..6: note = Synthetic Construct
EKDINK

SEQ ID NO: 9604 - protein, 6 aa, synthetic construct
  REGION 1..6: note = Synthetic Construct
EKDIQK

SEQ ID NO: 9605 - protein, 6 aa, synthetic construct
  REGION 1..6: note = Synthetic Construct
EKDIRK

SEQ ID NO: 9606 - protein, 6 aa, synthetic construct
  REGION 1..6: note = Synthetic Construct
EKDISK

SEQ ID NO: 9607 - protein, 6 aa, synthetic construct
  REGION 1..6: note = Synthetic Construct
EKDITK

SEQ ID NO: 9608 - protein, 6 aa, synthetic construct
  REGION 1..6: note = Synthetic Construct
EKDIYK

SEQ ID NO: 9609 - protein, 6 aa, synthetic construct
  REGION 1..6: note = Synthetic Construct
EKDLAK

SEQ ID NO: 9610 - protein, 6 aa, synthetic construct
  REGION 1..6: note = Synthetic Construct
EKDLDK

SEQ ID NO: 9611 - protein, 6 aa, synthetic construct
  REGION 1..6: note = Synthetic Construct
EKDLEK

SEQ ID NO: 9612 - protein, 6 aa, synthetic construct
  REGION 1..6: note = Synthetic Construct
EKDLFK

SEQ ID NO: 9613 - protein, 6 aa, synthetic construct
  REGION 1..6: note = Synthetic Construct
EKDLGK

SEQ ID NO: 9614 - protein, 6 aa, synthetic construct
  REGION 1..6: note = Synthetic Construct
EKDLHK

SEQ ID NO: 9615 - protein, 6 aa, synthetic construct
  REGION 1..6: note = Synthetic Construct
EKDLIK

SEQ ID NO: 9616 - protein, 6 aa, synthetic construct
  REGION 1..6: note = Synthetic Construct
EKDLLK

SEQ ID NO: 9617 - protein, 6 aa, synthetic construct
  REGION 1..6: note = Synthetic Construct
EKDLNK

SEQ ID NO: 9618 - protein, 6 aa, synthetic construct
  REGION 1..6: note = Synthetic Construct
EKDLQK

SEQ ID NO: 9619 - protein, 6 aa, synthetic construct
  REGION 1..6: note = Synthetic Construct
EKDLRK

SEQ ID NO: 9620 - protein, 6 aa, synthetic construct
  REGION 1..6: note = Synthetic Construct
EKDLSK

SEQ ID NO: 9621 - protein, 6 aa, synthetic construct
  REGION 1..6: note = Synthetic Construct
EKDLTK

SEQ ID NO: 9622 - protein, 6 aa, synthetic construct
  REGION 1..6: note = Synthetic Construct
EKDLYK

SEQ ID NO: 9623 - protein, 6 aa, synthetic construct
  REGION 1..6: note = Synthetic Construct
EKDNAK

SEQ ID NO: 9624 - protein, 6 aa, synthetic construct
  REGION 1..6: note = Synthetic Construct
EKDNDK

SEQ ID NO: 9625 - protein, 6 aa, synthetic construct
  REGION 1..6: note = Synthetic Construct
EKDNEK

SEQ ID NO: 9626 - protein, 6 aa, synthetic construct
  REGION 1..6: note = Synthetic Construct
EKDNFK

SEQ ID NO: 9627 - protein, 6 aa, synthetic construct
  REGION 1..6: note = Synthetic Construct
EKDNGK

SEQ ID NO: 9628 - protein, 6 aa, synthetic construct
  REGION 1..6: note = Synthetic Construct
EKDNHK

SEQ ID NO: 9629 - protein, 6 aa, synthetic construct
  REGION 1..6: note = Synthetic Construct
EKDNIK

SEQ ID NO: 9630 - protein, 6 aa, synthetic construct
  REGION 1..6: note = Synthetic Construct
EKDNLK

SEQ ID NO: 9631 - protein, 6 aa, synthetic construct
  REGION 1..6: note = Synthetic Construct
EKDNNK

SEQ ID NO: 9632 - protein, 6 aa, synthetic construct
  REGION 1..6: note = Synthetic Construct
EKDNQK

SEQ ID NO: 9633 - protein, 6 aa, synthetic construct
  REGION 1..6: note = Synthetic Construct
EKDNRK

SEQ ID NO: 9634 - protein, 6 aa, synthetic construct
  REGION 1..6: note = Synthetic Construct
EKDNSK

SEQ ID NO: 9635 - protein, 6 aa, synthetic construct
  REGION 1..6: note = Synthetic Construct
EKDNTK

SEQ ID NO: 9636 - protein, 6 aa, synthetic construct
  REGION 1..6: note = Synthetic Construct
EKDNYK

SEQ ID NO: 9637 - protein, 6 aa, synthetic construct
  REGION 1..6: note = Synthetic Construct
EKDQAK

SEQ ID NO: 9638 - protein, 6 aa, synthetic construct
  REGION 1..6: note = Synthetic Construct
EKDQDK

SEQ ID NO: 9639 - protein, 6 aa, synthetic construct
  REGION 1..6: note = Synthetic Construct
EKDQEK

SEQ ID NO: 9640 - protein, 6 aa, synthetic construct
  REGION 1..6: note = Synthetic Construct
EKDQFK

SEQ ID NO: 9641 - protein, 6 aa, synthetic construct
  REGION 1..6: note = Synthetic Construct
EKDQGK

SEQ ID NO: 9642 - protein, 6 aa, synthetic construct
  REGION 1..6: note = Synthetic Construct
EKDQHK

SEQ ID NO: 9643 - protein, 6 aa, synthetic construct
  REGION 1..6: note = Synthetic Construct
EKDQIK

SEQ ID NO: 9644 - protein, 6 aa, synthetic construct
  REGION 1..6: note = Synthetic Construct
EKDQLK

SEQ ID NO: 9645 - protein, 6 aa, synthetic construct
  REGION 1..6: note = Synthetic Construct
EKDQNK

SEQ ID NO: 9646 - protein, 6 aa, synthetic construct
  REGION 1..6: note = Synthetic Construct
EKDQQK

SEQ ID NO: 9647 - protein, 6 aa, synthetic construct
  REGION 1..6: note = Synthetic Construct
EKDQRK

SEQ ID NO: 9648 - protein, 6 aa, synthetic construct
  REGION 1..6: note = Synthetic Construct
EKDQSK

SEQ ID NO: 9649 - protein, 6 aa, synthetic construct
  REGION 1..6: note = Synthetic Construct
EKDQTK

SEQ ID NO: 9650 - protein, 6 aa, synthetic construct
  REGION 1..6: note = Synthetic Construct
EKDQYK

SEQ ID NO: 9651 - protein, 6 aa, synthetic construct
  REGION 1..6: note = Synthetic Construct
EKDRAK

SEQ ID NO: 9652 - protein, 6 aa, synthetic construct
  REGION 1..6: note = Synthetic Construct
EKDRDK

SEQ ID NO: 9653 - protein, 6 aa, synthetic construct
  REGION 1..6: note = Synthetic Construct
EKDREK

SEQ ID NO: 9654 - protein, 6 aa, synthetic construct
  REGION 1..6: note = Synthetic Construct
EKDRFK

SEQ ID NO: 9655 - protein, 6 aa, synthetic construct
  REGION 1..6: note = Synthetic Construct
EKDRGK

SEQ ID NO: 9656 - protein, 6 aa, synthetic construct
  REGION 1..6: note = Synthetic Construct
EKDRHK

SEQ ID NO: 9657 - protein, 6 aa, synthetic construct
  REGION 1..6: note = Synthetic Construct
EKDRIK

SEQ ID NO: 9658 - protein, 6 aa, synthetic construct
  REGION 1..6: note = Synthetic Construct
EKDRLK

SEQ ID NO: 9659 - protein, 6 aa, synthetic construct
  REGION 1..6: note = Synthetic Construct
EKDRNK

SEQ ID NO: 9660 - protein, 6 aa, synthetic construct
  REGION 1..6: note = Synthetic Construct
EKDRQK

SEQ ID NO: 9661 - protein, 6 aa, synthetic construct
  REGION 1..6: note = Synthetic Construct
EKDRRK

SEQ ID NO: 9662 - protein, 6 aa, synthetic construct
  REGION 1..6: note = Synthetic Construct
EKDRSK

SEQ ID NO: 9663 - protein, 6 aa, synthetic construct
  REGION 1..6: note = Synthetic Construct
EKDRTK

SEQ ID NO: 9664 - protein, 6 aa, synthetic construct
  REGION 1..6: note = Synthetic Construct
EKDRYK

SEQ ID NO: 9665 - protein, 6 aa, synthetic construct
  REGION 1..6: note = Synthetic Construct
EKDSAK

SEQ ID NO: 9666 - protein, 6 aa, synthetic construct
  REGION 1..6: note = Synthetic Construct
EKDSDK

SEQ ID NO: 9667 - protein, 6 aa, synthetic construct
  REGION 1..6: note = Synthetic Construct
EKDSEK

SEQ ID NO: 9668 - protein, 6 aa, synthetic construct
  REGION 1..6: note = Synthetic Construct
EKDSFK

SEQ ID NO: 9669 - protein, 6 aa, synthetic construct
  REGION 1..6: note = Synthetic Construct
EKDSGK

SEQ ID NO: 9670 - protein, 6 aa, synthetic construct
  REGION 1..6: note = Synthetic Construct
EKDSHK

SEQ ID NO: 9671 - protein, 6 aa, synthetic construct
  REGION 1..6: note = Synthetic Construct
EKDSIK

SEQ ID NO: 9672 - protein, 6 aa, synthetic construct
  REGION 1..6: note = Synthetic Construct
EKDSLK

SEQ ID NO: 9673 - protein, 6 aa, synthetic construct
  REGION 1..6: note = Synthetic Construct
EKDSNK

SEQ ID NO: 9674 - protein, 6 aa, synthetic construct
  REGION 1..6: note = Synthetic Construct
EKDSQK

SEQ ID NO: 9675 - protein, 6 aa, synthetic construct
  REGION 1..6: note = Synthetic Construct
EKDSRK

SEQ ID NO: 9676 - protein, 6 aa, synthetic construct
  REGION 1..6: note = Synthetic Construct
EKDSSK

SEQ ID NO: 9677 - protein, 6 aa, synthetic construct
  REGION 1..6: note = Synthetic Construct
EKDSTK

SEQ ID NO: 9678 - protein, 6 aa, synthetic construct
  REGION 1..6: note = Synthetic Construct
EKDSYK

SEQ ID NO: 9679 - protein, 6 aa, synthetic construct
  REGION 1..6: note = Synthetic Construct
EKDTAK

SEQ ID NO: 9680 - protein, 6 aa, synthetic construct
  REGION 1..6: note = Synthetic Construct
EKDTDK

SEQ ID NO: 9681 - protein, 6 aa, synthetic construct
  REGION 1..6: note = Synthetic Construct
EKDTEK

SEQ ID NO: 9682 - protein, 6 aa, synthetic construct
  REGION 1..6: note = Synthetic Construct
EKDTFK

SEQ ID NO: 9683 - protein, 6 aa, synthetic construct
  REGION 1..6: note = Synthetic Construct
EKDTGK

SEQ ID NO: 9684 - protein, 6 aa, synthetic construct
  REGION 1..6: note = Synthetic Construct
EKDTHK

SEQ ID NO: 9685 - protein, 6 aa, synthetic construct
  REGION 1..6: note = Synthetic Construct
EKDTIK

SEQ ID NO: 9686 - protein, 6 aa, synthetic construct
  REGION 1..6: note = Synthetic Construct
EKDTLK

SEQ ID NO: 9687 - protein, 6 aa, synthetic construct
  REGION 1..6: note = Synthetic Construct
EKDTNK

SEQ ID NO: 9688 - protein, 6 aa, synthetic construct
  REGION 1..6: note = Synthetic Construct
EKDTQK

SEQ ID NO: 9689 - protein, 6 aa, synthetic construct
  REGION 1..6: note = Synthetic Construct
EKDTRK

SEQ ID NO: 9690 - protein, 6 aa, synthetic construct
  REGION 1..6: note = Synthetic Construct
EKDTSK

SEQ ID NO: 9691 - protein, 6 aa, synthetic construct
  REGION 1..6: note = Synthetic Construct
EKDTTK

SEQ ID NO: 9692 - protein, 6 aa, synthetic construct
  REGION 1..6: note = Synthetic Construct
EKDTYK

SEQ ID NO: 9693 - protein, 6 aa, synthetic construct
  REGION 1..6: note = Synthetic Construct
EKDYAK

SEQ ID NO: 9694 - protein, 6 aa, synthetic construct
  REGION 1..6: note = Synthetic Construct
EKDYDK

SEQ ID NO: 9695 - protein, 6 aa, synthetic construct
  REGION 1..6: note = Synthetic Construct
EKDYEK

SEQ ID NO: 9696 - protein, 6 aa, synthetic construct
  REGION 1..6: note = Synthetic Construct
EKDYFK

SEQ ID NO: 9697 - protein, 6 aa, synthetic construct
  REGION 1..6: note = Synthetic Construct
EKDYGK

SEQ ID NO: 9698 - protein, 6 aa, synthetic construct
  REGION 1..6: note = Synthetic Construct
EKDYHK

SEQ ID NO: 9699 - protein, 6 aa, synthetic construct
  REGION 1..6: note = Synthetic Construct
EKDYIK

SEQ ID NO: 9700 - protein, 6 aa, synthetic construct
  REGION 1..6: note = Synthetic Construct
EKDYLK

SEQ ID NO: 9701 - protein, 6 aa, synthetic construct
  REGION 1..6: note = Synthetic Construct
EKDYNK

SEQ ID NO: 9702 - protein, 6 aa, synthetic construct
  REGION 1..6: note = Synthetic Construct
EKDYQK

SEQ ID NO: 9703 - protein, 6 aa, synthetic construct
  REGION 1..6: note = Synthetic Construct
EKDYRK

SEQ ID NO: 9704 - protein, 6 aa, synthetic construct
  REGION 1..6: note = Synthetic Construct
EKDYSK

SEQ ID NO: 9705 - protein, 6 aa, synthetic construct
  REGION 1..6: note = Synthetic Construct
EKDYTK

SEQ ID NO: 9706 - protein, 6 aa, synthetic construct
  REGION 1..6: note = Synthetic Construct
EKDYYK

SEQ ID NO: 9707 - protein, 6 aa, synthetic construct
  REGION 1..6: note = Synthetic Construct
EKEAAK

SEQ ID NO: 9708 - protein, 6 aa, synthetic construct
  REGION 1..6: note = Synthetic Construct
EKEADK

SEQ ID NO: 9709 - protein, 6 aa, synthetic construct
  REGION 1..6: note = Synthetic Construct
EKEAEK

SEQ ID NO: 9710 - protein, 6 aa, synthetic construct
  REGION 1..6: note = Synthetic Construct
EKEAFK

SEQ ID NO: 9711 - protein, 6 aa, synthetic construct
  REGION 1..6: note = Synthetic Construct
EKEAGK

SEQ ID NO: 9712 - protein, 6 aa, synthetic construct
  REGION 1..6: note = Synthetic Construct
EKEAHK

SEQ ID NO: 9713 - protein, 6 aa, synthetic construct
  REGION 1..6: note = Synthetic Construct
EKEAIK

SEQ ID NO: 9714 - protein, 6 aa, synthetic construct
  REGION 1..6: note = Synthetic Construct
EKEALK

SEQ ID NO: 9715 - protein, 6 aa, synthetic construct
  REGION 1..6: note = Synthetic Construct
EKEANK

SEQ ID NO: 9716 - protein, 6 aa, synthetic construct
  REGION 1..6: note = Synthetic Construct
EKEAQK

SEQ ID NO: 9717 - protein, 6 aa, synthetic construct
  REGION 1..6: note = Synthetic Construct
EKEARK

SEQ ID NO: 9718 - protein, 6 aa, synthetic construct
  REGION 1..6: note = Synthetic Construct
EKEASK

SEQ ID NO: 9719 - protein, 6 aa, synthetic construct
  REGION 1..6: note = Synthetic Construct
EKEATK

SEQ ID NO: 9720 - protein, 6 aa, synthetic construct
  REGION 1..6: note = Synthetic Construct
EKEAYK

SEQ ID NO: 9721 - protein, 6 aa, synthetic construct
  REGION 1..6: note = Synthetic Construct
EKEDAK

SEQ ID NO: 9722 - protein, 6 aa, synthetic construct
  REGION 1..6: note = Synthetic Construct
EKEDDK

SEQ ID NO: 9723 - protein, 6 aa, synthetic construct
  REGION 1..6: note = Synthetic Construct
EKEDEK

SEQ ID NO: 9724 - protein, 6 aa, synthetic construct
  REGION 1..6: note = Synthetic Construct
EKEDFK

SEQ ID NO: 9725 - protein, 6 aa, synthetic construct
  REGION 1..6: note = Synthetic Construct
EKEDGK

SEQ ID NO: 9726 - protein, 6 aa, synthetic construct
  REGION 1..6: note = Synthetic Construct
EKEDHK

SEQ ID NO: 9727 - protein, 6 aa, synthetic construct
  REGION 1..6: note = Synthetic Construct
EKEDIK

SEQ ID NO: 9728 - protein, 6 aa, synthetic construct
  REGION 1..6: note = Synthetic Construct
EKEDLK

SEQ ID NO: 9729 - protein, 6 aa, synthetic construct
  REGION 1..6: note = Synthetic Construct
EKEDNK

SEQ ID NO: 9730 - protein, 6 aa, synthetic construct
  REGION 1..6: note = Synthetic Construct
EKEDQK

SEQ ID NO: 9731 - protein, 6 aa, synthetic construct
  REGION 1..6: note = Synthetic Construct
EKEDRK

SEQ ID NO: 9732 - protein, 6 aa, synthetic construct
  REGION 1..6: note = Synthetic Construct
EKEDSK

SEQ ID NO: 9733 - protein, 6 aa, synthetic construct
  REGION 1..6: note = Synthetic Construct
EKEDTK

SEQ ID NO: 9734 - protein, 6 aa, synthetic construct
  REGION 1..6: note = Synthetic Construct
EKEDYK

SEQ ID NO: 9735 - protein, 6 aa, synthetic construct
  REGION 1..6: note = Synthetic Construct
EKEEAK

SEQ ID NO: 9736 - protein, 6 aa, synthetic construct
  REGION 1..6: note = Synthetic Construct
EKEEDK

SEQ ID NO: 9737 - protein, 6 aa, synthetic construct
  REGION 1..6: note = Synthetic Construct
EKEEEK

SEQ ID NO: 9738 - protein, 6 aa, synthetic construct
  REGION 1..6: note = Synthetic Construct
EKEEFK

SEQ ID NO: 9739 - protein, 6 aa, synthetic construct
  REGION 1..6: note = Synthetic Construct
EKEEGK

SEQ ID NO: 9740 - protein, 6 aa, synthetic construct
  REGION 1..6: note = Synthetic Construct
EKEEHK

SEQ ID NO: 9741 - protein, 6 aa, synthetic construct
  REGION 1..6: note = Synthetic Construct
EKEEIK

SEQ ID NO: 9742 - protein, 6 aa, synthetic construct
  REGION 1..6: note = Synthetic Construct
EKEELK

SEQ ID NO: 9743 - protein, 6 aa, synthetic construct
  REGION 1..6: note = Synthetic Construct
EKEENK

SEQ ID NO: 9744 - protein, 6 aa, synthetic construct
  REGION 1..6: note = Synthetic Construct
EKEEQK

SEQ ID NO: 9745 - protein, 6 aa, synthetic construct
  REGION 1..6: note = Synthetic Construct
EKEERK

SEQ ID NO: 9746 - protein, 6 aa, synthetic construct
  REGION 1..6: note = Synthetic Construct
EKEESK

SEQ ID NO: 9747 - protein, 6 aa, synthetic construct
  REGION 1..6: note = Synthetic Construct
EKEETK

SEQ ID NO: 9748 - protein, 6 aa, synthetic construct
  REGION 1..6: note = Synthetic Construct
EKEEYK

SEQ ID NO: 9749 - protein, 6 aa, synthetic construct
  REGION 1..6: note = Synthetic Construct
EKEFAK

SEQ ID NO: 9750 - protein, 6 aa, synthetic construct
  REGION 1..6: note = Synthetic Construct
EKEFDK

SEQ ID NO: 9751 - protein, 6 aa, synthetic construct
  REGION 1..6: note = Synthetic Construct
EKEFEK

SEQ ID NO: 9752 - protein, 6 aa, synthetic construct
  REGION 1..6: note = Synthetic Construct
EKEFFK

SEQ ID NO: 9753 - protein, 6 aa, synthetic construct
  REGION 1..6: note = Synthetic Construct
EKEFGK

SEQ ID NO: 9754 - protein, 6 aa, synthetic construct
  REGION 1..6: note = Synthetic Construct
EKEFHK

SEQ ID NO: 9755 - protein, 6 aa, synthetic construct
  REGION 1..6: note = Synthetic Construct
EKEFIK

SEQ ID NO: 9756 - protein, 6 aa, synthetic construct
  REGION 1..6: note = Synthetic Construct
EKEFLK

SEQ ID NO: 9757 - protein, 6 aa, synthetic construct
  REGION 1..6: note = Synthetic Construct
EKEFNK

SEQ ID NO: 9758 - protein, 6 aa, synthetic construct
  REGION 1..6: note = Synthetic Construct
EKEFQK

SEQ ID NO: 9759 - protein, 6 aa, synthetic construct
  REGION 1..6: note = Synthetic Construct
EKEFRK

SEQ ID NO: 9760 - protein, 6 aa, synthetic construct
  REGION 1..6: note = Synthetic Construct
EKEFSK

SEQ ID NO: 9761 - protein, 6 aa, synthetic construct
  REGION 1..6: note = Synthetic Construct
EKEFTK

SEQ ID NO: 9762 - protein, 6 aa, synthetic construct
  REGION 1..6: note = Synthetic Construct
EKEFYK

SEQ ID NO: 9763 - protein, 6 aa, synthetic construct
  REGION 1..6: note = Synthetic Construct
EKEGAK

SEQ ID NO: 9764 - protein, 6 aa, synthetic construct
  REGION 1..6: note = Synthetic Construct
EKEGDK

SEQ ID NO: 9765 - protein, 6 aa, synthetic construct
  REGION 1..6: note = Synthetic Construct
EKEGEK

SEQ ID NO: 9766 - protein, 6 aa, synthetic construct
  REGION 1..6: note = Synthetic Construct
EKEGFK

SEQ ID NO: 9767 - protein, 6 aa, synthetic construct
  REGION 1..6: note = Synthetic Construct
EKEGGK

SEQ ID NO: 9768 - protein, 6 aa, synthetic construct
  REGION 1..6: note = Synthetic Construct
EKEGHK

SEQ ID NO: 9769 - protein, 6 aa, synthetic construct
  REGION 1..6: note = Synthetic Construct
EKEGIK

SEQ ID NO: 9770 - protein, 6 aa, synthetic construct
  REGION 1..6: note = Synthetic Construct
EKEGLK

SEQ ID NO: 9771 - protein, 6 aa, synthetic construct
  REGION 1..6: note = Synthetic Construct
EKEGNK

SEQ ID NO: 9772 - protein, 6 aa, synthetic construct
  REGION 1..6: note = Synthetic Construct
EKEGQK

SEQ ID NO: 9773 - protein, 6 aa, synthetic construct
  REGION 1..6: note = Synthetic Construct
EKEGRK

SEQ ID NO: 9774 - protein, 6 aa, synthetic construct
  REGION 1..6: note = Synthetic Construct
EKEGSK

SEQ ID NO: 9775 - protein, 6 aa, synthetic construct
  REGION 1..6: note = Synthetic Construct
EKEGTK

SEQ ID NO: 9776 - protein, 6 aa, synthetic construct
  REGION 1..6: note = Synthetic Construct
EKEGYK

SEQ ID NO: 9777 - protein, 6 aa, synthetic construct
  REGION 1..6: note = Synthetic Construct
EKEHAK

SEQ ID NO: 9778 - protein, 6 aa, synthetic construct
  REGION 1..6: note = Synthetic Construct
EKEHDK

SEQ ID NO: 9779 - protein, 6 aa, synthetic construct
  REGION 1..6: note = Synthetic Construct
EKEHEK

SEQ ID NO: 9780 - protein, 6 aa, synthetic construct
  REGION 1..6: note = Synthetic Construct
EKEHFK

SEQ ID NO: 9781 - protein, 6 aa, synthetic construct
  REGION 1..6: note = Synthetic Construct
EKEHGK

SEQ ID NO: 9782 - protein, 6 aa, synthetic construct
  REGION 1..6: note = Synthetic Construct
EKEHHK

SEQ ID NO: 9783 - protein, 6 aa, synthetic construct
  REGION 1..6: note = Synthetic Construct
EKEHIK

SEQ ID NO: 9784 - protein, 6 aa, synthetic construct
  REGION 1..6: note = Synthetic Construct
EKEHLK

SEQ ID NO: 9785 - protein, 6 aa, synthetic construct
  REGION 1..6: note = Synthetic Construct
EKEHNK

SEQ ID NO: 9786 - protein, 6 aa, synthetic construct
  REGION 1..6: note = Synthetic Construct
EKEHQK

SEQ ID NO: 9787 - protein, 6 aa, synthetic construct
  REGION 1..6: note = Synthetic Construct
EKEHRK

SEQ ID NO: 9788 - protein, 6 aa, synthetic construct
  REGION 1..6: note = Synthetic Construct
EKEHSK

SEQ ID NO: 9789 - protein, 6 aa, synthetic construct
  REGION 1..6: note = Synthetic Construct
EKEHTK

SEQ ID NO: 9790 - protein, 6 aa, synthetic construct
  REGION 1..6: note = Synthetic Construct
EKEHYK

SEQ ID NO: 9791 - protein, 6 aa, synthetic construct
  REGION 1..6: note = Synthetic Construct
EKEIAK

SEQ ID NO: 9792 - protein, 6 aa, synthetic construct
  REGION 1..6: note = Synthetic Construct
EKEIDK

SEQ ID NO: 9793 - protein, 6 aa, synthetic construct
  REGION 1..6: note = Synthetic Construct
EKEIEK

SEQ ID NO: 9794 - protein, 6 aa, synthetic construct
  REGION 1..6: note = Synthetic Construct
EKEIFK

SEQ ID NO: 9795 - protein, 6 aa, synthetic construct
  REGION 1..6: note = Synthetic Construct
EKEIGK

SEQ ID NO: 9796 - protein, 6 aa, synthetic construct
  REGION 1..6: note = Synthetic Construct
EKEIHK

SEQ ID NO: 9797 - protein, 6 aa, synthetic construct
  REGION 1..6: note = Synthetic Construct
EKEIIK

SEQ ID NO: 9798 - protein, 6 aa, synthetic construct
  REGION 1..6: note = Synthetic Construct
EKEILK

SEQ ID NO: 9799 - protein, 6 aa, synthetic construct
  REGION 1..6: note = Synthetic Construct
EKEINK

SEQ ID NO: 9800 - protein, 6 aa, synthetic construct
  REGION 1..6: note = Synthetic Construct
EKEIQK

SEQ ID NO: 9801 - protein, 6 aa, synthetic construct
  REGION 1..6: note = Synthetic Construct
EKEIRK

SEQ ID NO: 9802 - protein, 6 aa, synthetic construct
  REGION 1..6: note = Synthetic Construct
EKEISK

SEQ ID NO: 9803 - protein, 6 aa, synthetic construct
  REGION 1..6: note = Synthetic Construct
EKEITK

SEQ ID NO: 9804 - protein, 6 aa, synthetic construct
  REGION 1..6: note = Synthetic Construct
EKEIYK

SEQ ID NO: 9805 - protein, 6 aa, synthetic construct
  REGION 1..6: note = Synthetic Construct
EKELAK

SEQ ID NO: 9806 - protein, 6 aa, synthetic construct
  REGION 1..6: note = Synthetic Construct
EKELDK

SEQ ID NO: 9807 - protein, 6 aa, synthetic construct
  REGION 1..6: note = Synthetic Construct
EKELEK

SEQ ID NO: 9808 - protein, 6 aa, synthetic construct
  REGION 1..6: note = Synthetic Construct
EKELFK

SEQ ID NO: 9809 - protein, 6 aa, synthetic construct
  REGION 1..6: note = Synthetic Construct
EKELGK

SEQ ID NO: 9810 - protein, 6 aa, synthetic construct
  REGION 1..6: note = Synthetic Construct
EKELHK

SEQ ID NO: 9811 - protein, 6 aa, synthetic construct
  REGION 1..6: note = Synthetic Construct
EKELIK

SEQ ID NO: 9812 - protein, 6 aa, synthetic construct
  REGION 1..6: note = Synthetic Construct
EKELLK

SEQ ID NO: 9813 - protein, 6 aa, synthetic construct
  REGION 1..6: note = Synthetic Construct
EKELNK

SEQ ID NO: 9814 - protein, 6 aa, synthetic construct
  REGION 1..6: note = Synthetic Construct
EKELQK

SEQ ID NO: 9815 - protein, 6 aa, synthetic construct
  REGION 1..6: note = Synthetic Construct
EKELRK

SEQ ID NO: 9816 - protein, 6 aa, synthetic construct
  REGION 1..6: note = Synthetic Construct
EKELSK

SEQ ID NO: 9817 - protein, 6 aa, synthetic construct
  REGION 1..6: note = Synthetic Construct
EKELTK

SEQ ID NO: 9818 - protein, 6 aa, synthetic construct
  REGION 1..6: note = Synthetic Construct
EKELYK

SEQ ID NO: 9819 - protein, 6 aa, synthetic construct
  REGION 1..6: note = Synthetic Construct
EKENAK

SEQ ID NO: 9820 - protein, 6 aa, synthetic construct
  REGION 1..6: note = Synthetic Construct
EKENDK

SEQ ID NO: 9821 - protein, 6 aa, synthetic construct
  REGION 1..6: note = Synthetic Construct
EKENEK

SEQ ID NO: 9822 - protein, 6 aa, synthetic construct
  REGION 1..6: note = Synthetic Construct
EKENFK

SEQ ID NO: 9823 - protein, 6 aa, synthetic construct
  REGION 1..6: note = Synthetic Construct
EKENGK

SEQ ID NO: 9824 - protein, 6 aa, synthetic construct
  REGION 1..6: note = Synthetic Construct
EKENHK

SEQ ID NO: 9825 - protein, 6 aa, synthetic construct
  REGION 1..6: note = Synthetic Construct
EKENIK

SEQ ID NO: 9826 - protein, 6 aa, synthetic construct
  REGION 1..6: note = Synthetic Construct
EKENLK

SEQ ID NO: 9827 - protein, 6 aa, synthetic construct
  REGION 1..6: note = Synthetic Construct
EKENNK

SEQ ID NO: 9828 - protein, 6 aa, synthetic construct
  REGION 1..6: note = Synthetic Construct
EKENQK

SEQ ID NO: 9829 - protein, 6 aa, synthetic construct
  REGION 1..6: note = Synthetic Construct
EKENRK

SEQ ID NO: 9830 - protein, 6 aa, synthetic construct
  REGION 1..6: note = Synthetic Construct
EKENSK

SEQ ID NO: 9831 - protein, 6 aa, synthetic construct
  REGION 1..6: note = Synthetic Construct
EKENTK

SEQ ID NO: 9832 - protein, 6 aa, synthetic construct
  REGION 1..6: note = Synthetic Construct
EKENYK

SEQ ID NO: 9833 - protein, 6 aa, synthetic construct
  REGION 1..6: note = Synthetic Construct
EKEQAK

SEQ ID NO: 9834 - protein, 6 aa, synthetic construct
  REGION 1..6: note = Synthetic Construct
EKEQDK

SEQ ID NO: 9835 - protein, 6 aa, synthetic construct
  REGION 1..6: note = Synthetic Construct
EKEQEK

SEQ ID NO: 9836 - protein, 6 aa, synthetic construct
  REGION 1..6: note = Synthetic Construct
EKEQFK

SEQ ID NO: 9837 - protein, 6 aa, synthetic construct
  REGION 1..6: note = Synthetic Construct
EKEQGK

SEQ ID NO: 9838 - protein, 6 aa, synthetic construct
  REGION 1..6: note = Synthetic Construct
EKEQHK

SEQ ID NO: 9839 - protein, 6 aa, synthetic construct
  REGION 1..6: note = Synthetic Construct
EKEQIK

SEQ ID NO: 9840 - protein, 6 aa, synthetic construct
  REGION 1..6: note = Synthetic Construct
EKEQLK

SEQ ID NO: 9841 - protein, 6 aa, synthetic construct
  REGION 1..6: note = Synthetic Construct
EKEQNK

SEQ ID NO: 9842 - protein, 6 aa, synthetic construct
  REGION 1..6: note = Synthetic Construct
EKEQQK

SEQ ID NO: 9843 - protein, 6 aa, synthetic construct
  REGION 1..6: note = Synthetic Construct
EKEQRK

SEQ ID NO: 9844 - protein, 6 aa, synthetic construct
  REGION 1..6: note = Synthetic Construct
EKEQSK

SEQ ID NO: 9845 - protein, 6 aa, synthetic construct
  REGION 1..6: note = Synthetic Construct
EKEQTK

SEQ ID NO: 9846 - protein, 6 aa, synthetic construct
  REGION 1..6: note = Synthetic Construct
EKEQYK

SEQ ID NO: 9847 - protein, 6 aa, synthetic construct
  REGION 1..6: note = Synthetic Construct
EKERAK

SEQ ID NO: 9848 - protein, 6 aa, synthetic construct
  REGION 1..6: note = Synthetic Construct
EKERDK

SEQ ID NO: 9849 - protein, 6 aa, synthetic construct
  REGION 1..6: note = Synthetic Construct
EKEREK

SEQ ID NO: 9850 - protein, 6 aa, synthetic construct
  REGION 1..6: note = Synthetic Construct
EKERFK

SEQ ID NO: 9851 - protein, 6 aa, synthetic construct
  REGION 1..6: note = Synthetic Construct
EKERGK

SEQ ID NO: 9852 - protein, 6 aa, synthetic construct
  REGION 1..6: note = Synthetic Construct
EKERHK

SEQ ID NO: 9853 - protein, 6 aa, synthetic construct
  REGION 1..6: note = Synthetic Construct
EKERIK

SEQ ID NO: 9854 - protein, 6 aa, synthetic construct
  REGION 1..6: note = Synthetic Construct
EKERLK

SEQ ID NO: 9855 - protein, 6 aa, synthetic construct
  REGION 1..6: note = Synthetic Construct
EKERNK

SEQ ID NO: 9856 - protein, 6 aa, synthetic construct
  REGION 1..6: note = Synthetic Construct
EKERQK

SEQ ID NO: 9857 - protein, 6 aa, synthetic construct
  REGION 1..6: note = Synthetic Construct
EKERRK

SEQ ID NO: 9858 - protein, 6 aa, synthetic construct
  REGION 1..6: note = Synthetic Construct
EKERSK

SEQ ID NO: 9859 - protein, 6 aa, synthetic construct
  REGION 1..6: note = Synthetic Construct
EKERTK

SEQ ID NO: 9860 - protein, 6 aa, synthetic construct
  REGION 1..6: note = Synthetic Construct
EKERYK

SEQ ID NO: 9861 - protein, 6 aa, synthetic construct
  REGION 1..6: note = Synthetic Construct
EKESAK

SEQ ID NO: 9862 - protein, 6 aa, synthetic construct
  REGION 1..6: note = Synthetic Construct
EKESDK

SEQ ID NO: 9863 - protein, 6 aa, synthetic construct
  REGION 1..6: note = Synthetic Construct
EKESEK

SEQ ID NO: 9864 - protein, 6 aa, synthetic construct
  REGION 1..6: note = Synthetic Construct
EKESFK

SEQ ID NO: 9865 - protein, 6 aa, synthetic construct
  REGION 1..6: note = Synthetic Construct
EKESGK

SEQ ID NO: 9866 - protein, 6 aa, synthetic construct
  REGION 1..6: note = Synthetic Construct
EKESHK

SEQ ID NO: 9867 - protein, 6 aa, synthetic construct
  REGION 1..6: note = Synthetic Construct
EKESIK

SEQ ID NO: 9868 - protein, 6 aa, synthetic construct
  REGION 1..6: note = Synthetic Construct
EKESLK

SEQ ID NO: 9869 - protein, 6 aa, synthetic construct
  REGION 1..6: note = Synthetic Construct
EKESNK

SEQ ID NO: 9870 - protein, 6 aa, synthetic construct
  REGION 1..6: note = Synthetic Construct
EKESQK

SEQ ID NO: 9871 - protein, 6 aa, synthetic construct
  REGION 1..6: note = Synthetic Construct
EKESRK

SEQ ID NO: 9872 - protein, 6 aa, synthetic construct
  REGION 1..6: note = Synthetic Construct
EKESSK

SEQ ID NO: 9873 - protein, 6 aa, synthetic construct
  REGION 1..6: note = Synthetic Construct
EKESTK

SEQ ID NO: 9874 - protein, 6 aa, synthetic construct
  REGION 1..6: note = Synthetic Construct
EKESYK

SEQ ID NO: 9875 - protein, 6 aa, synthetic construct
  REGION 1..6: note = Synthetic Construct
EKETAK

SEQ ID NO: 9876 - protein, 6 aa, synthetic construct
  REGION 1..6: note = Synthetic Construct
EKETDK

SEQ ID NO: 9877 - protein, 6 aa, synthetic construct
  REGION 1..6: note = Synthetic Construct
EKETEK

SEQ ID NO: 9878 - protein, 6 aa, synthetic construct
  REGION 1..6: note = Synthetic Construct
EKETFK

SEQ ID NO: 9879 - protein, 6 aa, synthetic construct
  REGION 1..6: note = Synthetic Construct
EKETGK

SEQ ID NO: 9880 - protein, 6 aa, synthetic construct
  REGION 1..6: note = Synthetic Construct
EKETHK

SEQ ID NO: 9881 - protein, 6 aa, synthetic construct
  REGION 1..6: note = Synthetic Construct
EKETIK

SEQ ID NO: 9882 - protein, 6 aa, synthetic construct
  REGION 1..6: note = Synthetic Construct
EKETLK

SEQ ID NO: 9883 - protein, 6 aa, synthetic construct
  REGION 1..6: note = Synthetic Construct
EKETNK

SEQ ID NO: 9884 - protein, 6 aa, synthetic construct
  REGION 1..6: note = Synthetic Construct
EKETQK

SEQ ID NO: 9885 - protein, 6 aa, synthetic construct
  REGION 1..6: note = Synthetic Construct
EKETRK

SEQ ID NO: 9886 - protein, 6 aa, synthetic construct
  REGION 1..6: note = Synthetic Construct
EKETSK

SEQ ID NO: 9887 - protein, 6 aa, synthetic construct
  REGION 1..6: note = Synthetic Construct
EKETTK

SEQ ID NO: 9888 - protein, 6 aa, synthetic construct
  REGION 1..6: note = Synthetic Construct
EKETYK

SEQ ID NO: 9889 - protein, 6 aa, synthetic construct
  REGION 1..6: note = Synthetic Construct
EKEYAK

SEQ ID NO: 9890 - protein, 6 aa, synthetic construct
  REGION 1..6: note = Synthetic Construct
EKEYDK

SEQ ID NO: 9891 - protein, 6 aa, synthetic construct
  REGION 1..6: note = Synthetic Construct
EKEYEK

SEQ ID NO: 9892 - protein, 6 aa, synthetic construct
  REGION 1..6: note = Synthetic Construct
EKEYFK

SEQ ID NO: 9893 - protein, 6 aa, synthetic construct
  REGION 1..6: note = Synthetic Construct
EKEYGK

SEQ ID NO: 9894 - protein, 6 aa, synthetic construct
  REGION 1..6: note = Synthetic Construct
EKEYHK

SEQ ID NO: 9895 - protein, 6 aa, synthetic construct
  REGION 1..6: note = Synthetic Construct
EKEYIK

SEQ ID NO: 9896 - protein, 6 aa, synthetic construct
  REGION 1..6: note = Synthetic Construct
EKEYLK

SEQ ID NO: 9897 - protein, 6 aa, synthetic construct
  REGION 1..6: note = Synthetic Construct
EKEYNK

SEQ ID NO: 9898 - protein, 6 aa, synthetic construct
  REGION 1..6: note = Synthetic Construct
EKEYQK

SEQ ID NO: 9899 - protein, 6 aa, synthetic construct
  REGION 1..6: note = Synthetic Construct
EKEYRK

SEQ ID NO: 9900 - protein, 6 aa, synthetic construct
  REGION 1..6: note = Synthetic Construct
EKEYSK

SEQ ID NO: 9901 - protein, 6 aa, synthetic construct
  REGION 1..6: note = Synthetic Construct
EKEYTK

SEQ ID NO: 9902 - protein, 6 aa, synthetic construct
  REGION 1..6: note = Synthetic Construct
EKEYYK

SEQ ID NO: 9903 - protein, 6 aa, synthetic construct
  REGION 1..6: note = Synthetic Construct
EKFAAK

SEQ ID NO: 9904 - protein, 6 aa, synthetic construct
  REGION 1..6: note = Synthetic Construct
EKFADK

SEQ ID NO: 9905 - protein, 6 aa, synthetic construct
  REGION 1..6: note = Synthetic Construct
EKFAEK

SEQ ID NO: 9906 - protein, 6 aa, synthetic construct
  REGION 1..6: note = Synthetic Construct
EKFAFK

SEQ ID NO: 9907 - protein, 6 aa, synthetic construct
  REGION 1..6: note = Synthetic Construct
EKFAGK

SEQ ID NO: 9908 - protein, 6 aa, synthetic construct
  REGION 1..6: note = Synthetic Construct
EKFAHK

SEQ ID NO: 9909 - protein, 6 aa, synthetic construct
  REGION 1..6: note = Synthetic Construct
EKFAIK

SEQ ID NO: 9910 - protein, 6 aa, synthetic construct
  REGION 1..6: note = Synthetic Construct
EKFALK

SEQ ID NO: 9911 - protein, 6 aa, synthetic construct
  REGION 1..6: note = Synthetic Construct
EKFANK

SEQ ID NO: 9912 - protein, 6 aa, synthetic construct
  REGION 1..6: note = Synthetic Construct
EKFAQK

SEQ ID NO: 9913 - protein, 6 aa, synthetic construct
  REGION 1..6: note = Synthetic Construct
EKFARK

SEQ ID NO: 9914 - protein, 6 aa, synthetic construct
  REGION 1..6: note = Synthetic Construct
EKFASK

SEQ ID NO: 9915 - protein, 6 aa, synthetic construct
  REGION 1..6: note = Synthetic Construct
EKFATK

SEQ ID NO: 9916 - protein, 6 aa, synthetic construct
  REGION 1..6: note = Synthetic Construct
EKFAYK

SEQ ID NO: 9917 - protein, 6 aa, synthetic construct
  REGION 1..6: note = Synthetic Construct
EKFDAK

SEQ ID NO: 9918 - protein, 6 aa, synthetic construct
  REGION 1..6: note = Synthetic Construct
EKFDDK

SEQ ID NO: 9919 - protein, 6 aa, synthetic construct
  REGION 1..6: note = Synthetic Construct
EKFDEK

SEQ ID NO: 9920 - protein, 6 aa, synthetic construct
  REGION 1..6: note = Synthetic Construct
EKFDFK

SEQ ID NO: 9921 - protein, 6 aa, synthetic construct
  REGION 1..6: note = Synthetic Construct
EKFDGK

SEQ ID NO: 9922 - protein, 6 aa, synthetic construct
  REGION 1..6: note = Synthetic Construct
EKFDHK

SEQ ID NO: 9923 - protein, 6 aa, synthetic construct
  REGION 1..6: note = Synthetic Construct
EKFDIK

SEQ ID NO: 9924 - protein, 6 aa, synthetic construct
  REGION 1..6: note = Synthetic Construct
EKFDLK

SEQ ID NO: 9925 - protein, 6 aa, synthetic construct
  REGION 1..6: note = Synthetic Construct
EKFDNK

SEQ ID NO: 9926 - protein, 6 aa, synthetic construct
  REGION 1..6: note = Synthetic Construct
EKFDQK

SEQ ID NO: 9927 - protein, 6 aa, synthetic construct
  REGION 1..6: note = Synthetic Construct
EKFDRK

SEQ ID NO: 9928 - protein, 6 aa, synthetic construct
  REGION 1..6: note = Synthetic Construct
EKFDSK

SEQ ID NO: 9929 - protein, 6 aa, synthetic construct
  REGION 1..6: note = Synthetic Construct
EKFDTK

SEQ ID NO: 9930 - protein, 6 aa, synthetic construct
  REGION 1..6: note = Synthetic Construct
EKFDYK

SEQ ID NO: 9931 - protein, 6 aa, synthetic construct
  REGION 1..6: note = Synthetic Construct
EKFEAK

SEQ ID NO: 9932 - protein, 6 aa, synthetic construct
  REGION 1..6: note = Synthetic Construct
EKFEDK

SEQ ID NO: 9933 - protein, 6 aa, synthetic construct
  REGION 1..6: note = Synthetic Construct
EKFEEK

SEQ ID NO: 9934 - protein, 6 aa, synthetic construct
  REGION 1..6: note = Synthetic Construct
EKFEFK

SEQ ID NO: 9935 - protein, 6 aa, synthetic construct
  REGION 1..6: note = Synthetic Construct
EKFEGK

SEQ ID NO: 9936 - protein, 6 aa, synthetic construct
  REGION 1..6: note = Synthetic Construct
EKFEHK

SEQ ID NO: 9937 - protein, 6 aa, synthetic construct
  REGION 1..6: note = Synthetic Construct
EKFEIK

SEQ ID NO: 9938 - protein, 6 aa, synthetic construct
  REGION 1..6: note = Synthetic Construct
EKFELK

SEQ ID NO: 9939 - protein, 6 aa, synthetic construct
  REGION 1..6: note = Synthetic Construct
EKFENK

SEQ ID NO: 9940 - protein, 6 aa, synthetic construct
  REGION 1..6: note = Synthetic Construct
EKFEQK

SEQ ID NO: 9941 - protein, 6 aa, synthetic construct
  REGION 1..6: note = Synthetic Construct
EKFERK

SEQ ID NO: 9942 - protein, 6 aa, synthetic construct
  REGION 1..6: note = Synthetic Construct
EKFESK

SEQ ID NO: 9943 - protein, 6 aa, synthetic construct
  REGION 1..6: note = Synthetic Construct
EKFETK

SEQ ID NO: 9944 - protein, 6 aa, synthetic construct
  REGION 1..6: note = Synthetic Construct
EKFEYK

SEQ ID NO: 9945 - protein, 6 aa, synthetic construct
  REGION 1..6: note = Synthetic Construct
EKFFAK

SEQ ID NO: 9946 - protein, 6 aa, synthetic construct
  REGION 1..6: note = Synthetic Construct
EKFFDK

SEQ ID NO: 9947 - protein, 6 aa, synthetic construct
  REGION 1..6: note = Synthetic Construct
EKFFEK

SEQ ID NO: 9948 - protein, 6 aa, synthetic construct
  REGION 1..6: note = Synthetic Construct
EKFFFK

SEQ ID NO: 9949 - protein, 6 aa, synthetic construct
  REGION 1..6: note = Synthetic Construct
EKFFGK

SEQ ID NO: 9950 - protein, 6 aa, synthetic construct
  REGION 1..6: note = Synthetic Construct
EKFFHK

SEQ ID NO: 9951 - protein, 6 aa, synthetic construct
  REGION 1..6: note = Synthetic Construct
EKFFIK

SEQ ID NO: 9952 - protein, 6 aa, synthetic construct
  REGION 1..6: note = Synthetic Construct
EKFFLK

SEQ ID NO: 9953 - protein, 6 aa, synthetic construct
  REGION 1..6: note = Synthetic Construct
EKFFNK

SEQ ID NO: 9954 - protein, 6 aa, synthetic construct
  REGION 1..6: note = Synthetic Construct
EKFFQK

SEQ ID NO: 9955 - protein, 6 aa, synthetic construct
  REGION 1..6: note = Synthetic Construct
EKFFRK

SEQ ID NO: 9956 - protein, 6 aa, synthetic construct
  REGION 1..6: note = Synthetic Construct
EKFFSK

SEQ ID NO: 9957 - protein, 6 aa, synthetic construct
  REGION 1..6: note = Synthetic Construct
EKFFTK

SEQ ID NO: 9958 - protein, 6 aa, synthetic construct
  REGION 1..6: note = Synthetic Construct
EKFFYK

SEQ ID NO: 9959 - protein, 6 aa, synthetic construct
  REGION 1..6: note = Synthetic Construct
EKFGAK

SEQ ID NO: 9960 - protein, 6 aa, synthetic construct
  REGION 1..6: note = Synthetic Construct
EKFGDK

SEQ ID NO: 9961 - protein, 6 aa, synthetic construct
  REGION 1..6: note = Synthetic Construct
EKFGEK

SEQ ID NO: 9962 - protein, 6 aa, synthetic construct
  REGION 1..6: note = Synthetic Construct
EKFGFK

SEQ ID NO: 9963 - protein, 6 aa, synthetic construct
  REGION 1..6: note = Synthetic Construct
EKFGGK

SEQ ID NO: 9964 - protein, 6 aa, synthetic construct
  REGION 1..6: note = Synthetic Construct
EKFGHK

SEQ ID NO: 9965 - protein, 6 aa, synthetic construct
  REGION 1..6: note = Synthetic Construct
EKFGIK

SEQ ID NO: 9966 - protein, 6 aa, synthetic construct
  REGION 1..6: note = Synthetic Construct
EKFGLK

SEQ ID NO: 9967 - protein, 6 aa, synthetic construct
  REGION 1..6: note = Synthetic Construct
EKFGNK

SEQ ID NO: 9968 - protein, 6 aa, synthetic construct
  REGION 1..6: note = Synthetic Construct
EKFGQK

SEQ ID NO: 9969 - protein, 6 aa, synthetic construct
  REGION 1..6: note = Synthetic Construct
EKFGRK

SEQ ID NO: 9970 - protein, 6 aa, synthetic construct
  REGION 1..6: note = Synthetic Construct
EKFGSK

SEQ ID NO: 9971 - protein, 6 aa, synthetic construct
  REGION 1..6: note = Synthetic Construct
EKFGTK

SEQ ID NO: 9972 - protein, 6 aa, synthetic construct
  REGION 1..6: note = Synthetic Construct
EKFGYK

SEQ ID NO: 9973 - protein, 6 aa, synthetic construct
  REGION 1..6: note = Synthetic Construct
EKFHAK

SEQ ID NO: 9974 - protein, 6 aa, synthetic construct
  REGION 1..6: note = Synthetic Construct
EKFHDK

SEQ ID NO: 9975 - protein, 6 aa, synthetic construct
  REGION 1..6: note = Synthetic Construct
EKFHEK

SEQ ID NO: 9976 - protein, 6 aa, synthetic construct
  REGION 1..6: note = Synthetic Construct
EKFHFK

SEQ ID NO: 9977 - protein, 6 aa, synthetic construct
  REGION 1..6: note = Synthetic Construct
EKFHGK

SEQ ID NO: 9978 - protein, 6 aa, synthetic construct
  REGION 1..6: note = Synthetic Construct
EKFHHK

SEQ ID NO: 9979 - protein, 6 aa, synthetic construct
  REGION 1..6: note = Synthetic Construct
EKFHIK

SEQ ID NO: 9980 - protein, 6 aa, synthetic construct
  REGION 1..6: note = Synthetic Construct
EKFHLK

SEQ ID NO: 9981 - protein, 6 aa, synthetic construct
  REGION 1..6: note = Synthetic Construct
EKFHNK

SEQ ID NO: 9982 - protein, 6 aa, synthetic construct
  REGION 1..6: note = Synthetic Construct
EKFHQK

SEQ ID NO: 9983 - protein, 6 aa, synthetic construct
  REGION 1..6: note = Synthetic Construct
EKFHRK

SEQ ID NO: 9984 - protein, 6 aa, synthetic construct
  REGION 1..6: note = Synthetic Construct
EKFHSK

SEQ ID NO: 9985 - protein, 6 aa, synthetic construct
  REGION 1..6: note = Synthetic Construct
EKFHTK

SEQ ID NO: 9986 - protein, 6 aa, synthetic construct
  REGION 1..6: note = Synthetic Construct
EKFHYK

SEQ ID NO: 9987 - protein, 6 aa, synthetic construct
  REGION 1..6: note = Synthetic Construct
EKFIAK

SEQ ID NO: 9988 - protein, 6 aa, synthetic construct
  REGION 1..6: note = Synthetic Construct
EKFIDK

SEQ ID NO: 9989 - protein, 6 aa, synthetic construct
  REGION 1..6: note = Synthetic Construct
EKFIEK

SEQ ID NO: 9990 - protein, 6 aa, synthetic construct
  REGION 1..6: note = Synthetic Construct
EKFIFK

SEQ ID NO: 9991 - protein, 6 aa, synthetic construct
  REGION 1..6: note = Synthetic Construct
EKFIGK

SEQ ID NO: 9992 - protein, 6 aa, synthetic construct
  REGION 1..6: note = Synthetic Construct
EKFIHK

SEQ ID NO: 9993 - protein, 6 aa, synthetic construct
  REGION 1..6: note = Synthetic Construct
EKFIIK

SEQ ID NO: 9994 - protein, 6 aa, synthetic construct
  REGION 1..6: note = Synthetic Construct
EKFILK

SEQ ID NO: 9995 - protein, 6 aa, synthetic construct
  REGION 1..6: note = Synthetic Construct
EKFINK

SEQ ID NO: 9996 - protein, 6 aa, synthetic construct
  REGION 1..6: note = Synthetic Construct
EKFIQK

SEQ ID NO: 9997 - protein, 6 aa, synthetic construct
  REGION 1..6: note = Synthetic Construct
EKFIRK

SEQ ID NO: 9998 - protein, 6 aa, synthetic construct
  REGION 1..6: note = Synthetic Construct
EKFISK

SEQ ID NO: 9999 - protein, 6 aa, synthetic construct
  REGION 1..6: note = Synthetic Construct
EKFITK

SEQ ID NO: 10000 - protein, 6 aa, synthetic construct
  REGION 1..6: note = Synthetic Construct
EKFIYK

SEQ ID NO: 10001 - protein, 6 aa, synthetic construct
  REGION 1..6: note = Synthetic Construct
EKFLAK

SEQ ID NO: 10002 - protein, 6 aa, synthetic construct
  REGION 1..6: note = Synthetic Construct
EKFLDK

SEQ ID NO: 10003 - protein, 6 aa, synthetic construct
  REGION 1..6: note = Synthetic Construct
EKFLEK

SEQ ID NO: 10004 - protein, 6 aa, synthetic construct
  REGION 1..6: note = Synthetic Construct
EKFLFK

SEQ ID NO: 10005 - protein, 6 aa, synthetic construct
  REGION 1..6: note = Synthetic Construct
EKFLGK

SEQ ID NO: 10006 - protein, 6 aa, synthetic construct
  REGION 1..6: note = Synthetic Construct
EKFLHK

SEQ ID NO: 10007 - protein, 6 aa, synthetic construct
  REGION 1..6: note = Synthetic Construct
EKFLIK

SEQ ID NO: 10008 - protein, 6 aa, synthetic construct
  REGION 1..6: note = Synthetic Construct
EKFLLK

SEQ ID NO: 10009 - protein, 6 aa, synthetic construct
  REGION 1..6: note = Synthetic Construct
EKFLNK

SEQ ID NO: 10010 - protein, 6 aa, synthetic construct
  REGION 1..6: note = Synthetic Construct
EKFLQK

SEQ ID NO: 10011 - protein, 6 aa, synthetic construct
  REGION 1..6: note = Synthetic Construct
EKFLRK

SEQ ID NO: 10012 - protein, 6 aa, synthetic construct
  REGION 1..6: note = Synthetic Construct
EKFLSK

SEQ ID NO: 10013 - protein, 6 aa, synthetic construct
  REGION 1..6: note = Synthetic Construct
EKFLTK

SEQ ID NO: 10014 - protein, 6 aa, synthetic construct
  REGION 1..6: note = Synthetic Construct
EKFLYK

SEQ ID NO: 10015 - protein, 6 aa, synthetic construct
  REGION 1..6: note = Synthetic Construct
EKFNAK

SEQ ID NO: 10016 - protein, 6 aa, synthetic construct
  REGION 1..6: note = Synthetic Construct
EKFNDK

SEQ ID NO: 10017 - protein, 6 aa, synthetic construct
  REGION 1..6: note = Synthetic Construct
EKFNEK

SEQ ID NO: 10018 - protein, 6 aa, synthetic construct
  REGION 1..6: note = Synthetic Construct
EKFNFK

SEQ ID NO: 10019 - protein, 6 aa, synthetic construct
  REGION 1..6: note = Synthetic Construct
EKFNGK

SEQ ID NO: 10020 - protein, 6 aa, synthetic construct
  REGION 1..6: note = Synthetic Construct
EKFNHK

SEQ ID NO: 10021 - protein, 6 aa, synthetic construct
  REGION 1..6: note = Synthetic Construct
EKFNIK

SEQ ID NO: 10022 - protein, 6 aa, synthetic construct
  REGION 1..6: note = Synthetic Construct
EKFNLK

SEQ ID NO: 10023 - protein, 6 aa, synthetic construct
  REGION 1..6: note = Synthetic Construct
EKFNNK

SEQ ID NO: 10024 - protein, 6 aa, synthetic construct
  REGION 1..6: note = Synthetic Construct
EKFNQK

SEQ ID NO: 10025 - protein, 6 aa, synthetic construct
  REGION 1..6: note = Synthetic Construct
EKFNRK

SEQ ID NO: 10026 - protein, 6 aa, synthetic construct
  REGION 1..6: note = Synthetic Construct
EKFNSK

SEQ ID NO: 10027 - protein, 6 aa, synthetic construct
  REGION 1..6: note = Synthetic Construct
EKFNTK

SEQ ID NO: 10028 - protein, 6 aa, synthetic construct
  REGION 1..6: note = Synthetic Construct
EKFNYK

SEQ ID NO: 10029 - protein, 6 aa, synthetic construct
  REGION 1..6: note = Synthetic Construct
EKFQAK

SEQ ID NO: 10030 - protein, 6 aa, synthetic construct
  REGION 1..6: note = Synthetic Construct
EKFQDK

SEQ ID NO: 10031 - protein, 6 aa, synthetic construct
  REGION 1..6: note = Synthetic Construct
EKFQEK

SEQ ID NO: 10032 - protein, 6 aa, synthetic construct
  REGION 1..6: note = Synthetic Construct
EKFQFK

SEQ ID NO: 10033 - protein, 6 aa, synthetic construct
  REGION 1..6: note = Synthetic Construct
EKFQGK

SEQ ID NO: 10034 - protein, 6 aa, synthetic construct
  REGION 1..6: note = Synthetic Construct
EKFQHK

SEQ ID NO: 10035 - protein, 6 aa, synthetic construct
  REGION 1..6: note = Synthetic Construct
EKFQIK

SEQ ID NO: 10036 - protein, 6 aa, synthetic construct
  REGION 1..6: note = Synthetic Construct
EKFQLK

SEQ ID NO: 10037 - protein, 6 aa, synthetic construct
  REGION 1..6: note = Synthetic Construct
EKFQNK

SEQ ID NO: 10038 - protein, 6 aa, synthetic construct
  REGION 1..6: note = Synthetic Construct
EKFQQK

SEQ ID NO: 10039 - protein, 6 aa, synthetic construct
  REGION 1..6: note = Synthetic Construct
EKFQRK

SEQ ID NO: 10040 - protein, 6 aa, synthetic construct
  REGION 1..6: note = Synthetic Construct
EKFQSK

SEQ ID NO: 10041 - protein, 6 aa, synthetic construct
  REGION 1..6: note = Synthetic Construct
EKFQTK

SEQ ID NO: 10042 - protein, 6 aa, synthetic construct
  REGION 1..6: note = Synthetic Construct
EKFQYK

SEQ ID NO: 10043 - protein, 6 aa, synthetic construct
  REGION 1..6: note = Synthetic Construct
EKFRAK

SEQ ID NO: 10044 - protein, 6 aa, synthetic construct
  REGION 1..6: note = Synthetic Construct
EKFRDK

SEQ ID NO: 10045 - protein, 6 aa, synthetic construct
  REGION 1..6: note = Synthetic Construct
EKFREK

SEQ ID NO: 10046 - protein, 6 aa, synthetic construct
  REGION 1..6: note = Synthetic Construct
EKFRFK

SEQ ID NO: 10047 - protein, 6 aa, synthetic construct
  REGION 1..6: note = Synthetic Construct
EKFRGK

SEQ ID NO: 10048 - protein, 6 aa, synthetic construct
  REGION 1..6: note = Synthetic Construct
EKFRHK

SEQ ID NO: 10049 - protein, 6 aa, synthetic construct
  REGION 1..6: note = Synthetic Construct
EKFRIK

SEQ ID NO: 10050 - protein, 6 aa, synthetic construct
  REGION 1..6: note = Synthetic Construct
EKFRLK

SEQ ID NO: 10051 - protein, 6 aa, synthetic construct
  REGION 1..6: note = Synthetic Construct
EKFRNK

SEQ ID NO: 10052 - protein, 6 aa, synthetic construct
  REGION 1..6: note = Synthetic Construct
EKFRQK

SEQ ID NO: 10053 - protein, 6 aa, synthetic construct
  REGION 1..6: note = Synthetic Construct
EKFRRK

SEQ ID NO: 10054 - protein, 6 aa, synthetic construct
  REGION 1..6: note = Synthetic Construct
EKFRSK

SEQ ID NO: 10055 - protein, 6 aa, synthetic construct
  REGION 1..6: note = Synthetic Construct
EKFRTK

SEQ ID NO: 10056 - protein, 6 aa, synthetic construct
  REGION 1..6: note = Synthetic Construct
EKFRYK

SEQ ID NO: 10057 - protein, 6 aa, synthetic construct
  REGION 1..6: note = Synthetic Construct
EKFSAK

SEQ ID NO: 10058 - protein, 6 aa, synthetic construct
  REGION 1..6: note = Synthetic Construct
EKFSDK

SEQ ID NO: 10059 - protein, 6 aa, synthetic construct
  REGION 1..6: note = Synthetic Construct
EKFSEK

SEQ ID NO: 10060 - protein, 6 aa, synthetic construct
  REGION 1..6: note = Synthetic Construct
EKFSFK

SEQ ID NO: 10061 - protein, 6 aa, synthetic construct
  REGION 1..6: note = Synthetic Construct
EKFSGK

SEQ ID NO: 10062 - protein, 6 aa, synthetic construct
  REGION 1..6: note = Synthetic Construct
EKFSHK

SEQ ID NO: 10063 - protein, 6 aa, synthetic construct
  REGION 1..6: note = Synthetic Construct
EKFSIK

SEQ ID NO: 10064 - protein, 6 aa, synthetic construct
  REGION 1..6: note = Synthetic Construct
EKFSLK

SEQ ID NO: 10065 - protein, 6 aa, synthetic construct
  REGION 1..6: note = Synthetic Construct
EKFSNK

SEQ ID NO: 10066 - protein, 6 aa, synthetic construct
  REGION 1..6: note = Synthetic Construct
EKFSQK

SEQ ID NO: 10067 - protein, 6 aa, synthetic construct
  REGION 1..6: note = Synthetic Construct
EKFSRK

SEQ ID NO: 10068 - protein, 6 aa, synthetic construct
  REGION 1..6: note = Synthetic Construct
EKFSSK

SEQ ID NO: 10069 - protein, 6 aa, synthetic construct
  REGION 1..6: note = Synthetic Construct
EKFSTK

SEQ ID NO: 10070 - protein, 6 aa, synthetic construct
  REGION 1..6: note = Synthetic Construct
EKFSYK

SEQ ID NO: 10071 - protein, 6 aa, synthetic construct
  REGION 1..6: note = Synthetic Construct
EKFTAK

SEQ ID NO: 10072 - protein, 6 aa, synthetic construct
  REGION 1..6: note = Synthetic Construct
EKFTDK

SEQ ID NO: 10073 - protein, 6 aa, synthetic construct
  REGION 1..6: note = Synthetic Construct
EKFTEK

SEQ ID NO: 10074 - protein, 6 aa, synthetic construct
  REGION 1..6: note = Synthetic Construct
EKFTFK

SEQ ID NO: 10075 - protein, 6 aa, synthetic construct
  REGION 1..6: note = Synthetic Construct
EKFTGK

SEQ ID NO: 10076 - protein, 6 aa, synthetic construct
  REGION 1..6: note = Synthetic Construct
EKFTHK

SEQ ID NO: 10077 - protein, 6 aa, synthetic construct
  REGION 1..6: note = Synthetic Construct
EKFTIK

SEQ ID NO: 10078 - protein, 6 aa, synthetic construct
  REGION 1..6: note = Synthetic Construct
EKFTLK

SEQ ID NO: 10079 - protein, 6 aa, synthetic construct
  REGION 1..6: note = Synthetic Construct
EKFTNK

SEQ ID NO: 10080 - protein, 6 aa, synthetic construct
  REGION 1..6: note = Synthetic Construct
EKFTQK

SEQ ID NO: 10081 - protein, 6 aa, synthetic construct
  REGION 1..6: note = Synthetic Construct
EKFTRK

SEQ ID NO: 10082 - protein, 6 aa, synthetic construct
  REGION 1..6: note = Synthetic Construct
EKFTSK

SEQ ID NO: 10083 - protein, 6 aa, synthetic construct
  REGION 1..6: note = Synthetic Construct
EKFTTK

SEQ ID NO: 10084 - protein, 6 aa, synthetic construct
  REGION 1..6: note = Synthetic Construct
EKFTYK

SEQ ID NO: 10085 - protein, 6 aa, synthetic construct
  REGION 1..6: note = Synthetic Construct
EKFYAK

SEQ ID NO: 10086 - protein, 6 aa, synthetic construct
  REGION 1..6: note = Synthetic Construct
EKFYDK

SEQ ID NO: 10087 - protein, 6 aa, synthetic construct
  REGION 1..6: note = Synthetic Construct
EKFYEK

SEQ ID NO: 10088 - protein, 6 aa, synthetic construct
  REGION 1..6: note = Synthetic Construct
EKFYFK

SEQ ID NO: 10089 - protein, 6 aa, synthetic construct
  REGION 1..6: note = Synthetic Construct
EKFYGK

SEQ ID NO: 10090 - protein, 6 aa, synthetic construct
  REGION 1..6: note = Synthetic Construct
EKFYHK

SEQ ID NO: 10091 - protein, 6 aa, synthetic construct
  REGION 1..6: note = Synthetic Construct
EKFYIK

SEQ ID NO: 10092 - protein, 6 aa, synthetic construct
  REGION 1..6: note = Synthetic Construct
EKFYLK

SEQ ID NO: 10093 - protein, 6 aa, synthetic construct
  REGION 1..6: note = Synthetic Construct
EKFYNK

SEQ ID NO: 10094 - protein, 6 aa, synthetic construct
  REGION 1..6: note = Synthetic Construct
EKFYQK

SEQ ID NO: 10095 - protein, 6 aa, synthetic construct
  REGION 1..6: note = Synthetic Construct
EKFYRK

SEQ ID NO: 10096 - protein, 6 aa, synthetic construct
  REGION 1..6: note = Synthetic Construct
EKFYSK

SEQ ID NO: 10097 - protein, 6 aa, synthetic construct
  REGION 1..6: note = Synthetic Construct
EKFYTK

SEQ ID NO: 10098 - protein, 6 aa, synthetic construct
  REGION 1..6: note = Synthetic Construct
EKFYYK

SEQ ID NO: 10099 - protein, 6 aa, synthetic construct
  REGION 1..6: note = Synthetic Construct
EKGAAK

SEQ ID NO: 10100 - protein, 6 aa, synthetic construct
  REGION 1..6: note = Synthetic Construct
EKGADK

SEQ ID NO: 10101 - protein, 6 aa, synthetic construct
  REGION 1..6: note = Synthetic Construct
EKGAEK

SEQ ID NO: 10102 - protein, 6 aa, synthetic construct
  REGION 1..6: note = Synthetic Construct
EKGAFK

SEQ ID NO: 10103 - protein, 6 aa, synthetic construct
  REGION 1..6: note = Synthetic Construct
EKGAGK

SEQ ID NO: 10104 - protein, 6 aa, synthetic construct
  REGION 1..6: note = Synthetic Construct
EKGAHK

SEQ ID NO: 10105 - protein, 6 aa, synthetic construct
  REGION 1..6: note = Synthetic Construct
EKGAIK

SEQ ID NO: 10106 - protein, 6 aa, synthetic construct
  REGION 1..6: note = Synthetic Construct
EKGALK

SEQ ID NO: 10107 - protein, 6 aa, synthetic construct
  REGION 1..6: note = Synthetic Construct
EKGANK

SEQ ID NO: 10108 - protein, 6 aa, synthetic construct
  REGION 1..6: note = Synthetic Construct
EKGAQK

SEQ ID NO: 10109 - protein, 6 aa, synthetic construct
  REGION 1..6: note = Synthetic Construct
EKGARK

SEQ ID NO: 10110 - protein, 6 aa, synthetic construct
  REGION 1..6: note = Synthetic Construct
EKGASK

SEQ ID NO: 10111 - protein, 6 aa, synthetic construct
  REGION 1..6: note = Synthetic Construct
EKGATK

SEQ ID NO: 10112 - protein, 6 aa, synthetic construct
  REGION 1..6: note = Synthetic Construct
EKGAYK

SEQ ID NO: 10113 - protein, 6 aa, synthetic construct
  REGION 1..6: note = Synthetic Construct
EKGDAK

SEQ ID NO: 10114 - protein, 6 aa, synthetic construct
  REGION 1..6: note = Synthetic Construct
EKGDDK

SEQ ID NO: 10115 - protein, 6 aa, synthetic construct
  REGION 1..6: note = Synthetic Construct
EKGDEK

SEQ ID NO: 10116 - protein, 6 aa, synthetic construct
  REGION 1..6: note = Synthetic Construct
EKGDFK

SEQ ID NO: 10117 - protein, 6 aa, synthetic construct
  REGION 1..6: note = Synthetic Construct
EKGDGK

SEQ ID NO: 10118 - protein, 6 aa, synthetic construct
  REGION 1..6: note = Synthetic Construct
EKGDHK

SEQ ID NO: 10119 - protein, 6 aa, synthetic construct
  REGION 1..6: note = Synthetic Construct
EKGDIK

SEQ ID NO: 10120 - protein, 6 aa, synthetic construct
  REGION 1..6: note = Synthetic Construct
EKGDLK

SEQ ID NO: 10121 - protein, 6 aa, synthetic construct
  REGION 1..6: note = Synthetic Construct
EKGDNK

SEQ ID NO: 10122 - protein, 6 aa, synthetic construct
  REGION 1..6: note = Synthetic Construct
EKGDQK

SEQ ID NO: 10123 - protein, 6 aa, synthetic construct
  REGION 1..6: note = Synthetic Construct
EKGDRK

SEQ ID NO: 10124 - protein, 6 aa, synthetic construct
  REGION 1..6: note = Synthetic Construct
EKGDSK

SEQ ID NO: 10125 - protein, 6 aa, synthetic construct
  REGION 1..6: note = Synthetic Construct
EKGDTK

SEQ ID NO: 10126 - protein, 6 aa, synthetic construct
  REGION 1..6: note = Synthetic Construct
EKGDYK

SEQ ID NO: 10127 - protein, 6 aa, synthetic construct
  REGION 1..6: note = Synthetic Construct
EKGEAK

SEQ ID NO: 10128 - protein, 6 aa, synthetic construct
  REGION 1..6: note = Synthetic Construct
EKGEDK

SEQ ID NO: 10129 - protein, 6 aa, synthetic construct
  REGION 1..6: note = Synthetic Construct
EKGEEK

SEQ ID NO: 10130 - protein, 6 aa, synthetic construct
  REGION 1..6: note = Synthetic Construct
EKGEFK

SEQ ID NO: 10131 - protein, 6 aa, synthetic construct
  REGION 1..6: note = Synthetic Construct
EKGEGK

SEQ ID NO: 10132 - protein, 6 aa, synthetic construct
  REGION 1..6: note = Synthetic Construct
EKGEHK

SEQ ID NO: 10133 - protein, 6 aa, synthetic construct
  REGION 1..6: note = Synthetic Construct
EKGEIK

SEQ ID NO: 10134 - protein, 6 aa, synthetic construct
  REGION 1..6: note = Synthetic Construct
EKGELK

SEQ ID NO: 10135 - protein, 6 aa, synthetic construct
  REGION 1..6: note = Synthetic Construct
EKGENK

SEQ ID NO: 10136 - protein, 6 aa, synthetic construct
  REGION 1..6: note = Synthetic Construct
EKGEQK

SEQ ID NO: 10137 - protein, 6 aa, synthetic construct
  REGION 1..6: note = Synthetic Construct
EKGERK

SEQ ID NO: 10138 - protein, 6 aa, synthetic construct
  REGION 1..6: note = Synthetic Construct
EKGESK

SEQ ID NO: 10139 - protein, 6 aa, synthetic construct
  REGION 1..6: note = Synthetic Construct
EKGETK

SEQ ID NO: 10140 - protein, 6 aa, synthetic construct
  REGION 1..6: note = Synthetic Construct
EKGEYK

SEQ ID NO: 10141 - protein, 6 aa, synthetic construct
  REGION 1..6: note = Synthetic Construct
EKGFAK

SEQ ID NO: 10142 - protein, 6 aa, synthetic construct
  REGION 1..6: note = Synthetic Construct
EKGFDK

SEQ ID NO: 10143 - protein, 6 aa, synthetic construct
  REGION 1..6: note = Synthetic Construct
EKGFEK

SEQ ID NO: 10144 - protein, 6 aa, synthetic construct
  REGION 1..6: note = Synthetic Construct
EKGFFK

SEQ ID NO: 10145 - protein, 6 aa, synthetic construct
  REGION 1..6: note = Synthetic Construct
EKGFGK

SEQ ID NO: 10146 - protein, 6 aa, synthetic construct
  REGION 1..6: note = Synthetic Construct
EKGFHK

SEQ ID NO: 10147 - protein, 6 aa, synthetic construct
  REGION 1..6: note = Synthetic Construct
EKGFIK

SEQ ID NO: 10148 - protein, 6 aa, synthetic construct
  REGION 1..6: note = Synthetic Construct
EKGFLK

SEQ ID NO: 10149 - protein, 6 aa, synthetic construct
  REGION 1..6: note = Synthetic Construct
EKGFNK

SEQ ID NO: 10150 - protein, 6 aa, synthetic construct
  REGION 1..6: note = Synthetic Construct
EKGFQK

SEQ ID NO: 10151 - protein, 6 aa, synthetic construct
  REGION 1..6: note = Synthetic Construct
EKGFRK

SEQ ID NO: 10152 - protein, 6 aa, synthetic construct
  REGION 1..6: note = Synthetic Construct
EKGFSK

SEQ ID NO: 10153 - protein, 6 aa, synthetic construct
  REGION 1..6: note = Synthetic Construct
EKGFTK

SEQ ID NO: 10154 - protein, 6 aa, synthetic construct
  REGION 1..6: note = Synthetic Construct
EKGFYK

SEQ ID NO: 10155 - protein, 6 aa, synthetic construct
  REGION 1..6: note = Synthetic Construct
EKGGAK

SEQ ID NO: 10156 - protein, 6 aa, synthetic construct
  REGION 1..6: note = Synthetic Construct
EKGGDK

SEQ ID NO: 10157 - protein, 6 aa, synthetic construct
  REGION 1..6: note = Synthetic Construct
EKGGEK

SEQ ID NO: 10158 - protein, 6 aa, synthetic construct
  REGION 1..6: note = Synthetic Construct
EKGGFK

SEQ ID NO: 10159 - protein, 6 aa, synthetic construct
  REGION 1..6: note = Synthetic Construct
EKGGGK

SEQ ID NO: 10160 - protein, 6 aa, synthetic construct
  REGION 1..6: note = Synthetic Construct
EKGGHK

SEQ ID NO: 10161 - protein, 6 aa, synthetic construct
  REGION 1..6: note = Synthetic Construct
EKGGIK

SEQ ID NO: 10162 - protein, 6 aa, synthetic construct
  REGION 1..6: note = Synthetic Construct
EKGGLK

SEQ ID NO: 10163 - protein, 6 aa, synthetic construct
  REGION 1..6: note = Synthetic Construct
EKGGNK

SEQ ID NO: 10164 - protein, 6 aa, synthetic construct
  REGION 1..6: note = Synthetic Construct
EKGGQK

SEQ ID NO: 10165 - protein, 6 aa, synthetic construct
  REGION 1..6: note = Synthetic Construct
EKGGRK

SEQ ID NO: 10166 - protein, 6 aa, synthetic construct
  REGION 1..6: note = Synthetic Construct
EKGGSK

SEQ ID NO: 10167 - protein, 6 aa, synthetic construct
  REGION 1..6: note = Synthetic Construct
EKGGTK

SEQ ID NO: 10168 - protein, 6 aa, synthetic construct
  REGION 1..6: note = Synthetic Construct
EKGGYK

SEQ ID NO: 10169 - protein, 6 aa, synthetic construct
  REGION 1..6: note = Synthetic Construct
EKGHAK

SEQ ID NO: 10170 - protein, 6 aa, synthetic construct
  REGION 1..6: note = Synthetic Construct
EKGHDK

SEQ ID NO: 10171 - protein, 6 aa, synthetic construct
  REGION 1..6: note = Synthetic Construct
EKGHEK

SEQ ID NO: 10172 - protein, 6 aa, synthetic construct
  REGION 1..6: note = Synthetic Construct
EKGHFK

SEQ ID NO: 10173 - protein, 6 aa, synthetic construct
  REGION 1..6: note = Synthetic Construct
EKGHGK

SEQ ID NO: 10174 - protein, 6 aa, synthetic construct
  REGION 1..6: note = Synthetic Construct
EKGHHK

SEQ ID NO: 10175 - protein, 6 aa, synthetic construct
  REGION 1..6: note = Synthetic Construct
EKGHIK

SEQ ID NO: 10176 - protein, 6 aa, synthetic construct
  REGION 1..6: note = Synthetic Construct
EKGHLK

SEQ ID NO: 10177 - protein, 6 aa, synthetic construct
  REGION 1..6: note = Synthetic Construct
EKGHNK

SEQ ID NO: 10178 - protein, 6 aa, synthetic construct
  REGION 1..6: note = Synthetic Construct
EKGHQK

SEQ ID NO: 10179 - protein, 6 aa, synthetic construct
  REGION 1..6: note = Synthetic Construct
EKGHRK

SEQ ID NO: 10180 - protein, 6 aa, synthetic construct
  REGION 1..6: note = Synthetic Construct
EKGHSK

SEQ ID NO: 10181 - protein, 6 aa, synthetic construct
  REGION 1..6: note = Synthetic Construct
EKGHTK

SEQ ID NO: 10182 - protein, 6 aa, synthetic construct
  REGION 1..6: note = Synthetic Construct
EKGHYK

SEQ ID NO: 10183 - protein, 6 aa, synthetic construct
  REGION 1..6: note = Synthetic Construct
EKGIAK

SEQ ID NO: 10184 - protein, 6 aa, synthetic construct
  REGION 1..6: note = Synthetic Construct
EKGIDK

SEQ ID NO: 10185 - protein, 6 aa, synthetic construct
  REGION 1..6: note = Synthetic Construct
EKGIEK

SEQ ID NO: 10186 - protein, 6 aa, synthetic construct
  REGION 1..6: note = Synthetic Construct
EKGIFK

SEQ ID NO: 10187 - protein, 6 aa, synthetic construct
  REGION 1..6: note = Synthetic Construct
EKGIGK

SEQ ID NO: 10188 - protein, 6 aa, synthetic construct
  REGION 1..6: note = Synthetic Construct
EKGIHK

SEQ ID NO: 10189 - protein, 6 aa, synthetic construct
  REGION 1..6: note = Synthetic Construct
EKGIIK

SEQ ID NO: 10190 - protein, 6 aa, synthetic construct
  REGION 1..6: note = Synthetic Construct
EKGILK

SEQ ID NO: 10191 - protein, 6 aa, synthetic construct
  REGION 1..6: note = Synthetic Construct
EKGINK

SEQ ID NO: 10192 - protein, 6 aa, synthetic construct
  REGION 1..6: note = Synthetic Construct
EKGIQK

SEQ ID NO: 10193 - protein, 6 aa, synthetic construct
  REGION 1..6: note = Synthetic Construct
EKGIRK

SEQ ID NO: 10194 - protein, 6 aa, synthetic construct
  REGION 1..6: note = Synthetic Construct
EKGISK

SEQ ID NO: 10195 - protein, 6 aa, synthetic construct
  REGION 1..6: note = Synthetic Construct
EKGITK

SEQ ID NO: 10196 - protein, 6 aa, synthetic construct
  REGION 1..6: note = Synthetic Construct
EKGIYK

SEQ ID NO: 10197 - protein, 6 aa, synthetic construct
  REGION 1..6: note = Synthetic Construct
EKGLAK

SEQ ID NO: 10198 - protein, 6 aa, synthetic construct
  REGION 1..6: note = Synthetic Construct
EKGLDK

SEQ ID NO: 10199 - protein, 6 aa, synthetic construct
  REGION 1..6: note = Synthetic Construct
EKGLEK

SEQ ID NO: 10200 - protein, 6 aa, synthetic construct
  REGION 1..6: note = Synthetic Construct
EKGLFK

SEQ ID NO: 10201 - protein, 6 aa, synthetic construct
  REGION 1..6: note = Synthetic Construct
EKGLGK

SEQ ID NO: 10202 - protein, 6 aa, synthetic construct
  REGION 1..6: note = Synthetic Construct
EKGLHK

SEQ ID NO: 10203 - protein, 6 aa, synthetic construct
  REGION 1..6: note = Synthetic Construct
EKGLIK

SEQ ID NO: 10204 - protein, 6 aa, synthetic construct
  REGION 1..6: note = Synthetic Construct
EKGLLK

SEQ ID NO: 10205 - protein, 6 aa, synthetic construct
  REGION 1..6: note = Synthetic Construct
EKGLNK

SEQ ID NO: 10206 - protein, 6 aa, synthetic construct
  REGION 1..6: note = Synthetic Construct
EKGLQK

SEQ ID NO: 10207 - protein, 6 aa, synthetic construct
  REGION 1..6: note = Synthetic Construct
EKGLRK

SEQ ID NO: 10208 - protein, 6 aa, synthetic construct
  REGION 1..6: note = Synthetic Construct
EKGLSK

SEQ ID NO: 10209 - protein, 6 aa, synthetic construct
  REGION 1..6: note = Synthetic Construct
EKGLTK

SEQ ID NO: 10210 - protein, 6 aa, synthetic construct
  REGION 1..6: note = Synthetic Construct
EKGLYK

SEQ ID NO: 10211 - protein, 6 aa, synthetic construct
  REGION 1..6: note = Synthetic Construct
EKGNAK

SEQ ID NO: 10212 - protein, 6 aa, synthetic construct
  REGION 1..6: note = Synthetic Construct
EKGNDK

SEQ ID NO: 10213 - protein, 6 aa, synthetic construct
  REGION 1..6: note = Synthetic Construct
EKGNEK

SEQ ID NO: 10214 - protein, 6 aa, synthetic construct
  REGION 1..6: note = Synthetic Construct
EKGNFK

SEQ ID NO: 10215 - protein, 6 aa, synthetic construct
  REGION 1..6: note = Synthetic Construct
EKGNGK

SEQ ID NO: 10216 - protein, 6 aa, synthetic construct
  REGION 1..6: note = Synthetic Construct
EKGNHK

SEQ ID NO: 10217 - protein, 6 aa, synthetic construct
  REGION 1..6: note = Synthetic Construct
EKGNIK

SEQ ID NO: 10218 - protein, 6 aa, synthetic construct
  REGION 1..6: note = Synthetic Construct
EKGNLK

SEQ ID NO: 10219 - protein, 6 aa, synthetic construct
  REGION 1..6: note = Synthetic Construct
EKGNNK

SEQ ID NO: 10220 - protein, 6 aa, synthetic construct
  REGION 1..6: note = Synthetic Construct
EKGNQK

SEQ ID NO: 10221 - protein, 6 aa, synthetic construct
  REGION 1..6: note = Synthetic Construct
EKGNRK

SEQ ID NO: 10222 - protein, 6 aa, synthetic construct
  REGION 1..6: note = Synthetic Construct
EKGNSK

SEQ ID NO: 10223 - protein, 6 aa, synthetic construct
  REGION 1..6: note = Synthetic Construct
EKGNTK

SEQ ID NO: 10224 - protein, 6 aa, synthetic construct
  REGION 1..6: note = Synthetic Construct
EKGNYK

SEQ ID NO: 10225 - protein, 6 aa, synthetic construct
  REGION 1..6: note = Synthetic Construct
EKGQAK

SEQ ID NO: 10226 - protein, 6 aa, synthetic construct
  REGION 1..6: note = Synthetic Construct
EKGQDK

SEQ ID NO: 10227 - protein, 6 aa, synthetic construct
  REGION 1..6: note = Synthetic Construct
EKGQEK

SEQ ID NO: 10228 - protein, 6 aa, synthetic construct
  REGION 1..6: note = Synthetic Construct
EKGQFK

SEQ ID NO: 10229 - protein, 6 aa, synthetic construct
  REGION 1..6: note = Synthetic Construct
EKGQGK

SEQ ID NO: 10230 - protein, 6 aa, synthetic construct
  REGION 1..6: note = Synthetic Construct
EKGQHK

SEQ ID NO: 10231 - protein, 6 aa, synthetic construct
  REGION 1..6: note = Synthetic Construct
EKGQIK

SEQ ID NO: 10232 - protein, 6 aa, synthetic construct
  REGION 1..6: note = Synthetic Construct
EKGQLK

SEQ ID NO: 10233 - protein, 6 aa, synthetic construct
  REGION 1..6: note = Synthetic Construct
EKGQNK

SEQ ID NO: 10234 - protein, 6 aa, synthetic construct
  REGION 1..6: note = Synthetic Construct
EKGQQK

SEQ ID NO: 10235 - protein, 6 aa, synthetic construct
  REGION 1..6: note = Synthetic Construct
EKGQRK

SEQ ID NO: 10236 - protein, 6 aa, synthetic construct
  REGION 1..6: note = Synthetic Construct
EKGQSK

SEQ ID NO: 10237 - protein, 6 aa, synthetic construct
  REGION 1..6: note = Synthetic Construct
EKGQTK

SEQ ID NO: 10238 - protein, 6 aa, synthetic construct
  REGION 1..6: note = Synthetic Construct
EKGQYK

SEQ ID NO: 10239 - protein, 6 aa, synthetic construct
  REGION 1..6: note = Synthetic Construct
EKGRAK

SEQ ID NO: 10240 - protein, 6 aa, synthetic construct
  REGION 1..6: note = Synthetic Construct
EKGRDK

SEQ ID NO: 10241 - protein, 6 aa, synthetic construct
  REGION 1..6: note = Synthetic Construct
EKGREK

SEQ ID NO: 10242 - protein, 6 aa, synthetic construct
  REGION 1..6: note = Synthetic Construct
EKGRFK

SEQ ID NO: 10243 - protein, 6 aa, synthetic construct
  REGION 1..6: note = Synthetic Construct
EKGRGK

SEQ ID NO: 10244 - protein, 6 aa, synthetic construct
  REGION 1..6: note = Synthetic Construct
EKGRHK

SEQ ID NO: 10245 - protein, 6 aa, synthetic construct
  REGION 1..6: note = Synthetic Construct
EKGRIK

SEQ ID NO: 10246 - protein, 6 aa, synthetic construct
  REGION 1..6: note = Synthetic Construct
EKGRLK

SEQ ID NO: 10247 - protein, 6 aa, synthetic construct
  REGION 1..6: note = Synthetic Construct
EKGRNK

SEQ ID NO: 10248 - protein, 6 aa, synthetic construct
  REGION 1..6: note = Synthetic Construct
EKGRQK

SEQ ID NO: 10249 - protein, 6 aa, synthetic construct
  REGION 1..6: note = Synthetic Construct
EKGRRK

SEQ ID NO: 10250 - protein, 6 aa, synthetic construct
  REGION 1..6: note = Synthetic Construct
EKGRSK

SEQ ID NO: 10251 - protein, 6 aa, synthetic construct
  REGION 1..6: note = Synthetic Construct
EKGRTK

SEQ ID NO: 10252 - protein, 6 aa, synthetic construct
  REGION 1..6: note = Synthetic Construct
EKGRYK

SEQ ID NO: 10253 - protein, 6 aa, synthetic construct
  REGION 1..6: note = Synthetic Construct
EKGSAK

SEQ ID NO: 10254 - protein, 6 aa, synthetic construct
  REGION 1..6: note = Synthetic Construct
EKGSDK

SEQ ID NO: 10255 - protein, 6 aa, synthetic construct
  REGION 1..6: note = Synthetic Construct
EKGSEK

SEQ ID NO: 10256 - protein, 6 aa, synthetic construct
  REGION 1..6: note = Synthetic Construct
EKGSFK

SEQ ID NO: 10257 - protein, 6 aa, synthetic construct
  REGION 1..6: note = Synthetic Construct
EKGSGK

SEQ ID NO: 10258 - protein, 6 aa, synthetic construct
  REGION 1..6: note = Synthetic Construct
EKGSHK

SEQ ID NO: 10259 - protein, 6 aa, synthetic construct
  REGION 1..6: note = Synthetic Construct
EKGSIK

SEQ ID NO: 10260 - protein, 6 aa, synthetic construct
  REGION 1..6: note = Synthetic Construct
EKGSLK

SEQ ID NO: 10261 - protein, 6 aa, synthetic construct
  REGION 1..6: note = Synthetic Construct
EKGSNK

SEQ ID NO: 10262 - protein, 6 aa, synthetic construct
  REGION 1..6: note = Synthetic Construct
EKGSQK

SEQ ID NO: 10263 - protein, 6 aa, synthetic construct
  REGION 1..6: note = Synthetic Construct
EKGSRK

SEQ ID NO: 10264 - protein, 6 aa, synthetic construct
  REGION 1..6: note = Synthetic Construct
EKGSSK

SEQ ID NO: 10265 - protein, 6 aa, synthetic construct
  REGION 1..6: note = Synthetic Construct
EKGSTK

SEQ ID NO: 10266 - protein, 6 aa, synthetic construct
  REGION 1..6: note = Synthetic Construct
EKGSYK

SEQ ID NO: 10267 - protein, 6 aa, synthetic construct
  REGION 1..6: note = Synthetic Construct
EKGTAK

SEQ ID NO: 10268 - protein, 6 aa, synthetic construct
  REGION 1..6: note = Synthetic Construct
EKGTDK

SEQ ID NO: 10269 - protein, 6 aa, synthetic construct
  REGION 1..6: note = Synthetic Construct
EKGTEK

SEQ ID NO: 10270 - protein, 6 aa, synthetic construct
  REGION 1..6: note = Synthetic Construct
EKGTFK

SEQ ID NO: 10271 - protein, 6 aa, synthetic construct
  REGION 1..6: note = Synthetic Construct
EKGTGK

SEQ ID NO: 10272 - protein, 6 aa, synthetic construct
  REGION 1..6: note = Synthetic Construct
EKGTHK

SEQ ID NO: 10273 - protein, 6 aa, synthetic construct
  REGION 1..6: note = Synthetic Construct
EKGTIK

SEQ ID NO: 10274 - protein, 6 aa, synthetic construct
  REGION 1..6: note = Synthetic Construct
EKGTLK

SEQ ID NO: 10275 - protein, 6 aa, synthetic construct
  REGION 1..6: note = Synthetic Construct
EKGTNK

SEQ ID NO: 10276 - protein, 6 aa, synthetic construct
  REGION 1..6: note = Synthetic Construct
EKGTQK

SEQ ID NO: 10277 - protein, 6 aa, synthetic construct
  REGION 1..6: note = Synthetic Construct
EKGTRK

SEQ ID NO: 10278 - protein, 6 aa, synthetic construct
  REGION 1..6: note = Synthetic Construct
EKGTSK

SEQ ID NO: 10279 - protein, 6 aa, synthetic construct
  REGION 1..6: note = Synthetic Construct
EKGTTK

SEQ ID NO: 10280 - protein, 6 aa, synthetic construct
  REGION 1..6: note = Synthetic Construct
EKGTYK

SEQ ID NO: 10281 - protein, 6 aa, synthetic construct
  REGION 1..6: note = Synthetic Construct
EKGYAK

SEQ ID NO: 10282 - protein, 6 aa, synthetic construct
  REGION 1..6: note = Synthetic Construct
EKGYDK

SEQ ID NO: 10283 - protein, 6 aa, synthetic construct
  REGION 1..6: note = Synthetic Construct
EKGYEK

SEQ ID NO: 10284 - protein, 6 aa, synthetic construct
  REGION 1..6: note = Synthetic Construct
EKGYFK

SEQ ID NO: 10285 - protein, 6 aa, synthetic construct
  REGION 1..6: note = Synthetic Construct
EKGYGK

SEQ ID NO: 10286 - protein, 6 aa, synthetic construct
  REGION 1..6: note = Synthetic Construct
EKGYHK

SEQ ID NO: 10287 - protein, 6 aa, synthetic construct
  REGION 1..6: note = Synthetic Construct
EKGYIK

SEQ ID NO: 10288 - protein, 6 aa, synthetic construct
  REGION 1..6: note = Synthetic Construct
EKGYLK

SEQ ID NO: 10289 - protein, 6 aa, synthetic construct
  REGION 1..6: note = Synthetic Construct
EKGYNK

SEQ ID NO: 10290 - protein, 6 aa, synthetic construct
  REGION 1..6: note = Synthetic Construct
EKGYQK

SEQ ID NO: 10291 - protein, 6 aa, synthetic construct
  REGION 1..6: note = Synthetic Construct
EKGYRK

SEQ ID NO: 10292 - protein, 6 aa, synthetic construct
  REGION 1..6: note = Synthetic Construct
EKGYSK

SEQ ID NO: 10293 - protein, 6 aa, synthetic construct
  REGION 1..6: note = Synthetic Construct
EKGYTK

SEQ ID NO: 10294 - protein, 6 aa, synthetic construct
  REGION 1..6: note = Synthetic Construct
EKGYYK

SEQ ID NO: 10295 - protein, 6 aa, synthetic construct
  REGION 1..6: note = Synthetic Construct
EKHAAK

SEQ ID NO: 10296 - protein, 6 aa, synthetic construct
  REGION 1..6: note = Synthetic Construct
EKHADK

SEQ ID NO: 10297 - protein, 6 aa, synthetic construct
  REGION 1..6: note = Synthetic Construct
EKHAEK

SEQ ID NO: 10298 - protein, 6 aa, synthetic construct
  REGION 1..6: note = Synthetic Construct
EKHAFK

SEQ ID NO: 10299 - protein, 6 aa, synthetic construct
  REGION 1..6: note = Synthetic Construct
EKHAGK

SEQ ID NO: 10300 - protein, 6 aa, synthetic construct
  REGION 1..6: note = Synthetic Construct
EKHAHK

SEQ ID NO: 10301 - protein, 6 aa, synthetic construct
  REGION 1..6: note = Synthetic Construct
EKHAIK

SEQ ID NO: 10302 - protein, 6 aa, synthetic construct
  REGION 1..6: note = Synthetic Construct
EKHALK

SEQ ID NO: 10303 - protein, 6 aa, synthetic construct
  REGION 1..6: note = Synthetic Construct
EKHANK

SEQ ID NO: 10304 - protein, 6 aa, synthetic construct
  REGION 1..6: note = Synthetic Construct
EKHAQK

SEQ ID NO: 10305 - protein, 6 aa, synthetic construct
  REGION 1..6: note = Synthetic Construct
EKHARK

SEQ ID NO: 10306 - protein, 6 aa, synthetic construct
  REGION 1..6: note = Synthetic Construct
EKHASK

SEQ ID NO: 10307 - protein, 6 aa, synthetic construct
  REGION 1..6: note = Synthetic Construct
EKHATK

SEQ ID NO: 10308 - protein, 6 aa, synthetic construct
  REGION 1..6: note = Synthetic Construct
EKHAYK

SEQ ID NO: 10309 - protein, 6 aa, synthetic construct
  REGION 1..6: note = Synthetic Construct
EKHDAK

SEQ ID NO: 10310 - protein, 6 aa, synthetic construct
  REGION 1..6: note = Synthetic Construct
EKHDDK

SEQ ID NO: 10311 - protein, 6 aa, synthetic construct
  REGION 1..6: note = Synthetic Construct
EKHDEK

SEQ ID NO: 10312 - protein, 6 aa, synthetic construct
  REGION 1..6: note = Synthetic Construct
EKHDFK

SEQ ID NO: 10313 - protein, 6 aa, synthetic construct
  REGION 1..6: note = Synthetic Construct
EKHDGK

SEQ ID NO: 10314 - protein, 6 aa, synthetic construct
  REGION 1..6: note = Synthetic Construct
EKHDHK

SEQ ID NO: 10315 - protein, 6 aa, synthetic construct
  REGION 1..6: note = Synthetic Construct
EKHDIK

SEQ ID NO: 10316 - protein, 6 aa, synthetic construct
  REGION 1..6: note = Synthetic Construct
EKHDLK

SEQ ID NO: 10317 - protein, 6 aa, synthetic construct
  REGION 1..6: note = Synthetic Construct
EKHDNK

SEQ ID NO: 10318 - protein, 6 aa, synthetic construct
  REGION 1..6: note = Synthetic Construct
EKHDQK

SEQ ID NO: 10319 - protein, 6 aa, synthetic construct
  REGION 1..6: note = Synthetic Construct
EKHDRK

SEQ ID NO: 10320 - protein, 6 aa, synthetic construct
  REGION 1..6: note = Synthetic Construct
EKHDSK

SEQ ID NO: 10321 - protein, 6 aa, synthetic construct
  REGION 1..6: note = Synthetic Construct
EKHDTK

SEQ ID NO: 10322 - protein, 6 aa, synthetic construct
  REGION 1..6: note = Synthetic Construct
EKHDYK

SEQ ID NO: 10323 - protein, 6 aa, synthetic construct
  REGION 1..6: note = Synthetic Construct
EKHEAK

SEQ ID NO: 10324 - protein, 6 aa, synthetic construct
  REGION 1..6: note = Synthetic Construct
EKHEDK

SEQ ID NO: 10325 - protein, 6 aa, synthetic construct
  REGION 1..6: note = Synthetic Construct
EKHEEK

SEQ ID NO: 10326 - protein, 6 aa, synthetic construct
  REGION 1..6: note = Synthetic Construct
EKHEFK

SEQ ID NO: 10327 - protein, 6 aa, synthetic construct
  REGION 1..6: note = Synthetic Construct
EKHEGK

SEQ ID NO: 10328 - protein, 6 aa, synthetic construct
  REGION 1..6: note = Synthetic Construct
EKHEHK

SEQ ID NO: 10329 - protein, 6 aa, synthetic construct
  REGION 1..6: note = Synthetic Construct
EKHEIK

SEQ ID NO: 10330 - protein, 6 aa, synthetic construct
  REGION 1..6: note = Synthetic Construct
EKHELK

SEQ ID NO: 10331 - protein, 6 aa, synthetic construct
  REGION 1..6: note = Synthetic Construct
EKHENK

SEQ ID NO: 10332 - protein, 6 aa, synthetic construct
  REGION 1..6: note = Synthetic Construct
EKHEQK

SEQ ID NO: 10333 - protein, 6 aa, synthetic construct
  REGION 1..6: note = Synthetic Construct
EKHERK

SEQ ID NO: 10334 - protein, 6 aa, synthetic construct
  REGION 1..6: note = Synthetic Construct
EKHESK

SEQ ID NO: 10335 - protein, 6 aa, synthetic construct
  REGION 1..6: note = Synthetic Construct
EKHETK

SEQ ID NO: 10336 - protein, 6 aa, synthetic construct
  REGION 1..6: note = Synthetic Construct
EKHEYK

SEQ ID NO: 10337 - protein, 6 aa, synthetic construct
  REGION 1..6: note = Synthetic Construct
EKHFAK

SEQ ID NO: 10338 - protein, 6 aa, synthetic construct
  REGION 1..6: note = Synthetic Construct
EKHFDK

SEQ ID NO: 10339 - protein, 6 aa, synthetic construct
  REGION 1..6: note = Synthetic Construct
EKHFEK

SEQ ID NO: 10340 - protein, 6 aa, synthetic construct
  REGION 1..6: note = Synthetic Construct
EKHFFK

SEQ ID NO: 10341 - protein, 6 aa, synthetic construct
  REGION 1..6: note = Synthetic Construct
EKHFGK

SEQ ID NO: 10342 - protein, 6 aa, synthetic construct
  REGION 1..6: note = Synthetic Construct
EKHFHK

SEQ ID NO: 10343 - protein, 6 aa, synthetic construct
  REGION 1..6: note = Synthetic Construct
EKHFIK

SEQ ID NO: 10344 - protein, 6 aa, synthetic construct
  REGION 1..6: note = Synthetic Construct
EKHFLK

SEQ ID NO: 10345 - protein, 6 aa, synthetic construct
  REGION 1..6: note = Synthetic Construct
EKHFNK

SEQ ID NO: 10346 - protein, 6 aa, synthetic construct
  REGION 1..6: note = Synthetic Construct
EKHFQK

SEQ ID NO: 10347 - protein, 6 aa, synthetic construct
  REGION 1..6: note = Synthetic Construct
EKHFRK

SEQ ID NO: 10348 - protein, 6 aa, synthetic construct
  REGION 1..6: note = Synthetic Construct
EKHFSK

SEQ ID NO: 10349 - protein, 6 aa, synthetic construct
  REGION 1..6: note = Synthetic Construct
EKHFTK

SEQ ID NO: 10350 - protein, 6 aa, synthetic construct
  REGION 1..6: note = Synthetic Construct
EKHFYK

SEQ ID NO: 10351 - protein, 6 aa, synthetic construct
  REGION 1..6: note = Synthetic Construct
EKHGAK

SEQ ID NO: 10352 - protein, 6 aa, synthetic construct
  REGION 1..6: note = Synthetic Construct
EKHGDK

SEQ ID NO: 10353 - protein, 6 aa, synthetic construct
  REGION 1..6: note = Synthetic Construct
EKHGEK

SEQ ID NO: 10354 - protein, 6 aa, synthetic construct
  REGION 1..6: note = Synthetic Construct
EKHGFK

SEQ ID NO: 10355 - protein, 6 aa, synthetic construct
  REGION 1..6: note = Synthetic Construct
EKHGGK

SEQ ID NO: 10356 - protein, 6 aa, synthetic construct
  REGION 1..6: note = Synthetic Construct
EKHGHK

SEQ ID NO: 10357 - protein, 6 aa, synthetic construct
  REGION 1..6: note = Synthetic Construct
EKHGIK

SEQ ID NO: 10358 - protein, 6 aa, synthetic construct
  REGION 1..6: note = Synthetic Construct
EKHGLK

SEQ ID NO: 10359 - protein, 6 aa, synthetic construct
  REGION 1..6: note = Synthetic Construct
EKHGNK

SEQ ID NO: 10360 - protein, 6 aa, synthetic construct
  REGION 1..6: note = Synthetic Construct
EKHGQK

SEQ ID NO: 10361 - protein, 6 aa, synthetic construct
  REGION 1..6: note = Synthetic Construct
EKHGRK

SEQ ID NO: 10362 - protein, 6 aa, synthetic construct
  REGION 1..6: note = Synthetic Construct
EKHGSK

SEQ ID NO: 10363 - protein, 6 aa, synthetic construct
  REGION 1..6: note = Synthetic Construct
EKHGTK

SEQ ID NO: 10364 - protein, 6 aa, synthetic construct
  REGION 1..6: note = Synthetic Construct
EKHGYK

SEQ ID NO: 10365 - protein, 6 aa, synthetic construct
  REGION 1..6: note = Synthetic Construct
EKHHAK

SEQ ID NO: 10366 - protein, 6 aa, synthetic construct
  REGION 1..6: note = Synthetic Construct
EKHHDK

SEQ ID NO: 10367 - protein, 6 aa, synthetic construct
  REGION 1..6: note = Synthetic Construct
EKHHEK

SEQ ID NO: 10368 - protein, 6 aa, synthetic construct
  REGION 1..6: note = Synthetic Construct
EKHHFK

SEQ ID NO: 10369 - protein, 6 aa, synthetic construct
  REGION 1..6: note = Synthetic Construct
EKHHGK

SEQ ID NO: 10370 - protein, 6 aa, synthetic construct
  REGION 1..6: note = Synthetic Construct
EKHHHK

SEQ ID NO: 10371 - protein, 6 aa, synthetic construct
  REGION 1..6: note = Synthetic Construct
EKHHIK

SEQ ID NO: 10372 - protein, 6 aa, synthetic construct
  REGION 1..6: note = Synthetic Construct
EKHHLK

SEQ ID NO: 10373 - protein, 6 aa, synthetic construct
  REGION 1..6: note = Synthetic Construct
EKHHNK

SEQ ID NO: 10374 - protein, 6 aa, synthetic construct
  REGION 1..6: note = Synthetic Construct
EKHHQK

SEQ ID NO: 10375 - protein, 6 aa, synthetic construct
  REGION 1..6: note = Synthetic Construct
EKHHRK

SEQ ID NO: 10376 - protein, 6 aa, synthetic construct
  REGION 1..6: note = Synthetic Construct
EKHHSK

SEQ ID NO: 10377 - protein, 6 aa, synthetic construct
  REGION 1..6: note = Synthetic Construct
EKHHTK

SEQ ID NO: 10378 - protein, 6 aa, synthetic construct
  REGION 1..6: note = Synthetic Construct
EKHHYK

SEQ ID NO: 10379 - protein, 6 aa, synthetic construct
  REGION 1..6: note = Synthetic Construct
EKHIAK

SEQ ID NO: 10380 - protein, 6 aa, synthetic construct
  REGION 1..6: note = Synthetic Construct
EKHIDK

SEQ ID NO: 10381 - protein, 6 aa, synthetic construct
  REGION 1..6: note = Synthetic Construct
EKHIEK

SEQ ID NO: 10382 - protein, 6 aa, synthetic construct
  REGION 1..6: note = Synthetic Construct
EKHIFK

SEQ ID NO: 10383 - protein, 6 aa, synthetic construct
  REGION 1..6: note = Synthetic Construct
EKHIGK

SEQ ID NO: 10384 - protein, 6 aa, synthetic construct
  REGION 1..6: note = Synthetic Construct
EKHIHK

SEQ ID NO: 10385 - protein, 6 aa, synthetic construct
  REGION 1..6: note = Synthetic Construct
EKHIIK

SEQ ID NO: 10386 - protein, 6 aa, synthetic construct
  REGION 1..6: note = Synthetic Construct
EKHILK

SEQ ID NO: 10387 - protein, 6 aa, synthetic construct
  REGION 1..6: note = Synthetic Construct
EKHINK

SEQ ID NO: 10388 - protein, 6 aa, synthetic construct
  REGION 1..6: note = Synthetic Construct
EKHIQK

SEQ ID NO: 10389 - protein, 6 aa, synthetic construct
  REGION 1..6: note = Synthetic Construct
EKHIRK

SEQ ID NO: 10390 - protein, 6 aa, synthetic construct
  REGION 1..6: note = Synthetic Construct
EKHISK

SEQ ID NO: 10391 - protein, 6 aa, synthetic construct
  REGION 1..6: note = Synthetic Construct
EKHITK

SEQ ID NO: 10392 - protein, 6 aa, synthetic construct
  REGION 1..6: note = Synthetic Construct
EKHIYK

SEQ ID NO: 10393 - protein, 6 aa, synthetic construct
  REGION 1..6: note = Synthetic Construct
EKHLAK

SEQ ID NO: 10394 - protein, 6 aa, synthetic construct
  REGION 1..6: note = Synthetic Construct
EKHLDK

SEQ ID NO: 10395 - protein, 6 aa, synthetic construct
  REGION 1..6: note = Synthetic Construct
EKHLEK

SEQ ID NO: 10396 - protein, 6 aa, synthetic construct
  REGION 1..6: note = Synthetic Construct
EKHLFK

SEQ ID NO: 10397 - protein, 6 aa, synthetic construct
  REGION 1..6: note = Synthetic Construct
EKHLGK

SEQ ID NO: 10398 - protein, 6 aa, synthetic construct
  REGION 1..6: note = Synthetic Construct
EKHLHK

SEQ ID NO: 10399 - protein, 6 aa, synthetic construct
  REGION 1..6: note = Synthetic Construct
EKHLIK

SEQ ID NO: 10400 - protein, 6 aa, synthetic construct
  REGION 1..6: note = Synthetic Construct
EKHLLK

SEQ ID NO: 10401 - protein, 6 aa, synthetic construct
  REGION 1..6: note = Synthetic Construct
EKHLNK

SEQ ID NO: 10402 - protein, 6 aa, synthetic construct
  REGION 1..6: note = Synthetic Construct
EKHLQK

SEQ ID NO: 10403 - protein, 6 aa, synthetic construct
  REGION 1..6: note = Synthetic Construct
EKHLRK

SEQ ID NO: 10404 - protein, 6 aa, synthetic construct
  REGION 1..6: note = Synthetic Construct
EKHLSK

SEQ ID NO: 10405 - protein, 6 aa, synthetic construct
  REGION 1..6: note = Synthetic Construct
EKHLTK

SEQ ID NO: 10406 - protein, 6 aa, synthetic construct
  REGION 1..6: note = Synthetic Construct
EKHLYK

SEQ ID NO: 10407 - protein, 6 aa, synthetic construct
  REGION 1..6: note = Synthetic Construct
EKHNAK

SEQ ID NO: 10408 - protein, 6 aa, synthetic construct
  REGION 1..6: note = Synthetic Construct
EKHNDK

SEQ ID NO: 10409 - protein, 6 aa, synthetic construct
  REGION 1..6: note = Synthetic Construct
EKHNEK

SEQ ID NO: 10410 - protein, 6 aa, synthetic construct
  REGION 1..6: note = Synthetic Construct
EKHNFK

SEQ ID NO: 10411 - protein, 6 aa, synthetic construct
  REGION 1..6: note = Synthetic Construct
EKHNGK

SEQ ID NO: 10412 - protein, 6 aa, synthetic construct
  REGION 1..6: note = Synthetic Construct
EKHNHK

SEQ ID NO: 10413 - protein, 6 aa, synthetic construct
  REGION 1..6: note = Synthetic Construct
EKHNIK

SEQ ID NO: 10414 - protein, 6 aa, synthetic construct
  REGION 1..6: note = Synthetic Construct
EKHNLK

SEQ ID NO: 10415 - protein, 6 aa, synthetic construct
  REGION 1..6: note = Synthetic Construct
EKHNNK

SEQ ID NO: 10416 - protein, 6 aa, synthetic construct
  REGION 1..6: note = Synthetic Construct
EKHNQK

SEQ ID NO: 10417 - protein, 6 aa, synthetic construct
  REGION 1..6: note = Synthetic Construct
EKHNRK

SEQ ID NO: 10418 - protein, 6 aa, synthetic construct
  REGION 1..6: note = Synthetic Construct
EKHNSK

SEQ ID NO: 10419 - protein, 6 aa, synthetic construct
  REGION 1..6: note = Synthetic Construct
EKHNTK

SEQ ID NO: 10420 - protein, 6 aa, synthetic construct
  REGION 1..6: note = Synthetic Construct
EKHNYK

SEQ ID NO: 10421 - protein, 6 aa, synthetic construct
  REGION 1..6: note = Synthetic Construct
EKHQAK

SEQ ID NO: 10422 - protein, 6 aa, synthetic construct
  REGION 1..6: note = Synthetic Construct
EKHQDK

SEQ ID NO: 10423 - protein, 6 aa, synthetic construct
  REGION 1..6: note = Synthetic Construct
EKHQEK

SEQ ID NO: 10424 - protein, 6 aa, synthetic construct
  REGION 1..6: note = Synthetic Construct
EKHQFK

SEQ ID NO: 10425 - protein, 6 aa, synthetic construct
  REGION 1..6: note = Synthetic Construct
EKHQGK

SEQ ID NO: 10426 - protein, 6 aa, synthetic construct
  REGION 1..6: note = Synthetic Construct
EKHQHK

SEQ ID NO: 10427 - protein, 6 aa, synthetic construct
  REGION 1..6: note = Synthetic Construct
EKHQIK

SEQ ID NO: 10428 - protein, 6 aa, synthetic construct
  REGION 1..6: note = Synthetic Construct
EKHQLK

SEQ ID NO: 10429 - protein, 6 aa, synthetic construct
  REGION 1..6: note = Synthetic Construct
EKHQNK

SEQ ID NO: 10430 - protein, 6 aa, synthetic construct
  REGION 1..6: note = Synthetic Construct
EKHQQK

SEQ ID NO: 10431 - protein, 6 aa, synthetic construct
  REGION 1..6: note = Synthetic Construct
EKHQRK

SEQ ID NO: 10432 - protein, 6 aa, synthetic construct
  REGION 1..6: note = Synthetic Construct
EKHQSK

SEQ ID NO: 10433 - protein, 6 aa, synthetic construct
  REGION 1..6: note = Synthetic Construct
EKHQTK

SEQ ID NO: 10434 - protein, 6 aa, synthetic construct
  REGION 1..6: note = Synthetic Construct
EKHQYK

SEQ ID NO: 10435 - protein, 6 aa, synthetic construct
  REGION 1..6: note = Synthetic Construct
EKHRAK

SEQ ID NO: 10436 - protein, 6 aa, synthetic construct
  REGION 1..6: note = Synthetic Construct
EKHRDK

SEQ ID NO: 10437 - protein, 6 aa, synthetic construct
  REGION 1..6: note = Synthetic Construct
EKHREK

SEQ ID NO: 10438 - protein, 6 aa, synthetic construct
  REGION 1..6: note = Synthetic Construct
EKHRFK

SEQ ID NO: 10439 - protein, 6 aa, synthetic construct
  REGION 1..6: note = Synthetic Construct
EKHRGK

SEQ ID NO: 10440 - protein, 6 aa, synthetic construct
  REGION 1..6: note = Synthetic Construct
EKHRHK

SEQ ID NO: 10441 - protein, 6 aa, synthetic construct
  REGION 1..6: note = Synthetic Construct
EKHRIK

SEQ ID NO: 10442 - protein, 6 aa, synthetic construct
  REGION 1..6: note = Synthetic Construct
EKHRLK

SEQ ID NO: 10443 - protein, 6 aa, synthetic construct
  REGION 1..6: note = Synthetic Construct
EKHRNK

SEQ ID NO: 10444 - protein, 6 aa, synthetic construct
  REGION 1..6: note = Synthetic Construct
EKHRQK

SEQ ID NO: 10445 - protein, 6 aa, synthetic construct
  REGION 1..6: note = Synthetic Construct
EKHRRK

SEQ ID NO: 10446 - protein, 6 aa, synthetic construct
  REGION 1..6: note = Synthetic Construct
EKHRSK

SEQ ID NO: 10447 - protein, 6 aa, synthetic construct
  REGION 1..6: note = Synthetic Construct
EKHRTK

SEQ ID NO: 10448 - protein, 6 aa, synthetic construct
  REGION 1..6: note = Synthetic Construct
EKHRYK

SEQ ID NO: 10449 - protein, 6 aa, synthetic construct
  REGION 1..6: note = Synthetic Construct
EKHSAK

SEQ ID NO: 10450 - protein, 6 aa, synthetic construct
  REGION 1..6: note = Synthetic Construct
EKHSDK

SEQ ID NO: 10451 - protein, 6 aa, synthetic construct
  REGION 1..6: note = Synthetic Construct
EKHSEK

SEQ ID NO: 10452 - protein, 6 aa, synthetic construct
  REGION 1..6: note = Synthetic Construct
EKHSFK

SEQ ID NO: 10453 - protein, 6 aa, synthetic construct
  REGION 1..6: note = Synthetic Construct
EKHSGK

SEQ ID NO: 10454 - protein, 6 aa, synthetic construct
  REGION 1..6: note = Synthetic Construct
EKHSHK

SEQ ID NO: 10455 - protein, 6 aa, synthetic construct
  REGION 1..6: note = Synthetic Construct
EKHSIK

SEQ ID NO: 10456 - protein, 6 aa, synthetic construct
  REGION 1..6: note = Synthetic Construct
EKHSLK

SEQ ID NO: 10457 - protein, 6 aa, synthetic construct
  REGION 1..6: note = Synthetic Construct
EKHSNK

SEQ ID NO: 10458 - protein, 6 aa, synthetic construct
  REGION 1..6: note = Synthetic Construct
EKHSQK

SEQ ID NO: 10459 - protein, 6 aa, synthetic construct
  REGION 1..6: note = Synthetic Construct
EKHSRK

SEQ ID NO: 10460 - protein, 6 aa, synthetic construct
  REGION 1..6: note = Synthetic Construct
EKHSSK

SEQ ID NO: 10461 - protein, 6 aa, synthetic construct
  REGION 1..6: note = Synthetic Construct
EKHSTK

SEQ ID NO: 10462 - protein, 6 aa, synthetic construct
  REGION 1..6: note = Synthetic Construct
EKHSYK

SEQ ID NO: 10463 - protein, 6 aa, synthetic construct
  REGION 1..6: note = Synthetic Construct
EKHTAK

SEQ ID NO: 10464 - protein, 6 aa, synthetic construct
  REGION 1..6: note = Synthetic Construct
EKHTDK

SEQ ID NO: 10465 - protein, 6 aa, synthetic construct
  REGION 1..6: note = Synthetic Construct
EKHTEK

SEQ ID NO: 10466 - protein, 6 aa, synthetic construct
  REGION 1..6: note = Synthetic Construct
EKHTFK

SEQ ID NO: 10467 - protein, 6 aa, synthetic construct
  REGION 1..6: note = Synthetic Construct
EKHTGK

SEQ ID NO: 10468 - protein, 6 aa, synthetic construct
  REGION 1..6: note = Synthetic Construct
EKHTHK

SEQ ID NO: 10469 - protein, 6 aa, synthetic construct
  REGION 1..6: note = Synthetic Construct
EKHTIK

SEQ ID NO: 10470 - protein, 6 aa, synthetic construct
  REGION 1..6: note = Synthetic Construct
EKHTLK

SEQ ID NO: 10471 - protein, 6 aa, synthetic construct
  REGION 1..6: note = Synthetic Construct
EKHTNK

SEQ ID NO: 10472 - protein, 6 aa, synthetic construct
  REGION 1..6: note = Synthetic Construct
EKHTQK

SEQ ID NO: 10473 - protein, 6 aa, synthetic construct
  REGION 1..6: note = Synthetic Construct
EKHTRK

SEQ ID NO: 10474 - protein, 6 aa, synthetic construct
  REGION 1..6: note = Synthetic Construct
EKHTSK

SEQ ID NO: 10475 - protein, 6 aa, synthetic construct
  REGION 1..6: note = Synthetic Construct
EKHTTK

SEQ ID NO: 10476 - protein, 6 aa, synthetic construct
  REGION 1..6: note = Synthetic Construct
EKHTYK

SEQ ID NO: 10477 - protein, 6 aa, synthetic construct
  REGION 1..6: note = Synthetic Construct
EKHYAK

SEQ ID NO: 10478 - protein, 6 aa, synthetic construct
  REGION 1..6: note = Synthetic Construct
EKHYDK

SEQ ID NO: 10479 - protein, 6 aa, synthetic construct
  REGION 1..6: note = Synthetic Construct
EKHYEK

SEQ ID NO: 10480 - protein, 6 aa, synthetic construct
  REGION 1..6: note = Synthetic Construct
EKHYFK

SEQ ID NO: 10481 - protein, 6 aa, synthetic construct
  REGION 1..6: note = Synthetic Construct
EKHYGK

SEQ ID NO: 10482 - protein, 6 aa, synthetic construct
  REGION 1..6: note = Synthetic Construct
EKHYHK

SEQ ID NO: 10483 - protein, 6 aa, synthetic construct
  REGION 1..6: note = Synthetic Construct
EKHYIK

SEQ ID NO: 10484 - protein, 6 aa, synthetic construct
  REGION 1..6: note = Synthetic Construct
EKHYLK

SEQ ID NO: 10485 - protein, 6 aa, synthetic construct
  REGION 1..6: note = Synthetic Construct
EKHYNK

SEQ ID NO: 10486 - protein, 6 aa, synthetic construct
  REGION 1..6: note = Synthetic Construct
EKHYQK

SEQ ID NO: 10487 - protein, 6 aa, synthetic construct
  REGION 1..6: note = Synthetic Construct
EKHYRK

SEQ ID NO: 10488 - protein, 6 aa, synthetic construct
  REGION 1..6: note = Synthetic Construct
EKHYSK

SEQ ID NO: 10489 - protein, 6 aa, synthetic construct
  REGION 1..6: note = Synthetic Construct
EKHYTK

SEQ ID NO: 10490 - protein, 6 aa, synthetic construct
  REGION 1..6: note = Synthetic Construct
EKHYYK

SEQ ID NO: 10491 - protein, 6 aa, synthetic construct
  REGION 1..6: note = Synthetic Construct
EKIAAK

SEQ ID NO: 10492 - protein, 6 aa, synthetic construct
  REGION 1..6: note = Synthetic Construct
EKIADK

SEQ ID NO: 10493 - protein, 6 aa, synthetic construct
  REGION 1..6: note = Synthetic Construct
EKIAEK

SEQ ID NO: 10494 - protein, 6 aa, synthetic construct
  REGION 1..6: note = Synthetic Construct
EKIAFK

SEQ ID NO: 10495 - protein, 6 aa, synthetic construct
  REGION 1..6: note = Synthetic Construct
EKIAGK

SEQ ID NO: 10496 - protein, 6 aa, synthetic construct
  REGION 1..6: note = Synthetic Construct
EKIAHK

SEQ ID NO: 10497 - protein, 6 aa, synthetic construct
  REGION 1..6: note = Synthetic Construct
EKIAIK

SEQ ID NO: 10498 - protein, 6 aa, synthetic construct
  REGION 1..6: note = Synthetic Construct
EKIALK

SEQ ID NO: 10499 - protein, 6 aa, synthetic construct
  REGION 1..6: note = Synthetic Construct
EKIANK

SEQ ID NO: 10500 - protein, 6 aa, synthetic construct
  REGION 1..6: note = Synthetic Construct
EKIAQK

SEQ ID NO: 10501 - protein, 6 aa, synthetic construct
  REGION 1..6: note = Synthetic Construct
EKIARK

SEQ ID NO: 10502 - protein, 6 aa, synthetic construct
  REGION 1..6: note = Synthetic Construct
EKIASK

SEQ ID NO: 10503 - protein, 6 aa, synthetic construct
  REGION 1..6: note = Synthetic Construct
EKIATK

SEQ ID NO: 10504 - protein, 6 aa, synthetic construct
  REGION 1..6: note = Synthetic Construct
EKIAYK

SEQ ID NO: 10505 - protein, 6 aa, synthetic construct
  REGION 1..6: note = Synthetic Construct
EKIDAK

SEQ ID NO: 10506 - protein, 6 aa, synthetic construct
  REGION 1..6: note = Synthetic Construct
EKIDDK

SEQ ID NO: 10507 - protein, 6 aa, synthetic construct
  REGION 1..6: note = Synthetic Construct
EKIDEK

SEQ ID NO: 10508 - protein, 6 aa, synthetic construct
  REGION 1..6: note = Synthetic Construct
EKIDFK

SEQ ID NO: 10509 - protein, 6 aa, synthetic construct
  REGION 1..6: note = Synthetic Construct
EKIDGK

SEQ ID NO: 10510 - protein, 6 aa, synthetic construct
  REGION 1..6: note = Synthetic Construct
EKIDHK

SEQ ID NO: 10511 - protein, 6 aa, synthetic construct
  REGION 1..6: note = Synthetic Construct
EKIDIK

SEQ ID NO: 10512 - protein, 6 aa, synthetic construct
  REGION 1..6: note = Synthetic Construct
EKIDLK

SEQ ID NO: 10513 - protein, 6 aa, synthetic construct
  REGION 1..6: note = Synthetic Construct
EKIDNK

SEQ ID NO: 10514 - protein, 6 aa, synthetic construct
  REGION 1..6: note = Synthetic Construct
EKIDQK

SEQ ID NO: 10515 - protein, 6 aa, synthetic construct
  REGION 1..6: note = Synthetic Construct
EKIDRK

SEQ ID NO: 10516 - protein, 6 aa, synthetic construct
  REGION 1..6: note = Synthetic Construct
EKIDSK

SEQ ID NO: 10517 - protein, 6 aa, synthetic construct
  REGION 1..6: note = Synthetic Construct
EKIDTK

SEQ ID NO: 10518 - protein, 6 aa, synthetic construct
  REGION 1..6: note = Synthetic Construct
EKIDYK

SEQ ID NO: 10519 - protein, 6 aa, synthetic construct
  REGION 1..6: note = Synthetic Construct
EKIEAK

SEQ ID NO: 10520 - protein, 6 aa, synthetic construct
  REGION 1..6: note = Synthetic Construct
EKIEDK

SEQ ID NO: 10521 - protein, 6 aa, synthetic construct
  REGION 1..6: note = Synthetic Construct
EKIEEK

SEQ ID NO: 10522 - protein, 6 aa, synthetic construct
  REGION 1..6: note = Synthetic Construct
EKIEFK

SEQ ID NO: 10523 - protein, 6 aa, synthetic construct
  REGION 1..6: note = Synthetic Construct
EKIEGK

SEQ ID NO: 10524 - protein, 6 aa, synthetic construct
  REGION 1..6: note = Synthetic Construct
EKIEHK

SEQ ID NO: 10525 - protein, 6 aa, synthetic construct
  REGION 1..6: note = Synthetic Construct
EKIEIK

SEQ ID NO: 10526 - protein, 6 aa, synthetic construct
  REGION 1..6: note = Synthetic Construct
EKIELK

SEQ ID NO: 10527 - protein, 6 aa, synthetic construct
  REGION 1..6: note = Synthetic Construct
EKIENK

SEQ ID NO: 10528 - protein, 6 aa, synthetic construct
  REGION 1..6: note = Synthetic Construct
EKIEQK

SEQ ID NO: 10529 - protein, 6 aa, synthetic construct
  REGION 1..6: note = Synthetic Construct
EKIERK

SEQ ID NO: 10530 - protein, 6 aa, synthetic construct
  REGION 1..6: note = Synthetic Construct
EKIESK

SEQ ID NO: 10531 - protein, 6 aa, synthetic construct
  REGION 1..6: note = Synthetic Construct
EKIETK

SEQ ID NO: 10532 - protein, 6 aa, synthetic construct
  REGION 1..6: note = Synthetic Construct
EKIEYK

SEQ ID NO: 10533 - protein, 6 aa, synthetic construct
  REGION 1..6: note = Synthetic Construct
EKIFAK

SEQ ID NO: 10534 - protein, 6 aa, synthetic construct
  REGION 1..6: note = Synthetic Construct
EKIFDK

SEQ ID NO: 10535 - protein, 6 aa, synthetic construct
  REGION 1..6: note = Synthetic Construct
EKIFEK

SEQ ID NO: 10536 - protein, 6 aa, synthetic construct
  REGION 1..6: note = Synthetic Construct
EKIFFK

SEQ ID NO: 10537 - protein, 6 aa, synthetic construct
  REGION 1..6: note = Synthetic Construct
EKIFGK

SEQ ID NO: 10538 - protein, 6 aa, synthetic construct
  REGION 1..6: note = Synthetic Construct
EKIFHK

SEQ ID NO: 10539 - protein, 6 aa, synthetic construct
  REGION 1..6: note = Synthetic Construct
EKIFIK

SEQ ID NO: 10540 - protein, 6 aa, synthetic construct
  REGION 1..6: note = Synthetic Construct
EKIFLK

SEQ ID NO: 10541 - protein, 6 aa, synthetic construct
  REGION 1..6: note = Synthetic Construct
EKIFNK

SEQ ID NO: 10542 - protein, 6 aa, synthetic construct
  REGION 1..6: note = Synthetic Construct
EKIFQK

SEQ ID NO: 10543 - protein, 6 aa, synthetic construct
  REGION 1..6: note = Synthetic Construct
EKIFRK

SEQ ID NO: 10544 - protein, 6 aa, synthetic construct
  REGION 1..6: note = Synthetic Construct
EKIFSK

SEQ ID NO: 10545 - protein, 6 aa, synthetic construct
  REGION 1..6: note = Synthetic Construct
EKIFTK

SEQ ID NO: 10546 - protein, 6 aa, synthetic construct
  REGION 1..6: note = Synthetic Construct
EKIFYK

SEQ ID NO: 10547 - protein, 6 aa, synthetic construct
  REGION 1..6: note = Synthetic Construct
EKIGAK

SEQ ID NO: 10548 - protein, 6 aa, synthetic construct
  REGION 1..6: note = Synthetic Construct
EKIGDK

SEQ ID NO: 10549 - protein, 6 aa, synthetic construct
  REGION 1..6: note = Synthetic Construct
EKIGEK

SEQ ID NO: 10550 - protein, 6 aa, synthetic construct
  REGION 1..6: note = Synthetic Construct
EKIGFK

SEQ ID NO: 10551 - protein, 6 aa, synthetic construct
  REGION 1..6: note = Synthetic Construct
EKIGGK

SEQ ID NO: 10552 - protein, 6 aa, synthetic construct
  REGION 1..6: note = Synthetic Construct
EKIGHK

SEQ ID NO: 10553 - protein, 6 aa, synthetic construct
  REGION 1..6: note = Synthetic Construct
EKIGIK

SEQ ID NO: 10554 - protein, 6 aa, synthetic construct
  REGION 1..6: note = Synthetic Construct
EKIGLK

SEQ ID NO: 10555 - protein, 6 aa, synthetic construct
  REGION 1..6: note = Synthetic Construct
EKIGNK

SEQ ID NO: 10556 - protein, 6 aa, synthetic construct
  REGION 1..6: note = Synthetic Construct
EKIGQK

SEQ ID NO: 10557 - protein, 6 aa, synthetic construct
  REGION 1..6: note = Synthetic Construct
EKIGRK

SEQ ID NO: 10558 - protein, 6 aa, synthetic construct
  REGION 1..6: note = Synthetic Construct
EKIGSK

SEQ ID NO: 10559 - protein, 6 aa, synthetic construct
  REGION 1..6: note = Synthetic Construct
EKIGTK

SEQ ID NO: 10560 - protein, 6 aa, synthetic construct
  REGION 1..6: note = Synthetic Construct
EKIGYK

SEQ ID NO: 10561 - protein, 6 aa, synthetic construct
  REGION 1..6: note = Synthetic Construct
EKIHAK

SEQ ID NO: 10562 - protein, 6 aa, synthetic construct
  REGION 1..6: note = Synthetic Construct
EKIHDK

SEQ ID NO: 10563 - protein, 6 aa, synthetic construct
  REGION 1..6: note = Synthetic Construct
EKIHEK

SEQ ID NO: 10564 - protein, 6 aa, synthetic construct
  REGION 1..6: note = Synthetic Construct
EKIHFK

SEQ ID NO: 10565 - protein, 6 aa, synthetic construct
  REGION 1..6: note = Synthetic Construct
EKIHGK

SEQ ID NO: 10566 - protein, 6 aa, synthetic construct
  REGION 1..6: note = Synthetic Construct
EKIHHK

SEQ ID NO: 10567 - protein, 6 aa, synthetic construct
  REGION 1..6: note = Synthetic Construct
EKIHIK

SEQ ID NO: 10568 - protein, 6 aa, synthetic construct
  REGION 1..6: note = Synthetic Construct
EKIHLK

SEQ ID NO: 10569 - protein, 6 aa, synthetic construct
  REGION 1..6: note = Synthetic Construct
EKIHNK

SEQ ID NO: 10570 - protein, 6 aa, synthetic construct
  REGION 1..6: note = Synthetic Construct
EKIHQK

SEQ ID NO: 10571 - protein, 6 aa, synthetic construct
  REGION 1..6: note = Synthetic Construct
EKIHRK

SEQ ID NO: 10572 - protein, 6 aa, synthetic construct
  REGION 1..6: note = Synthetic Construct
EKIHSK

SEQ ID NO: 10573 - protein, 6 aa, synthetic construct
  REGION 1..6: note = Synthetic Construct
EKIHTK

SEQ ID NO: 10574 - protein, 6 aa, synthetic construct
  REGION 1..6: note = Synthetic Construct
EKIHYK

SEQ ID NO: 10575 - protein, 6 aa, synthetic construct
  REGION 1..6: note = Synthetic Construct
EKIIAK

SEQ ID NO: 10576 - protein, 6 aa, synthetic construct
  REGION 1..6: note = Synthetic Construct
EKIIDK

SEQ ID NO: 10577 - protein, 6 aa, synthetic construct
  REGION 1..6: note = Synthetic Construct
EKIIEK

SEQ ID NO: 10578 - protein, 6 aa, synthetic construct
  REGION 1..6: note = Synthetic Construct
EKIIFK

SEQ ID NO: 10579 - protein, 6 aa, synthetic construct
  REGION 1..6: note = Synthetic Construct
EKIIGK

SEQ ID NO: 10580 - protein, 6 aa, synthetic construct
  REGION 1..6: note = Synthetic Construct
EKIIHK

SEQ ID NO: 10581 - protein, 6 aa, synthetic construct
  REGION 1..6: note = Synthetic Construct
EKIIIK

SEQ ID NO: 10582 - protein, 6 aa, synthetic construct
  REGION 1..6: note = Synthetic Construct
EKIILK

SEQ ID NO: 10583 - protein, 6 aa, synthetic construct
  REGION 1..6: note = Synthetic Construct
EKIINK

SEQ ID NO: 10584 - protein, 6 aa, synthetic construct
  REGION 1..6: note = Synthetic Construct
EKIIQK

SEQ ID NO: 10585 - protein, 6 aa, synthetic construct
  REGION 1..6: note = Synthetic Construct
EKIIRK

SEQ ID NO: 10586 - protein, 6 aa, synthetic construct
  REGION 1..6: note = Synthetic Construct
EKIISK

SEQ ID NO: 10587 - protein, 6 aa, synthetic construct
  REGION 1..6: note = Synthetic Construct
EKIITK

SEQ ID NO: 10588 - protein, 6 aa, synthetic construct
  REGION 1..6: note = Synthetic Construct
EKIIYK

SEQ ID NO: 10589 - protein, 6 aa, synthetic construct
  REGION 1..6: note = Synthetic Construct
EKILAK

SEQ ID NO: 10590 - protein, 6 aa, synthetic construct
  REGION 1..6: note = Synthetic Construct
EKILDK

SEQ ID NO: 10591 - protein, 6 aa, synthetic construct
  REGION 1..6: note = Synthetic Construct
EKILEK

SEQ ID NO: 10592 - protein, 6 aa, synthetic construct
  REGION 1..6: note = Synthetic Construct
EKILFK

SEQ ID NO: 10593 - protein, 6 aa, synthetic construct
  REGION 1..6: note = Synthetic Construct
EKILGK

SEQ ID NO: 10594 - protein, 6 aa, synthetic construct
  REGION 1..6: note = Synthetic Construct
EKILHK

SEQ ID NO: 10595 - protein, 6 aa, synthetic construct
  REGION 1..6: note = Synthetic Construct
EKILIK

SEQ ID NO: 10596 - protein, 6 aa, synthetic construct
  REGION 1..6: note = Synthetic Construct
EKILLK

SEQ ID NO: 10597 - protein, 6 aa, synthetic construct
  REGION 1..6: note = Synthetic Construct
EKILNK

SEQ ID NO: 10598 - protein, 6 aa, synthetic construct
  REGION 1..6: note = Synthetic Construct
EKILQK

SEQ ID NO: 10599 - protein, 6 aa, synthetic construct
  REGION 1..6: note = Synthetic Construct
EKILRK

SEQ ID NO: 10600 - protein, 6 aa, synthetic construct
  REGION 1..6: note = Synthetic Construct
EKILSK

SEQ ID NO: 10601 - protein, 6 aa, synthetic construct
  REGION 1..6: note = Synthetic Construct
EKILTK

SEQ ID NO: 10602 - protein, 6 aa, synthetic construct
  REGION 1..6: note = Synthetic Construct
EKILYK

SEQ ID NO: 10603 - protein, 6 aa, synthetic construct
  REGION 1..6: note = Synthetic Construct
EKINAK

SEQ ID NO: 10604 - protein, 6 aa, synthetic construct
  REGION 1..6: note = Synthetic Construct
EKINDK

SEQ ID NO: 10605 - protein, 6 aa, synthetic construct
  REGION 1..6: note = Synthetic Construct
EKINEK

SEQ ID NO: 10606 - protein, 6 aa, synthetic construct
  REGION 1..6: note = Synthetic Construct
EKINFK

SEQ ID NO: 10607 - protein, 6 aa, synthetic construct
  REGION 1..6: note = Synthetic Construct
EKINGK

SEQ ID NO: 10608 - protein, 6 aa, synthetic construct
  REGION 1..6: note = Synthetic Construct
EKINHK

SEQ ID NO: 10609 - protein, 6 aa, synthetic construct
  REGION 1..6: note = Synthetic Construct
EKINIK

SEQ ID NO: 10610 - protein, 6 aa, synthetic construct
  REGION 1..6: note = Synthetic Construct
EKINLK

SEQ ID NO: 10611 - protein, 6 aa, synthetic construct
  REGION 1..6: note = Synthetic Construct
EKINNK

SEQ ID NO: 10612 - protein, 6 aa, synthetic construct
  REGION 1..6: note = Synthetic Construct
EKINQK

SEQ ID NO: 10613 - protein, 6 aa, synthetic construct
  REGION 1..6: note = Synthetic Construct
EKINRK

SEQ ID NO: 10614 - protein, 6 aa, synthetic construct
  REGION 1..6: note = Synthetic Construct
EKINSK

SEQ ID NO: 10615 - protein, 6 aa, synthetic construct
  REGION 1..6: note = Synthetic Construct
EKINTK

SEQ ID NO: 10616 - protein, 6 aa, synthetic construct
  REGION 1..6: note = Synthetic Construct
EKINYK

SEQ ID NO: 10617 - protein, 6 aa, synthetic construct
  REGION 1..6: note = Synthetic Construct
EKIQAK

SEQ ID NO: 10618 - protein, 6 aa, synthetic construct
  REGION 1..6: note = Synthetic Construct
EKIQDK

SEQ ID NO: 10619 - protein, 6 aa, synthetic construct
  REGION 1..6: note = Synthetic Construct
EKIQEK

SEQ ID NO: 10620 - protein, 6 aa, synthetic construct
  REGION 1..6: note = Synthetic Construct
EKIQFK

SEQ ID NO: 10621 - protein, 6 aa, synthetic construct
  REGION 1..6: note = Synthetic Construct
EKIQGK

SEQ ID NO: 10622 - protein, 6 aa, synthetic construct
  REGION 1..6: note = Synthetic Construct
EKIQHK

SEQ ID NO: 10623 - protein, 6 aa, synthetic construct
  REGION 1..6: note = Synthetic Construct
EKIQIK

SEQ ID NO: 10624 - protein, 6 aa, synthetic construct
  REGION 1..6: note = Synthetic Construct
EKIQLK

SEQ ID NO: 10625 - protein, 6 aa, synthetic construct
  REGION 1..6: note = Synthetic Construct
EKIQNK

SEQ ID NO: 10626 - protein, 6 aa, synthetic construct
  REGION 1..6: note = Synthetic Construct
EKIQQK

SEQ ID NO: 10627 - protein, 6 aa, synthetic construct
  REGION 1..6: note = Synthetic Construct
EKIQRK

SEQ ID NO: 10628 - protein, 6 aa, synthetic construct
  REGION 1..6: note = Synthetic Construct
EKIQSK

SEQ ID NO: 10629 - protein, 6 aa, synthetic construct
  REGION 1..6: note = Synthetic Construct
EKIQTK

SEQ ID NO: 10630 - protein, 6 aa, synthetic construct
  REGION 1..6: note = Synthetic Construct
EKIQYK

SEQ ID NO: 10631 - protein, 6 aa, synthetic construct
  REGION 1..6: note = Synthetic Construct
EKIRAK

SEQ ID NO: 10632 - protein, 6 aa, synthetic construct
  REGION 1..6: note = Synthetic Construct
EKIRDK

SEQ ID NO: 10633 - protein, 6 aa, synthetic construct
  REGION 1..6: note = Synthetic Construct
EKIREK

SEQ ID NO: 10634 - protein, 6 aa, synthetic construct
  REGION 1..6: note = Synthetic Construct
EKIRFK

SEQ ID NO: 10635 - protein, 6 aa, synthetic construct
  REGION 1..6: note = Synthetic Construct
EKIRGK

SEQ ID NO: 10636 - protein, 6 aa, synthetic construct
  REGION 1..6: note = Synthetic Construct
EKIRHK

SEQ ID NO: 10637 - protein, 6 aa, synthetic construct
  REGION 1..6: note = Synthetic Construct
EKIRIK

SEQ ID NO: 10638 - protein, 6 aa, synthetic construct
  REGION 1..6: note = Synthetic Construct
EKIRLK

SEQ ID NO: 10639 - protein, 6 aa, synthetic construct
  REGION 1..6: note = Synthetic Construct
EKIRNK

SEQ ID NO: 10640 - protein, 6 aa, synthetic construct
  REGION 1..6: note = Synthetic Construct
EKIRQK

SEQ ID NO: 10641 - protein, 6 aa, synthetic construct
  REGION 1..6: note = Synthetic Construct
EKIRRK

SEQ ID NO: 10642 - protein, 6 aa, synthetic construct
  REGION 1..6: note = Synthetic Construct
EKIRSK

SEQ ID NO: 10643 - protein, 6 aa, synthetic construct
  REGION 1..6: note = Synthetic Construct
EKIRTK

SEQ ID NO: 10644 - protein, 6 aa, synthetic construct
  REGION 1..6: note = Synthetic Construct
EKIRYK

SEQ ID NO: 10645 - protein, 6 aa, synthetic construct
  REGION 1..6: note = Synthetic Construct
EKISAK

SEQ ID NO: 10646 - protein, 6 aa, synthetic construct
  REGION 1..6: note = Synthetic Construct
EKISDK

SEQ ID NO: 10647 - protein, 6 aa, synthetic construct
  REGION 1..6: note = Synthetic Construct
EKISEK

SEQ ID NO: 10648 - protein, 6 aa, synthetic construct
  REGION 1..6: note = Synthetic Construct
EKISFK

SEQ ID NO: 10649 - protein, 6 aa, synthetic construct
  REGION 1..6: note = Synthetic Construct
EKISGK

SEQ ID NO: 10650 - protein, 6 aa, synthetic construct
  REGION 1..6: note = Synthetic Construct
EKISHK

SEQ ID NO: 10651 - protein, 6 aa, synthetic construct
  REGION 1..6: note = Synthetic Construct
EKISIK

SEQ ID NO: 10652 - protein, 6 aa, synthetic construct
  REGION 1..6: note = Synthetic Construct
EKISLK

SEQ ID NO: 10653 - protein, 6 aa, synthetic construct
  REGION 1..6: note = Synthetic Construct
EKISNK

SEQ ID NO: 10654 - protein, 6 aa, synthetic construct
  REGION 1..6: note = Synthetic Construct
EKISQK

SEQ ID NO: 10655 - protein, 6 aa, synthetic construct
  REGION 1..6: note = Synthetic Construct
EKISRK

SEQ ID NO: 10656 - protein, 6 aa, synthetic construct
  REGION 1..6: note = Synthetic Construct
EKISSK

SEQ ID NO: 10657 - protein, 6 aa, synthetic construct
  REGION 1..6: note = Synthetic Construct
EKISTK

SEQ ID NO: 10658 - protein, 6 aa, synthetic construct
  REGION 1..6: note = Synthetic Construct
EKISYK

SEQ ID NO: 10659 - protein, 6 aa, synthetic construct
  REGION 1..6: note = Synthetic Construct
EKITAK

SEQ ID NO: 10660 - protein, 6 aa, synthetic construct
  REGION 1..6: note = Synthetic Construct
EKITDK

SEQ ID NO: 10661 - protein, 6 aa, synthetic construct
  REGION 1..6: note = Synthetic Construct
EKITEK

SEQ ID NO: 10662 - protein, 6 aa, synthetic construct
  REGION 1..6: note = Synthetic Construct
EKITFK

SEQ ID NO: 10663 - protein, 6 aa, synthetic construct
  REGION 1..6: note = Synthetic Construct
EKITGK

SEQ ID NO: 10664 - protein, 6 aa, synthetic construct
  REGION 1..6: note = Synthetic Construct
EKITHK

SEQ ID NO: 10665 - protein, 6 aa, synthetic construct
  REGION 1..6: note = Synthetic Construct
EKITIK

SEQ ID NO: 10666 - protein, 6 aa, synthetic construct
  REGION 1..6: note = Synthetic Construct
EKITLK

SEQ ID NO: 10667 - protein, 6 aa, synthetic construct
  REGION 1..6: note = Synthetic Construct
EKITNK

SEQ ID NO: 10668 - protein, 6 aa, synthetic construct
  REGION 1..6: note = Synthetic Construct
EKITQK

SEQ ID NO: 10669 - protein, 6 aa, synthetic construct
  REGION 1..6: note = Synthetic Construct
EKITRK

SEQ ID NO: 10670 - protein, 6 aa, synthetic construct
  REGION 1..6: note = Synthetic Construct
EKITSK

SEQ ID NO: 10671 - protein, 6 aa, synthetic construct
  REGION 1..6: note = Synthetic Construct
EKITTK

SEQ ID NO: 10672 - protein, 6 aa, synthetic construct
  REGION 1..6: note = Synthetic Construct
EKITYK

SEQ ID NO: 10673 - protein, 6 aa, synthetic construct
  REGION 1..6: note = Synthetic Construct
EKIYAK

SEQ ID NO: 10674 - protein, 6 aa, synthetic construct
  REGION 1..6: note = Synthetic Construct
EKIYDK

SEQ ID NO: 10675 - protein, 6 aa, synthetic construct
  REGION 1..6: note = Synthetic Construct
EKIYEK

SEQ ID NO: 10676 - protein, 6 aa, synthetic construct
  REGION 1..6: note = Synthetic Construct
EKIYFK

SEQ ID NO: 10677 - protein, 6 aa, synthetic construct
  REGION 1..6: note = Synthetic Construct
EKIYGK

SEQ ID NO: 10678 - protein, 6 aa, synthetic construct
  REGION 1..6: note = Synthetic Construct
EKIYHK

SEQ ID NO: 10679 - protein, 6 aa, synthetic construct
  REGION 1..6: note = Synthetic Construct
EKIYIK

SEQ ID NO: 10680 - protein, 6 aa, synthetic construct
  REGION 1..6: note = Synthetic Construct
EKIYLK

SEQ ID NO: 10681 - protein, 6 aa, synthetic construct
  REGION 1..6: note = Synthetic Construct
EKIYNK

SEQ ID NO: 10682 - protein, 6 aa, synthetic construct
  REGION 1..6: note = Synthetic Construct
EKIYQK

SEQ ID NO: 10683 - protein, 6 aa, synthetic construct
  REGION 1..6: note = Synthetic Construct
EKIYRK

SEQ ID NO: 10684 - protein, 6 aa, synthetic construct
  REGION 1..6: note = Synthetic Construct
EKIYSK

SEQ ID NO: 10685 - protein, 6 aa, synthetic construct
  REGION 1..6: note = Synthetic Construct
EKIYTK

SEQ ID NO: 10686 - protein, 6 aa, synthetic construct
  REGION 1..6: note = Synthetic Construct
EKIYYK

SEQ ID NO: 10687 - protein, 6 aa, synthetic construct
  REGION 1..6: note = Synthetic Construct
EKLAAK

SEQ ID NO: 10688 - protein, 6 aa, synthetic construct
  REGION 1..6: note = Synthetic Construct
EKLADK

SEQ ID NO: 10689 - protein, 6 aa, synthetic construct
  REGION 1..6: note = Synthetic Construct
EKLAEK

SEQ ID NO: 10690 - protein, 6 aa, synthetic construct
  REGION 1..6: note = Synthetic Construct
EKLAFK

SEQ ID NO: 10691 - protein, 6 aa, synthetic construct
  REGION 1..6: note = Synthetic Construct
EKLAGK

SEQ ID NO: 10692 - protein, 6 aa, synthetic construct
  REGION 1..6: note = Synthetic Construct
EKLAHK

SEQ ID NO: 10693 - protein, 6 aa, synthetic construct
  REGION 1..6: note = Synthetic Construct
EKLAIK

SEQ ID NO: 10694 - protein, 6 aa, synthetic construct
  REGION 1..6: note = Synthetic Construct
EKLALK

SEQ ID NO: 10695 - protein, 6 aa, synthetic construct
  REGION 1..6: note = Synthetic Construct
EKLANK

SEQ ID NO: 10696 - protein, 6 aa, synthetic construct
  REGION 1..6: note = Synthetic Construct
EKLAQK

SEQ ID NO: 10697 - protein, 6 aa, synthetic construct
  REGION 1..6: note = Synthetic Construct
EKLARK

SEQ ID NO: 10698 - protein, 6 aa, synthetic construct
  REGION 1..6: note = Synthetic Construct
EKLASK

SEQ ID NO: 10699 - protein, 6 aa, synthetic construct
  REGION 1..6: note = Synthetic Construct
EKLATK

SEQ ID NO: 10700 - protein, 6 aa, synthetic construct
  REGION 1..6: note = Synthetic Construct
EKLAYK

SEQ ID NO: 10701 - protein, 6 aa, synthetic construct
  REGION 1..6: note = Synthetic Construct
EKLDAK

SEQ ID NO: 10702 - protein, 6 aa, synthetic construct
  REGION 1..6: note = Synthetic Construct
EKLDDK

SEQ ID NO: 10703 - protein, 6 aa, synthetic construct
  REGION 1..6: note = Synthetic Construct
EKLDEK

SEQ ID NO: 10704 - protein, 6 aa, synthetic construct
  REGION 1..6: note = Synthetic Construct
EKLDFK

SEQ ID NO: 10705 - protein, 6 aa, synthetic construct
  REGION 1..6: note = Synthetic Construct
EKLDGK

SEQ ID NO: 10706 - protein, 6 aa, synthetic construct
  REGION 1..6: note = Synthetic Construct
EKLDHK

SEQ ID NO: 10707 - protein, 6 aa, synthetic construct
  REGION 1..6: note = Synthetic Construct
EKLDIK

SEQ ID NO: 10708 - protein, 6 aa, synthetic construct
  REGION 1..6: note = Synthetic Construct
EKLDLK

SEQ ID NO: 10709 - protein, 6 aa, synthetic construct
  REGION 1..6: note = Synthetic Construct
EKLDNK

SEQ ID NO: 10710 - protein, 6 aa, synthetic construct
  REGION 1..6: note = Synthetic Construct
EKLDQK

SEQ ID NO: 10711 - protein, 6 aa, synthetic construct
  REGION 1..6: note = Synthetic Construct
EKLDRK

SEQ ID NO: 10712 - protein, 6 aa, synthetic construct
  REGION 1..6: note = Synthetic Construct
EKLDSK

SEQ ID NO: 10713 - protein, 6 aa, synthetic construct
  REGION 1..6: note = Synthetic Construct
EKLDTK

SEQ ID NO: 10714 - protein, 6 aa, synthetic construct
  REGION 1..6: note = Synthetic Construct
EKLDYK

SEQ ID NO: 10715 - protein, 6 aa, synthetic construct
  REGION 1..6: note = Synthetic Construct
EKLEAK

SEQ ID NO: 10716 - protein, 6 aa, synthetic construct
  REGION 1..6: note = Synthetic Construct
EKLEDK

SEQ ID NO: 10717 - protein, 6 aa, synthetic construct
  REGION 1..6: note = Synthetic Construct
EKLEEK

SEQ ID NO: 10718 - protein, 6 aa, synthetic construct
  REGION 1..6: note = Synthetic Construct
EKLEFK

SEQ ID NO: 10719 - protein, 6 aa, synthetic construct
  REGION 1..6: note = Synthetic Construct
EKLEGK

SEQ ID NO: 10720 - protein, 6 aa, synthetic construct
  REGION 1..6: note = Synthetic Construct
EKLEHK

SEQ ID NO: 10721 - protein, 6 aa, synthetic construct
  REGION 1..6: note = Synthetic Construct
EKLEIK

SEQ ID NO: 10722 - protein, 6 aa, synthetic construct
  REGION 1..6: note = Synthetic Construct
EKLELK

SEQ ID NO: 10723 - protein, 6 aa, synthetic construct
  REGION 1..6: note = Synthetic Construct
EKLENK

SEQ ID NO: 10724 - protein, 6 aa, synthetic construct
  REGION 1..6: note = Synthetic Construct
EKLEQK

SEQ ID NO: 10725 - protein, 6 aa, synthetic construct
  REGION 1..6: note = Synthetic Construct
EKLERK

SEQ ID NO: 10726 - protein, 6 aa, synthetic construct
  REGION 1..6: note = Synthetic Construct
EKLESK

SEQ ID NO: 10727 - protein, 6 aa, synthetic construct
  REGION 1..6: note = Synthetic Construct
EKLETK

SEQ ID NO: 10728 - protein, 6 aa, synthetic construct
  REGION 1..6: note = Synthetic Construct
EKLEYK

SEQ ID NO: 10729 - protein, 6 aa, synthetic construct
  REGION 1..6: note = Synthetic Construct
EKLFAK

SEQ ID NO: 10730 - protein, 6 aa, synthetic construct
  REGION 1..6: note = Synthetic Construct
EKLFDK

SEQ ID NO: 10731 - protein, 6 aa, synthetic construct
  REGION 1..6: note = Synthetic Construct
EKLFEK

SEQ ID NO: 10732 - protein, 6 aa, synthetic construct
  REGION 1..6: note = Synthetic Construct
EKLFFK

SEQ ID NO: 10733 - protein, 6 aa, synthetic construct
  REGION 1..6: note = Synthetic Construct
EKLFGK

SEQ ID NO: 10734 - protein, 6 aa, synthetic construct
  REGION 1..6: note = Synthetic Construct
EKLFHK

SEQ ID NO: 10735 - protein, 6 aa, synthetic construct
  REGION 1..6: note = Synthetic Construct
EKLFIK

SEQ ID NO: 10736 - protein, 6 aa, synthetic construct
  REGION 1..6: note = Synthetic Construct
EKLFLK

SEQ ID NO: 10737 - protein, 6 aa, synthetic construct
  REGION 1..6: note = Synthetic Construct
EKLFNK

SEQ ID NO: 10738 - protein, 6 aa, synthetic construct
  REGION 1..6: note = Synthetic Construct
EKLFQK

SEQ ID NO: 10739 - protein, 6 aa, synthetic construct
  REGION 1..6: note = Synthetic Construct
EKLFRK

SEQ ID NO: 10740 - protein, 6 aa, synthetic construct
  REGION 1..6: note = Synthetic Construct
EKLFSK

SEQ ID NO: 10741 - protein, 6 aa, synthetic construct
  REGION 1..6: note = Synthetic Construct
EKLFTK

SEQ ID NO: 10742 - protein, 6 aa, synthetic construct
  REGION 1..6: note = Synthetic Construct
EKLFYK

SEQ ID NO: 10743 - protein, 6 aa, synthetic construct
  REGION 1..6: note = Synthetic Construct
EKLGAK

SEQ ID NO: 10744 - protein, 6 aa, synthetic construct
  REGION 1..6: note = Synthetic Construct
EKLGDK

SEQ ID NO: 10745 - protein, 6 aa, synthetic construct
  REGION 1..6: note = Synthetic Construct
EKLGEK

SEQ ID NO: 10746 - protein, 6 aa, synthetic construct
  REGION 1..6: note = Synthetic Construct
EKLGFK

SEQ ID NO: 10747 - protein, 6 aa, synthetic construct
  REGION 1..6: note = Synthetic Construct
EKLGGK

SEQ ID NO: 10748 - protein, 6 aa, synthetic construct
  REGION 1..6: note = Synthetic Construct
EKLGHK

SEQ ID NO: 10749 - protein, 6 aa, synthetic construct
  REGION 1..6: note = Synthetic Construct
EKLGIK

SEQ ID NO: 10750 - protein, 6 aa, synthetic construct
  REGION 1..6: note = Synthetic Construct
EKLGLK

SEQ ID NO: 10751 - protein, 6 aa, synthetic construct
  REGION 1..6: note = Synthetic Construct
EKLGNK

SEQ ID NO: 10752 - protein, 6 aa, synthetic construct
  REGION 1..6: note = Synthetic Construct
EKLGQK

SEQ ID NO: 10753 - protein, 6 aa, synthetic construct
  REGION 1..6: note = Synthetic Construct
EKLGRK

SEQ ID NO: 10754 - protein, 6 aa, synthetic construct
  REGION 1..6: note = Synthetic Construct
EKLGSK

SEQ ID NO: 10755 - protein, 6 aa, synthetic construct
  REGION 1..6: note = Synthetic Construct
EKLGTK

SEQ ID NO: 10756 - protein, 6 aa, synthetic construct
  REGION 1..6: note = Synthetic Construct
EKLGYK

SEQ ID NO: 10757 - protein, 6 aa, synthetic construct
  REGION 1..6: note = Synthetic Construct
EKLHAK

SEQ ID NO: 10758 - protein, 6 aa, synthetic construct
  REGION 1..6: note = Synthetic Construct
EKLHDK

SEQ ID NO: 10759 - protein, 6 aa, synthetic construct
  REGION 1..6: note = Synthetic Construct
EKLHEK

SEQ ID NO: 10760 - protein, 6 aa, synthetic construct
  REGION 1..6: note = Synthetic Construct
EKLHFK

SEQ ID NO: 10761 - protein, 6 aa, synthetic construct
  REGION 1..6: note = Synthetic Construct
EKLHGK

SEQ ID NO: 10762 - protein, 6 aa, synthetic construct
  REGION 1..6: note = Synthetic Construct
EKLHHK

SEQ ID NO: 10763 - protein, 6 aa, synthetic construct
  REGION 1..6: note = Synthetic Construct
EKLHIK

SEQ ID NO: 10764 - protein, 6 aa, synthetic construct
  REGION 1..6: note = Synthetic Construct
EKLHLK

SEQ ID NO: 10765 - protein, 6 aa, synthetic construct
  REGION 1..6: note = Synthetic Construct
EKLHNK

SEQ ID NO: 10766 - protein, 6 aa, synthetic construct
  REGION 1..6: note = Synthetic Construct
EKLHQK

SEQ ID NO: 10767 - protein, 6 aa, synthetic construct
  REGION 1..6: note = Synthetic Construct
EKLHRK

SEQ ID NO: 10768 - protein, 6 aa, synthetic construct
  REGION 1..6: note = Synthetic Construct
EKLHSK

SEQ ID NO: 10769 - protein, 6 aa, synthetic construct
  REGION 1..6: note = Synthetic Construct
EKLHTK

SEQ ID NO: 10770 - protein, 6 aa, synthetic construct
  REGION 1..6: note = Synthetic Construct
EKLHYK

SEQ ID NO: 10771 - protein, 6 aa, synthetic construct
  REGION 1..6: note = Synthetic Construct
EKLIAK

SEQ ID NO: 10772 - protein, 6 aa, synthetic construct
  REGION 1..6: note = Synthetic Construct
EKLIDK

SEQ ID NO: 10773 - protein, 6 aa, synthetic construct
  REGION 1..6: note = Synthetic Construct
EKLIEK

SEQ ID NO: 10774 - protein, 6 aa, synthetic construct
  REGION 1..6: note = Synthetic Construct
EKLIFK

SEQ ID NO: 10775 - protein, 6 aa, synthetic construct
  REGION 1..6: note = Synthetic Construct
EKLIGK

SEQ ID NO: 10776 - protein, 6 aa, synthetic construct
  REGION 1..6: note = Synthetic Construct
EKLIHK

SEQ ID NO: 10777 - protein, 6 aa, synthetic construct
  REGION 1..6: note = Synthetic Construct
EKLIIK

SEQ ID NO: 10778 - protein, 6 aa, synthetic construct
  REGION 1..6: note = Synthetic Construct
EKLILK

SEQ ID NO: 10779 - protein, 6 aa, synthetic construct
  REGION 1..6: note = Synthetic Construct
EKLINK

SEQ ID NO: 10780 - protein, 6 aa, synthetic construct
  REGION 1..6: note = Synthetic Construct
EKLIQK

SEQ ID NO: 10781 - protein, 6 aa, synthetic construct
  REGION 1..6: note = Synthetic Construct
EKLIRK

SEQ ID NO: 10782 - protein, 6 aa, synthetic construct
  REGION 1..6: note = Synthetic Construct
EKLISK

SEQ ID NO: 10783 - protein, 6 aa, synthetic construct
  REGION 1..6: note = Synthetic Construct
EKLITK

SEQ ID NO: 10784 - protein, 6 aa, synthetic construct
  REGION 1..6: note = Synthetic Construct
EKLIYK

SEQ ID NO: 10785 - protein, 6 aa, synthetic construct
  REGION 1..6: note = Synthetic Construct
EKLLAK

SEQ ID NO: 10786 - protein, 6 aa, synthetic construct
  REGION 1..6: note = Synthetic Construct
EKLLDK

SEQ ID NO: 10787 - protein, 6 aa, synthetic construct
  REGION 1..6: note = Synthetic Construct
EKLLEK

SEQ ID NO: 10788 - protein, 6 aa, synthetic construct
  REGION 1..6: note = Synthetic Construct
EKLLFK

SEQ ID NO: 10789 - protein, 6 aa, synthetic construct
  REGION 1..6: note = Synthetic Construct
EKLLGK

SEQ ID NO: 10790 - protein, 6 aa, synthetic construct
  REGION 1..6: note = Synthetic Construct
EKLLHK

SEQ ID NO: 10791 - protein, 6 aa, synthetic construct
  REGION 1..6: note = Synthetic Construct
EKLLIK

SEQ ID NO: 10792 - protein, 6 aa, synthetic construct
  REGION 1..6: note = Synthetic Construct
EKLLLK

SEQ ID NO: 10793 - protein, 6 aa, synthetic construct
  REGION 1..6: note = Synthetic Construct
EKLLNK

SEQ ID NO: 10794 - protein, 6 aa, synthetic construct
  REGION 1..6: note = Synthetic Construct
EKLLQK

SEQ ID NO: 10795 - protein, 6 aa, synthetic construct
  REGION 1..6: note = Synthetic Construct
EKLLRK

SEQ ID NO: 10796 - protein, 6 aa, synthetic construct
  REGION 1..6: note = Synthetic Construct
EKLLSK

SEQ ID NO: 10797 - protein, 6 aa, synthetic construct
  REGION 1..6: note = Synthetic Construct
EKLLTK

SEQ ID NO: 10798 - protein, 6 aa, synthetic construct
  REGION 1..6: note = Synthetic Construct
EKLLYK

SEQ ID NO: 10799 - protein, 6 aa, synthetic construct
  REGION 1..6: note = Synthetic Construct
EKLNAK

SEQ ID NO: 10800 - protein, 6 aa, synthetic construct
  REGION 1..6: note = Synthetic Construct
EKLNDK

SEQ ID NO: 10801 - protein, 6 aa, synthetic construct
  REGION 1..6: note = Synthetic Construct
EKLNEK

SEQ ID NO: 10802 - protein, 6 aa, synthetic construct
  REGION 1..6: note = Synthetic Construct
EKLNFK

SEQ ID NO: 10803 - protein, 6 aa, synthetic construct
  REGION 1..6: note = Synthetic Construct
EKLNGK

SEQ ID NO: 10804 - protein, 6 aa, synthetic construct
  REGION 1..6: note = Synthetic Construct
EKLNHK

SEQ ID NO: 10805 - protein, 6 aa, synthetic construct
  REGION 1..6: note = Synthetic Construct
EKLNIK

SEQ ID NO: 10806 - protein, 6 aa, synthetic construct
  REGION 1..6: note = Synthetic Construct
EKLNLK

SEQ ID NO: 10807 - protein, 6 aa, synthetic construct
  REGION 1..6: note = Synthetic Construct
EKLNNK

SEQ ID NO: 10808 - protein, 6 aa, synthetic construct
  REGION 1..6: note = Synthetic Construct
EKLNQK

SEQ ID NO: 10809 - protein, 6 aa, synthetic construct
  REGION 1..6: note = Synthetic Construct
EKLNRK

SEQ ID NO: 10810 - protein, 6 aa, synthetic construct
  REGION 1..6: note = Synthetic Construct
EKLNSK

SEQ ID NO: 10811 - protein, 6 aa, synthetic construct
  REGION 1..6: note = Synthetic Construct
EKLNTK

SEQ ID NO: 10812 - protein, 6 aa, synthetic construct
  REGION 1..6: note = Synthetic Construct
EKLNYK

SEQ ID NO: 10813 - protein, 6 aa, synthetic construct
  REGION 1..6: note = Synthetic Construct
EKLQAK

SEQ ID NO: 10814 - protein, 6 aa, synthetic construct
  REGION 1..6: note = Synthetic Construct
EKLQDK

SEQ ID NO: 10815 - protein, 6 aa, synthetic construct
  REGION 1..6: note = Synthetic Construct
EKLQEK

SEQ ID NO: 10816 - protein, 6 aa, synthetic construct
  REGION 1..6: note = Synthetic Construct
EKLQFK

SEQ ID NO: 10817 - protein, 6 aa, synthetic construct
  REGION 1..6: note = Synthetic Construct
EKLQGK

SEQ ID NO: 10818 - protein, 6 aa, synthetic construct
  REGION 1..6: note = Synthetic Construct
EKLQHK

SEQ ID NO: 10819 - protein, 6 aa, synthetic construct
  REGION 1..6: note = Synthetic Construct
EKLQIK

SEQ ID NO: 10820 - protein, 6 aa, synthetic construct
  REGION 1..6: note = Synthetic Construct
EKLQLK

SEQ ID NO: 10821 - protein, 6 aa, synthetic construct
  REGION 1..6: note = Synthetic Construct
EKLQNK

SEQ ID NO: 10822 - protein, 6 aa, synthetic construct
  REGION 1..6: note = Synthetic Construct
EKLQQK

SEQ ID NO: 10823 - protein, 6 aa, synthetic construct
  REGION 1..6: note = Synthetic Construct
EKLQRK

SEQ ID NO: 10824 - protein, 6 aa, synthetic construct
  REGION 1..6: note = Synthetic Construct
EKLQSK

SEQ ID NO: 10825 - protein, 6 aa, synthetic construct
  REGION 1..6: note = Synthetic Construct
EKLQTK

SEQ ID NO: 10826 - protein, 6 aa, synthetic construct
  REGION 1..6: note = Synthetic Construct
EKLQYK

SEQ ID NO: 10827 - protein, 6 aa, synthetic construct
  REGION 1..6: note = Synthetic Construct
EKLRAK

SEQ ID NO: 10828 - protein, 6 aa, synthetic construct
  REGION 1..6: note = Synthetic Construct
EKLRDK

SEQ ID NO: 10829 - protein, 6 aa, synthetic construct
  REGION 1..6: note = Synthetic Construct
EKLREK

SEQ ID NO: 10830 - protein, 6 aa, synthetic construct
  REGION 1..6: note = Synthetic Construct
EKLRFK

SEQ ID NO: 10831 - protein, 6 aa, synthetic construct
  REGION 1..6: note = Synthetic Construct
EKLRGK

SEQ ID NO: 10832 - protein, 6 aa, synthetic construct
  REGION 1..6: note = Synthetic Construct
EKLRHK

SEQ ID NO: 10833 - protein, 6 aa, synthetic construct
  REGION 1..6: note = Synthetic Construct
EKLRIK

SEQ ID NO: 10834 - protein, 6 aa, synthetic construct
  REGION 1..6: note = Synthetic Construct
EKLRLK

SEQ ID NO: 10835 - protein, 6 aa, synthetic construct
  REGION 1..6: note = Synthetic Construct
EKLRNK

SEQ ID NO: 10836 - protein, 6 aa, synthetic construct
  REGION 1..6: note = Synthetic Construct
EKLRQK

SEQ ID NO: 10837 - protein, 6 aa, synthetic construct
  REGION 1..6: note = Synthetic Construct
EKLRRK

SEQ ID NO: 10838 - protein, 6 aa, synthetic construct
  REGION 1..6: note = Synthetic Construct
EKLRSK

SEQ ID NO: 10839 - protein, 6 aa, synthetic construct
  REGION 1..6: note = Synthetic Construct
EKLRTK

SEQ ID NO: 10840 - protein, 6 aa, synthetic construct
  REGION 1..6: note = Synthetic Construct
EKLRYK

SEQ ID NO: 10841 - protein, 6 aa, synthetic construct
  REGION 1..6: note = Synthetic Construct
EKLSAK

SEQ ID NO: 10842 - protein, 6 aa, synthetic construct
  REGION 1..6: note = Synthetic Construct
EKLSDK

SEQ ID NO: 10843 - protein, 6 aa, synthetic construct
  REGION 1..6: note = Synthetic Construct
EKLSEK

SEQ ID NO: 10844 - protein, 6 aa, synthetic construct
  REGION 1..6: note = Synthetic Construct
EKLSFK

SEQ ID NO: 10845 - protein, 6 aa, synthetic construct
  REGION 1..6: note = Synthetic Construct
EKLSGK

SEQ ID NO: 10846 - protein, 6 aa, synthetic construct
  REGION 1..6: note = Synthetic Construct
EKLSHK

SEQ ID NO: 10847 - protein, 6 aa, synthetic construct
  REGION 1..6: note = Synthetic Construct
EKLSIK

SEQ ID NO: 10848 - protein, 6 aa, synthetic construct
  REGION 1..6: note = Synthetic Construct
EKLSLK

SEQ ID NO: 10849 - protein, 6 aa, synthetic construct
  REGION 1..6: note = Synthetic Construct
EKLSNK

SEQ ID NO: 10850 - protein, 6 aa, synthetic construct
  REGION 1..6: note = Synthetic Construct
EKLSQK

SEQ ID NO: 10851 - protein, 6 aa, synthetic construct
  REGION 1..6: note = Synthetic Construct
EKLSRK

SEQ ID NO: 10852 - protein, 6 aa, synthetic construct
  REGION 1..6: note = Synthetic Construct
EKLSSK

SEQ ID NO: 10853 - protein, 6 aa, synthetic construct
  REGION 1..6: note = Synthetic Construct
EKLSTK

SEQ ID NO: 10854 - protein, 6 aa, synthetic construct
  REGION 1..6: note = Synthetic Construct
EKLSYK

SEQ ID NO: 10855 - protein, 6 aa, synthetic construct
  REGION 1..6: note = Synthetic Construct
EKLTAK

SEQ ID NO: 10856 - protein, 6 aa, synthetic construct
  REGION 1..6: note = Synthetic Construct
EKLTDK

SEQ ID NO: 10857 - protein, 6 aa, synthetic construct
  REGION 1..6: note = Synthetic Construct
EKLTEK

SEQ ID NO: 10858 - protein, 6 aa, synthetic construct
  REGION 1..6: note = Synthetic Construct
EKLTFK

SEQ ID NO: 10859 - protein, 6 aa, synthetic construct
  REGION 1..6: note = Synthetic Construct
EKLTGK

SEQ ID NO: 10860 - protein, 6 aa, synthetic construct
  REGION 1..6: note = Synthetic Construct
EKLTHK

SEQ ID NO: 10861 - protein, 6 aa, synthetic construct
  REGION 1..6: note = Synthetic Construct
EKLTIK

SEQ ID NO: 10862 - protein, 6 aa, synthetic construct
  REGION 1..6: note = Synthetic Construct
EKLTLK

SEQ ID NO: 10863 - protein, 6 aa, synthetic construct
  REGION 1..6: note = Synthetic Construct
EKLTNK

SEQ ID NO: 10864 - protein, 6 aa, synthetic construct
  REGION 1..6: note = Synthetic Construct
EKLTQK

SEQ ID NO: 10865 - protein, 6 aa, synthetic construct
  REGION 1..6: note = Synthetic Construct
EKLTRK

SEQ ID NO: 10866 - protein, 6 aa, synthetic construct
  REGION 1..6: note = Synthetic Construct
EKLTSK

SEQ ID NO: 10867 - protein, 6 aa, synthetic construct
  REGION 1..6: note = Synthetic Construct
EKLTTK

SEQ ID NO: 10868 - protein, 6 aa, synthetic construct
  REGION 1..6: note = Synthetic Construct
EKLTYK

SEQ ID NO: 10869 - protein, 6 aa, synthetic construct
  REGION 1..6: note = Synthetic Construct
EKLYAK

SEQ ID NO: 10870 - protein, 6 aa, synthetic construct
  REGION 1..6: note = Synthetic Construct
EKLYDK

SEQ ID NO: 10871 - protein, 6 aa, synthetic construct
  REGION 1..6: note = Synthetic Construct
EKLYEK

SEQ ID NO: 10872 - protein, 6 aa, synthetic construct
  REGION 1..6: note = Synthetic Construct
EKLYFK

SEQ ID NO: 10873 - protein, 6 aa, synthetic construct
  REGION 1..6: note = Synthetic Construct
EKLYGK

SEQ ID NO: 10874 - protein, 6 aa, synthetic construct
  REGION 1..6: note = Synthetic Construct
EKLYHK

SEQ ID NO: 10875 - protein, 6 aa, synthetic construct
  REGION 1..6: note = Synthetic Construct
EKLYIK

SEQ ID NO: 10876 - protein, 6 aa, synthetic construct
  REGION 1..6: note = Synthetic Construct
EKLYLK

SEQ ID NO: 10877 - protein, 6 aa, synthetic construct
  REGION 1..6: note = Synthetic Construct
EKLYNK

SEQ ID NO: 10878 - protein, 6 aa, synthetic construct
  REGION 1..6: note = Synthetic Construct
EKLYQK

SEQ ID NO: 10879 - protein, 6 aa, synthetic construct
  REGION 1..6: note = Synthetic Construct
EKLYRK

SEQ ID NO: 10880 - protein, 6 aa, synthetic construct
  REGION 1..6: note = Synthetic Construct
EKLYSK

SEQ ID NO: 10881 - protein, 6 aa, synthetic construct
  REGION 1..6: note = Synthetic Construct
EKLYTK

SEQ ID NO: 10882 - protein, 6 aa, synthetic construct
  REGION 1..6: note = Synthetic Construct
EKLYYK

SEQ ID NO: 10883 - protein, 6 aa, synthetic construct
  REGION 1..6: note = Synthetic Construct
EKNAAK

SEQ ID NO: 10884 - protein, 6 aa, synthetic construct
  REGION 1..6: note = Synthetic Construct
EKNADK

SEQ ID NO: 10885 - protein, 6 aa, synthetic construct
  REGION 1..6: note = Synthetic Construct
EKNAEK

SEQ ID NO: 10886 - protein, 6 aa, synthetic construct
  REGION 1..6: note = Synthetic Construct
EKNAFK

SEQ ID NO: 10887 - protein, 6 aa, synthetic construct
  REGION 1..6: note = Synthetic Construct
EKNAGK

SEQ ID NO: 10888 - protein, 6 aa, synthetic construct
  REGION 1..6: note = Synthetic Construct
EKNAHK

SEQ ID NO: 10889 - protein, 6 aa, synthetic construct
  REGION 1..6: note = Synthetic Construct
EKNAIK

SEQ ID NO: 10890 - protein, 6 aa, synthetic construct
  REGION 1..6: note = Synthetic Construct
EKNALK

SEQ ID NO: 10891 - protein, 6 aa, synthetic construct
  REGION 1..6: note = Synthetic Construct
EKNANK

SEQ ID NO: 10892 - protein, 6 aa, synthetic construct
  REGION 1..6: note = Synthetic Construct
EKNAQK

SEQ ID NO: 10893 - protein, 6 aa, synthetic construct
  REGION 1..6: note = Synthetic Construct
EKNARK

SEQ ID NO: 10894 - protein, 6 aa, synthetic construct
  REGION 1..6: note = Synthetic Construct
EKNASK

SEQ ID NO: 10895 - protein, 6 aa, synthetic construct
  REGION 1..6: note = Synthetic Construct
EKNATK

SEQ ID NO: 10896 - protein, 6 aa, synthetic construct
  REGION 1..6: note = Synthetic Construct
EKNAYK

SEQ ID NO: 10897 - protein, 6 aa, synthetic construct
  REGION 1..6: note = Synthetic Construct
EKNDAK

SEQ ID NO: 10898 - protein, 6 aa, synthetic construct
  REGION 1..6: note = Synthetic Construct
EKNDDK

SEQ ID NO: 10899 - protein, 6 aa, synthetic construct
  REGION 1..6: note = Synthetic Construct
EKNDEK

SEQ ID NO: 10900 - protein, 6 aa, synthetic construct
  REGION 1..6: note = Synthetic Construct
EKNDFK

SEQ ID NO: 10901 - protein, 6 aa, synthetic construct
  REGION 1..6: note = Synthetic Construct
EKNDGK

SEQ ID NO: 10902 - protein, 6 aa, synthetic construct
  REGION 1..6: note = Synthetic Construct
EKNDHK

SEQ ID NO: 10903 - protein, 6 aa, synthetic construct
  REGION 1..6: note = Synthetic Construct
EKNDIK

SEQ ID NO: 10904 - protein, 6 aa, synthetic construct
  REGION 1..6: note = Synthetic Construct
EKNDLK

SEQ ID NO: 10905 - protein, 6 aa, synthetic construct
  REGION 1..6: note = Synthetic Construct
EKNDNK

SEQ ID NO: 10906 - protein, 6 aa, synthetic construct
  REGION 1..6: note = Synthetic Construct
EKNDQK

SEQ ID NO: 10907 - protein, 6 aa, synthetic construct
  REGION 1..6: note = Synthetic Construct
EKNDRK

SEQ ID NO: 10908 - protein, 6 aa, synthetic construct
  REGION 1..6: note = Synthetic Construct
EKNDSK

SEQ ID NO: 10909 - protein, 6 aa, synthetic construct
  REGION 1..6: note = Synthetic Construct
EKNDTK

SEQ ID NO: 10910 - protein, 6 aa, synthetic construct
  REGION 1..6: note = Synthetic Construct
EKNDYK

SEQ ID NO: 10911 - protein, 6 aa, synthetic construct
  REGION 1..6: note = Synthetic Construct
EKNEAK

SEQ ID NO: 10912 - protein, 6 aa, synthetic construct
  REGION 1..6: note = Synthetic Construct
EKNEDK

SEQ ID NO: 10913 - protein, 6 aa, synthetic construct
  REGION 1..6: note = Synthetic Construct
EKNEEK

SEQ ID NO: 10914 - protein, 6 aa, synthetic construct
  REGION 1..6: note = Synthetic Construct
EKNEFK

SEQ ID NO: 10915 - protein, 6 aa, synthetic construct
  REGION 1..6: note = Synthetic Construct
EKNEGK

SEQ ID NO: 10916 - protein, 6 aa, synthetic construct
  REGION 1..6: note = Synthetic Construct
EKNEHK

SEQ ID NO: 10917 - protein, 6 aa, synthetic construct
  REGION 1..6: note = Synthetic Construct
EKNEIK

SEQ ID NO: 10918 - protein, 6 aa, synthetic construct
  REGION 1..6: note = Synthetic Construct
EKNELK

SEQ ID NO: 10919 - protein, 6 aa, synthetic construct
  REGION 1..6: note = Synthetic Construct
EKNENK

SEQ ID NO: 10920 - protein, 6 aa, synthetic construct
  REGION 1..6: note = Synthetic Construct
EKNEQK

SEQ ID NO: 10921 - protein, 6 aa, synthetic construct
  REGION 1..6: note = Synthetic Construct
EKNERK

SEQ ID NO: 10922 - protein, 6 aa, synthetic construct
  REGION 1..6: note = Synthetic Construct
EKNESK

SEQ ID NO: 10923 - protein, 6 aa, synthetic construct
  REGION 1..6: note = Synthetic Construct
EKNETK

SEQ ID NO: 10924 - protein, 6 aa, synthetic construct
  REGION 1..6: note = Synthetic Construct
EKNEYK

SEQ ID NO: 10925 - protein, 6 aa, synthetic construct
  REGION 1..6: note = Synthetic Construct
EKNFAK

SEQ ID NO: 10926 - protein, 6 aa, synthetic construct
  REGION 1..6: note = Synthetic Construct
EKNFDK

SEQ ID NO: 10927 - protein, 6 aa, synthetic construct
  REGION 1..6: note = Synthetic Construct
EKNFEK

SEQ ID NO: 10928 - protein, 6 aa, synthetic construct
  REGION 1..6: note = Synthetic Construct
EKNFFK

SEQ ID NO: 10929 - protein, 6 aa, synthetic construct
  REGION 1..6: note = Synthetic Construct
EKNFGK

SEQ ID NO: 10930 - protein, 6 aa, synthetic construct
  REGION 1..6: note = Synthetic Construct
EKNFHK

SEQ ID NO: 10931 - protein, 6 aa, synthetic construct
  REGION 1..6: note = Synthetic Construct
EKNFIK

SEQ ID NO: 10932 - protein, 6 aa, synthetic construct
  REGION 1..6: note = Synthetic Construct
EKNFLK

SEQ ID NO: 10933 - protein, 6 aa, synthetic construct
  REGION 1..6: note = Synthetic Construct
EKNFNK

SEQ ID NO: 10934 - protein, 6 aa, synthetic construct
  REGION 1..6: note = Synthetic Construct
EKNFQK

SEQ ID NO: 10935 - protein, 6 aa, synthetic construct
  REGION 1..6: note = Synthetic Construct
EKNFRK

SEQ ID NO: 10936 - protein, 6 aa, synthetic construct
  REGION 1..6: note = Synthetic Construct
EKNFSK

SEQ ID NO: 10937 - protein, 6 aa, synthetic construct
  REGION 1..6: note = Synthetic Construct
EKNFTK

SEQ ID NO: 10938 - protein, 6 aa, synthetic construct
  REGION 1..6: note = Synthetic Construct
EKNFYK

SEQ ID NO: 10939 - protein, 6 aa, synthetic construct
  REGION 1..6: note = Synthetic Construct
EKNGAK

SEQ ID NO: 10940 - protein, 6 aa, synthetic construct
  REGION 1..6: note = Synthetic Construct
EKNGDK

SEQ ID NO: 10941 - protein, 6 aa, synthetic construct
  REGION 1..6: note = Synthetic Construct
EKNGEK

SEQ ID NO: 10942 - protein, 6 aa, synthetic construct
  REGION 1..6: note = Synthetic Construct
EKNGFK

SEQ ID NO: 10943 - protein, 6 aa, synthetic construct
  REGION 1..6: note = Synthetic Construct
EKNGGK

SEQ ID NO: 10944 - protein, 6 aa, synthetic construct
  REGION 1..6: note = Synthetic Construct
EKNGHK

SEQ ID NO: 10945 - protein, 6 aa, synthetic construct
  REGION 1..6: note = Synthetic Construct
EKNGIK

SEQ ID NO: 10946 - protein, 6 aa, synthetic construct
  REGION 1..6: note = Synthetic Construct
EKNGLK

SEQ ID NO: 10947 - protein, 6 aa, synthetic construct
  REGION 1..6: note = Synthetic Construct
EKNGNK

SEQ ID NO: 10948 - protein, 6 aa, synthetic construct
  REGION 1..6: note = Synthetic Construct
EKNGQK

SEQ ID NO: 10949 - protein, 6 aa, synthetic construct
  REGION 1..6: note = Synthetic Construct
EKNGRK

SEQ ID NO: 10950 - protein, 6 aa, synthetic construct
  REGION 1..6: note = Synthetic Construct
EKNGSK

SEQ ID NO: 10951 - protein, 6 aa, synthetic construct
  REGION 1..6: note = Synthetic Construct
EKNGTK

SEQ ID NO: 10952 - protein, 6 aa, synthetic construct
  REGION 1..6: note = Synthetic Construct
EKNGYK

SEQ ID NO: 10953 - protein, 6 aa, synthetic construct
  REGION 1..6: note = Synthetic Construct
EKNHAK

SEQ ID NO: 10954 - protein, 6 aa, synthetic construct
  REGION 1..6: note = Synthetic Construct
EKNHDK

SEQ ID NO: 10955 - protein, 6 aa, synthetic construct
  REGION 1..6: note = Synthetic Construct
EKNHEK

SEQ ID NO: 10956 - protein, 6 aa, synthetic construct
  REGION 1..6: note = Synthetic Construct
EKNHFK

SEQ ID NO: 10957 - protein, 6 aa, synthetic construct
  REGION 1..6: note = Synthetic Construct
EKNHGK

SEQ ID NO: 10958 - protein, 6 aa, synthetic construct
  REGION 1..6: note = Synthetic Construct
EKNHHK

SEQ ID NO: 10959 - protein, 6 aa, synthetic construct
  REGION 1..6: note = Synthetic Construct
EKNHIK

SEQ ID NO: 10960 - protein, 6 aa, synthetic construct
  REGION 1..6: note = Synthetic Construct
EKNHLK

SEQ ID NO: 10961 - protein, 6 aa, synthetic construct
  REGION 1..6: note = Synthetic Construct
EKNHNK

SEQ ID NO: 10962 - protein, 6 aa, synthetic construct
  REGION 1..6: note = Synthetic Construct
EKNHQK

SEQ ID NO: 10963 - protein, 6 aa, synthetic construct
  REGION 1..6: note = Synthetic Construct
EKNHRK

SEQ ID NO: 10964 - protein, 6 aa, synthetic construct
  REGION 1..6: note = Synthetic Construct
EKNHSK

SEQ ID NO: 10965 - protein, 6 aa, synthetic construct
  REGION 1..6: note = Synthetic Construct
EKNHTK

SEQ ID NO: 10966 - protein, 6 aa, synthetic construct
  REGION 1..6: note = Synthetic Construct
EKNHYK

SEQ ID NO: 10967 - protein, 6 aa, synthetic construct
  REGION 1..6: note = Synthetic Construct
EKNIAK

SEQ ID NO: 10968 - protein, 6 aa, synthetic construct
  REGION 1..6: note = Synthetic Construct
EKNIDK

SEQ ID NO: 10969 - protein, 6 aa, synthetic construct
  REGION 1..6: note = Synthetic Construct
EKNIEK

SEQ ID NO: 10970 - protein, 6 aa, synthetic construct
  REGION 1..6: note = Synthetic Construct
EKNIFK

SEQ ID NO: 10971 - protein, 6 aa, synthetic construct
  REGION 1..6: note = Synthetic Construct
EKNIGK

SEQ ID NO: 10972 - protein, 6 aa, synthetic construct
  REGION 1..6: note = Synthetic Construct
EKNIHK

SEQ ID NO: 10973 - protein, 6 aa, synthetic construct
  REGION 1..6: note = Synthetic Construct
EKNIIK

SEQ ID NO: 10974 - protein, 6 aa, synthetic construct
  REGION 1..6: note = Synthetic Construct
EKNILK

SEQ ID NO: 10975 - protein, 6 aa, synthetic construct
  REGION 1..6: note = Synthetic Construct
EKNINK

SEQ ID NO: 10976 - protein, 6 aa, synthetic construct
  REGION 1..6: note = Synthetic Construct
EKNIQK

SEQ ID NO: 10977 - protein, 6 aa, synthetic construct
  REGION 1..6: note = Synthetic Construct
EKNIRK

SEQ ID NO: 10978 - protein, 6 aa, synthetic construct
  REGION 1..6: note = Synthetic Construct
EKNISK

SEQ ID NO: 10979 - protein, 6 aa, synthetic construct
  REGION 1..6: note = Synthetic Construct
EKNITK

SEQ ID NO: 10980 - protein, 6 aa, synthetic construct
  REGION 1..6: note = Synthetic Construct
EKNIYK

SEQ ID NO: 10981 - protein, 6 aa, synthetic construct
  REGION 1..6: note = Synthetic Construct
EKNLAK

SEQ ID NO: 10982 - protein, 6 aa, synthetic construct
  REGION 1..6: note = Synthetic Construct
EKNLDK

SEQ ID NO: 10983 - protein, 6 aa, synthetic construct
  REGION 1..6: note = Synthetic Construct
EKNLEK

SEQ ID NO: 10984 - protein, 6 aa, synthetic construct
  REGION 1..6: note = Synthetic Construct
EKNLFK

SEQ ID NO: 10985 - protein, 6 aa, synthetic construct
  REGION 1..6: note = Synthetic Construct
EKNLGK

SEQ ID NO: 10986 - protein, 6 aa, synthetic construct
  REGION 1..6: note = Synthetic Construct
EKNLHK

SEQ ID NO: 10987 - protein, 6 aa, synthetic construct
  REGION 1..6: note = Synthetic Construct
EKNLIK

SEQ ID NO: 10988 - protein, 6 aa, synthetic construct
  REGION 1..6: note = Synthetic Construct
EKNLLK

SEQ ID NO: 10989 - protein, 6 aa, synthetic construct
  REGION 1..6: note = Synthetic Construct
EKNLNK

SEQ ID NO: 10990 - protein, 6 aa, synthetic construct
  REGION 1..6: note = Synthetic Construct
EKNLQK

SEQ ID NO: 10991 - protein, 6 aa, synthetic construct
  REGION 1..6: note = Synthetic Construct
EKNLRK

SEQ ID NO: 10992 - protein, 6 aa, synthetic construct
  REGION 1..6: note = Synthetic Construct
EKNLSK

SEQ ID NO: 10993 - protein, 6 aa, synthetic construct
  REGION 1..6: note = Synthetic Construct
EKNLTK

SEQ ID NO: 10994 - protein, 6 aa, synthetic construct
  REGION 1..6: note = Synthetic Construct
EKNLYK

SEQ ID NO: 10995 - protein, 6 aa, synthetic construct
  REGION 1..6: note = Synthetic Construct
EKNNAK

SEQ ID NO: 10996 - protein, 6 aa, synthetic construct
  REGION 1..6: note = Synthetic Construct
EKNNDK

SEQ ID NO: 10997 - protein, 6 aa, synthetic construct
  REGION 1..6: note = Synthetic Construct
EKNNEK

SEQ ID NO: 10998 - protein, 6 aa, synthetic construct
  REGION 1..6: note = Synthetic Construct
EKNNFK

SEQ ID NO: 10999 - protein, 6 aa, synthetic construct
  REGION 1..6: note = Synthetic Construct
EKNNGK

SEQ ID NO: 11000 - protein, 6 aa, synthetic construct
  REGION 1..6: note = Synthetic Construct
EKNNHK

SEQ ID NO: 11001 - protein, 6 aa, synthetic construct
  REGION 1..6: note = Synthetic Construct
EKNNIK

SEQ ID NO: 11002 - protein, 6 aa, synthetic construct
  REGION 1..6: note = Synthetic Construct
EKNNLK

SEQ ID NO: 11003 - protein, 6 aa, synthetic construct
  REGION 1..6: note = Synthetic Construct
EKNNNK

SEQ ID NO: 11004 - protein, 6 aa, synthetic construct
  REGION 1..6: note = Synthetic Construct
EKNNQK

SEQ ID NO: 11005 - protein, 6 aa, synthetic construct
  REGION 1..6: note = Synthetic Construct
EKNNRK

SEQ ID NO: 11006 - protein, 6 aa, synthetic construct
  REGION 1..6: note = Synthetic Construct
EKNNSK

SEQ ID NO: 11007 - protein, 6 aa, synthetic construct
  REGION 1..6: note = Synthetic Construct
EKNNTK

SEQ ID NO: 11008 - protein, 6 aa, synthetic construct
  REGION 1..6: note = Synthetic Construct
EKNNYK

SEQ ID NO: 11009 - protein, 6 aa, synthetic construct
  REGION 1..6: note = Synthetic Construct
EKNQAK

SEQ ID NO: 11010 - protein, 6 aa, synthetic construct
  REGION 1..6: note = Synthetic Construct
EKNQDK

SEQ ID NO: 11011 - protein, 6 aa, synthetic construct
  REGION 1..6: note = Synthetic Construct
EKNQEK

SEQ ID NO: 11012 - protein, 6 aa, synthetic construct
  REGION 1..6: note = Synthetic Construct
EKNQFK

SEQ ID NO: 11013 - protein, 6 aa, synthetic construct
  REGION 1..6: note = Synthetic Construct
EKNQGK

SEQ ID NO: 11014 - protein, 6 aa, synthetic construct
  REGION 1..6: note = Synthetic Construct
EKNQHK

SEQ ID NO: 11015 - protein, 6 aa, synthetic construct
  REGION 1..6: note = Synthetic Construct
EKNQIK

SEQ ID NO: 11016 - protein, 6 aa, synthetic construct
  REGION 1..6: note = Synthetic Construct
EKNQLK

SEQ ID NO: 11017 - protein, 6 aa, synthetic construct
  REGION 1..6: note = Synthetic Construct
EKNQNK

SEQ ID NO: 11018 - protein, 6 aa, synthetic construct
  REGION 1..6: note = Synthetic Construct
EKNQQK

SEQ ID NO: 11019 - protein, 6 aa, synthetic construct
  REGION 1..6: note = Synthetic Construct
EKNQRK

SEQ ID NO: 11020 - protein, 6 aa, synthetic construct
  REGION 1..6: note = Synthetic Construct
EKNQSK

SEQ ID NO: 11021 - protein, 6 aa, synthetic construct
  REGION 1..6: note = Synthetic Construct
EKNQTK

SEQ ID NO: 11022 - protein, 6 aa, synthetic construct
  REGION 1..6: note = Synthetic Construct
EKNQYK

SEQ ID NO: 11023 - protein, 6 aa, synthetic construct
  REGION 1..6: note = Synthetic Construct
EKNRAK

SEQ ID NO: 11024 - protein, 6 aa, synthetic construct
  REGION 1..6: note = Synthetic Construct
EKNRDK

SEQ ID NO: 11025 - protein, 6 aa, synthetic construct
  REGION 1..6: note = Synthetic Construct
EKNREK

SEQ ID NO: 11026 - protein, 6 aa, synthetic construct
  REGION 1..6: note = Synthetic Construct
EKNRFK

SEQ ID NO: 11027 - protein, 6 aa, synthetic construct
  REGION 1..6: note = Synthetic Construct
EKNRGK

SEQ ID NO: 11028 - protein, 6 aa, synthetic construct
  REGION 1..6: note = Synthetic Construct
EKNRHK

SEQ ID NO: 11029 - protein, 6 aa, synthetic construct
  REGION 1..6: note = Synthetic Construct
EKNRIK

SEQ ID NO: 11030 - protein, 6 aa, synthetic construct
  REGION 1..6: note = Synthetic Construct
EKNRLK

SEQ ID NO: 11031 - protein, 6 aa, synthetic construct
  REGION 1..6: note = Synthetic Construct
EKNRNK

SEQ ID NO: 11032 - protein, 6 aa, synthetic construct
  REGION 1..6: note = Synthetic Construct
EKNRQK

SEQ ID NO: 11033 - protein, 6 aa, synthetic construct
  REGION 1..6: note = Synthetic Construct
EKNRRK

SEQ ID NO: 11034 - protein, 6 aa, synthetic construct
  REGION 1..6: note = Synthetic Construct
EKNRSK

SEQ ID NO: 11035 - protein, 6 aa, synthetic construct
  REGION 1..6: note = Synthetic Construct
EKNRTK

SEQ ID NO: 11036 - protein, 6 aa, synthetic construct
  REGION 1..6: note = Synthetic Construct
EKNRYK

SEQ ID NO: 11037 - protein, 6 aa, synthetic construct
  REGION 1..6: note = Synthetic Construct
EKNSAK

SEQ ID NO: 11038 - protein, 6 aa, synthetic construct
  REGION 1..6: note = Synthetic Construct
EKNSDK

SEQ ID NO: 11039 - protein, 6 aa, synthetic construct
  REGION 1..6: note = Synthetic Construct
EKNSEK

SEQ ID NO: 11040 - protein, 6 aa, synthetic construct
  REGION 1..6: note = Synthetic Construct
EKNSFK

SEQ ID NO: 11041 - protein, 6 aa, synthetic construct
  REGION 1..6: note = Synthetic Construct
EKNSGK

SEQ ID NO: 11042 - protein, 6 aa, synthetic construct
  REGION 1..6: note = Synthetic Construct
EKNSHK

SEQ ID NO: 11043 - protein, 6 aa, synthetic construct
  REGION 1..6: note = Synthetic Construct
EKNSIK

SEQ ID NO: 11044 - protein, 6 aa, synthetic construct
  REGION 1..6: note = Synthetic Construct
EKNSLK

SEQ ID NO: 11045 - protein, 6 aa, synthetic construct
  REGION 1..6: note = Synthetic Construct
EKNSNK

SEQ ID NO: 11046 - protein, 6 aa, synthetic construct
  REGION 1..6: note = Synthetic Construct
EKNSQK

SEQ ID NO: 11047 - protein, 6 aa, synthetic construct
  REGION 1..6: note = Synthetic Construct
EKNSRK

SEQ ID NO: 11048 - protein, 6 aa, synthetic construct
  REGION 1..6: note = Synthetic Construct
EKNSSK

SEQ ID NO: 11049 - protein, 6 aa, synthetic construct
  REGION 1..6: note = Synthetic Construct
EKNSTK

SEQ ID NO: 11050 - protein, 6 aa, synthetic construct
  REGION 1..6: note = Synthetic Construct
EKNSYK

SEQ ID NO: 11051 - protein, 6 aa, synthetic construct
  REGION 1..6: note = Synthetic Construct
EKNTAK

SEQ ID NO: 11052 - protein, 6 aa, synthetic construct
  REGION 1..6: note = Synthetic Construct
EKNTDK

SEQ ID NO: 11053 - protein, 6 aa, synthetic construct
  REGION 1..6: note = Synthetic Construct
EKNTEK

SEQ ID NO: 11054 - protein, 6 aa, synthetic construct
  REGION 1..6: note = Synthetic Construct
EKNTFK

SEQ ID NO: 11055 - protein, 6 aa, synthetic construct
  REGION 1..6: note = Synthetic Construct
EKNTGK

SEQ ID NO: 11056 - protein, 6 aa, synthetic construct
  REGION 1..6: note = Synthetic Construct
EKNTHK

SEQ ID NO: 11057 - protein, 6 aa, synthetic construct
  REGION 1..6: note = Synthetic Construct
EKNTIK

SEQ ID NO: 11058 - protein, 6 aa, synthetic construct
  REGION 1..6: note = Synthetic Construct
EKNTLK

SEQ ID NO: 11059 - protein, 6 aa, synthetic construct
  REGION 1..6: note = Synthetic Construct
EKNTNK

SEQ ID NO: 11060 - protein, 6 aa, synthetic construct
  REGION 1..6: note = Synthetic Construct
EKNTQK

SEQ ID NO: 11061 - protein, 6 aa, synthetic construct
  REGION 1..6: note = Synthetic Construct
EKNTRK

SEQ ID NO: 11062 - protein, 6 aa, synthetic construct
  REGION 1..6: note = Synthetic Construct
EKNTSK

SEQ ID NO: 11063 - protein, 6 aa, synthetic construct
  REGION 1..6: note = Synthetic Construct
EKNTTK

SEQ ID NO: 11064 - protein, 6 aa, synthetic construct
  REGION 1..6: note = Synthetic Construct
EKNTYK

SEQ ID NO: 11065 - protein, 6 aa, synthetic construct
  REGION 1..6: note = Synthetic Construct
EKNYAK

SEQ ID NO: 11066 - protein, 6 aa, synthetic construct
  REGION 1..6: note = Synthetic Construct
EKNYDK

SEQ ID NO: 11067 - protein, 6 aa, synthetic construct
  REGION 1..6: note = Synthetic Construct
EKNYEK

SEQ ID NO: 11068 - protein, 6 aa, synthetic construct
  REGION 1..6: note = Synthetic Construct
EKNYFK

SEQ ID NO: 11069 - protein, 6 aa, synthetic construct
  REGION 1..6: note = Synthetic Construct
EKNYGK

SEQ ID NO: 11070 - protein, 6 aa, synthetic construct
  REGION 1..6: note = Synthetic Construct
EKNYHK

SEQ ID NO: 11071 - protein, 6 aa, synthetic construct
  REGION 1..6: note = Synthetic Construct
EKNYIK

SEQ ID NO: 11072 - protein, 6 aa, synthetic construct
  REGION 1..6: note = Synthetic Construct
EKNYLK

SEQ ID NO: 11073 - protein, 6 aa, synthetic construct
  REGION 1..6: note = Synthetic Construct
EKNYNK

SEQ ID NO: 11074 - protein, 6 aa, synthetic construct
  REGION 1..6: note = Synthetic Construct
EKNYQK

SEQ ID NO: 11075 - protein, 6 aa, synthetic construct
  REGION 1..6: note = Synthetic Construct
EKNYRK

SEQ ID NO: 11076 - protein, 6 aa, synthetic construct
  REGION 1..6: note = Synthetic Construct
EKNYSK

SEQ ID NO: 11077 - protein, 6 aa, synthetic construct
  REGION 1..6: note = Synthetic Construct
EKNYTK

SEQ ID NO: 11078 - protein, 6 aa, synthetic construct
  REGION 1..6: note = Synthetic Construct
EKNYYK

SEQ ID NO: 11079 - protein, 6 aa, synthetic construct
  REGION 1..6: note = Synthetic Construct
EKPAAK

SEQ ID NO: 11080 - protein, 6 aa, synthetic construct
  REGION 1..6: note = Synthetic Construct
EKPADK

SEQ ID NO: 11081 - protein, 6 aa, synthetic construct
  REGION 1..6: note = Synthetic Construct
EKPAEK

SEQ ID NO: 11082 - protein, 6 aa, synthetic construct
  REGION 1..6: note = Synthetic Construct
EKPAFK

SEQ ID NO: 11083 - protein, 6 aa, synthetic construct
  REGION 1..6: note = Synthetic Construct
EKPAGK

SEQ ID NO: 11084 - protein, 6 aa, synthetic construct
  REGION 1..6: note = Synthetic Construct
EKPAHK

SEQ ID NO: 11085 - protein, 6 aa, synthetic construct
  REGION 1..6: note = Synthetic Construct
EKPAIK

SEQ ID NO: 11086 - protein, 6 aa, synthetic construct
  REGION 1..6: note = Synthetic Construct
EKPALK

SEQ ID NO: 11087 - protein, 6 aa, synthetic construct
  REGION 1..6: note = Synthetic Construct
EKPANK

SEQ ID NO: 11088 - protein, 6 aa, synthetic construct
  REGION 1..6: note = Synthetic Construct
EKPAQK

SEQ ID NO: 11089 - protein, 6 aa, synthetic construct
  REGION 1..6: note = Synthetic Construct
EKPARK

SEQ ID NO: 11090 - protein, 6 aa, synthetic construct
  REGION 1..6: note = Synthetic Construct
EKPASK

SEQ ID NO: 11091 - protein, 6 aa, synthetic construct
  REGION 1..6: note = Synthetic Construct
EKPATK

SEQ ID NO: 11092 - protein, 6 aa, synthetic construct
  REGION 1..6: note = Synthetic Construct
EKPAYK

SEQ ID NO: 11093 - protein, 6 aa, synthetic construct
  REGION 1..6: note = Synthetic Construct
EKPDAK

SEQ ID NO: 11094 - protein, 6 aa, synthetic construct
  REGION 1..6: note = Synthetic Construct
EKPDDK

SEQ ID NO: 11095 - protein, 6 aa, synthetic construct
  REGION 1..6: note = Synthetic Construct
EKPDEK

SEQ ID NO: 11096 - protein, 6 aa, synthetic construct
  REGION 1..6: note = Synthetic Construct
EKPDFK

SEQ ID NO: 11097 - protein, 6 aa, synthetic construct
  REGION 1..6: note = Synthetic Construct
EKPDGK

SEQ ID NO: 11098 - protein, 6 aa, synthetic construct
  REGION 1..6: note = Synthetic Construct
EKPDHK

SEQ ID NO: 11099 - protein, 6 aa, synthetic construct
  REGION 1..6: note = Synthetic Construct
EKPDIK

SEQ ID NO: 11100 - protein, 6 aa, synthetic construct
  REGION 1..6: note = Synthetic Construct
EKPDLK

SEQ ID NO: 11101 - protein, 6 aa, synthetic construct
  REGION 1..6: note = Synthetic Construct
EKPDNK

SEQ ID NO: 11102 - protein, 6 aa, synthetic construct
  REGION 1..6: note = Synthetic Construct
EKPDQK

SEQ ID NO: 11103 - protein, 6 aa, synthetic construct
  REGION 1..6: note = Synthetic Construct
EKPDRK

SEQ ID NO: 11104 - protein, 6 aa, synthetic construct
  REGION 1..6: note = Synthetic Construct
EKPDSK

SEQ ID NO: 11105 - protein, 6 aa, synthetic construct
  REGION 1..6: note = Synthetic Construct
EKPDTK

SEQ ID NO: 11106 - protein, 6 aa, synthetic construct
  REGION 1..6: note = Synthetic Construct
EKPDYK

SEQ ID NO: 11107 - protein, 6 aa, synthetic construct
  REGION 1..6: note = Synthetic Construct
EKPEAK

SEQ ID NO: 11108 - protein, 6 aa, synthetic construct
  REGION 1..6: note = Synthetic Construct
EKPEDK

SEQ ID NO: 11109 - protein, 6 aa, synthetic construct
  REGION 1..6: note = Synthetic Construct
EKPEEK

SEQ ID NO: 11110 - protein, 6 aa, synthetic construct
  REGION 1..6: note = Synthetic Construct
EKPEFK

SEQ ID NO: 11111 - protein, 6 aa, synthetic construct
  REGION 1..6: note = Synthetic Construct
EKPEGK

SEQ ID NO: 11112 - protein, 6 aa, synthetic construct
  REGION 1..6: note = Synthetic Construct
EKPEHK

SEQ ID NO: 11113 - protein, 6 aa, synthetic construct
  REGION 1..6: note = Synthetic Construct
EKPEIK

SEQ ID NO: 11114 - protein, 6 aa, synthetic construct
  REGION 1..6: note = Synthetic Construct
EKPELK

SEQ ID NO: 11115 - protein, 6 aa, synthetic construct
  REGION 1..6: note = Synthetic Construct
EKPENK

SEQ ID NO: 11116 - protein, 6 aa, synthetic construct
  REGION 1..6: note = Synthetic Construct
EKPEQK

SEQ ID NO: 11117 - protein, 6 aa, synthetic construct
  REGION 1..6: note = Synthetic Construct
EKPERK

SEQ ID NO: 11118 - protein, 6 aa, synthetic construct
  REGION 1..6: note = Synthetic Construct
EKPESK

SEQ ID NO: 11119 - protein, 6 aa, synthetic construct
  REGION 1..6: note = Synthetic Construct
EKPETK

SEQ ID NO: 11120 - protein, 6 aa, synthetic construct
  REGION 1..6: note = Synthetic Construct
EKPEYK

SEQ ID NO: 11121 - protein, 6 aa, synthetic construct
  REGION 1..6: note = Synthetic Construct
EKPFAK

SEQ ID NO: 11122 - protein, 6 aa, synthetic construct
  REGION 1..6: note = Synthetic Construct
EKPFDK

SEQ ID NO: 11123 - protein, 6 aa, synthetic construct
  REGION 1..6: note = Synthetic Construct
EKPFEK

SEQ ID NO: 11124 - protein, 6 aa, synthetic construct
  REGION 1..6: note = Synthetic Construct
EKPFFK

SEQ ID NO: 11125 - protein, 6 aa, synthetic construct
  REGION 1..6: note = Synthetic Construct
EKPFGK

SEQ ID NO: 11126 - protein, 6 aa, synthetic construct
  REGION 1..6: note = Synthetic Construct
EKPFHK

SEQ ID NO: 11127 - protein, 6 aa, synthetic construct
  REGION 1..6: note = Synthetic Construct
EKPFIK

SEQ ID NO: 11128 - protein, 6 aa, synthetic construct
  REGION 1..6: note = Synthetic Construct
EKPFLK

SEQ ID NO: 11129 - protein, 6 aa, synthetic construct
  REGION 1..6: note = Synthetic Construct
EKPFNK

SEQ ID NO: 11130 - protein, 6 aa, synthetic construct
  REGION 1..6: note = Synthetic Construct
EKPFQK

SEQ ID NO: 11131 - protein, 6 aa, synthetic construct
  REGION 1..6: note = Synthetic Construct
EKPFRK

SEQ ID NO: 11132 - protein, 6 aa, synthetic construct
  REGION 1..6: note = Synthetic Construct
EKPFSK

SEQ ID NO: 11133 - protein, 6 aa, synthetic construct
  REGION 1..6: note = Synthetic Construct
EKPFTK

SEQ ID NO: 11134 - protein, 6 aa, synthetic construct
  REGION 1..6: note = Synthetic Construct
EKPFYK

SEQ ID NO: 11135 - protein, 6 aa, synthetic construct
  REGION 1..6: note = Synthetic Construct
EKPGAK

SEQ ID NO: 11136 - protein, 6 aa, synthetic construct
  REGION 1..6: note = Synthetic Construct
EKPGDK

SEQ ID NO: 11137 - protein, 6 aa, synthetic construct
  REGION 1..6: note = Synthetic Construct
EKPGEK

SEQ ID NO: 11138 - protein, 6 aa, synthetic construct
  REGION 1..6: note = Synthetic Construct
EKPGFK

SEQ ID NO: 11139 - protein, 6 aa, synthetic construct
  REGION 1..6: note = Synthetic Construct
EKPGGK

SEQ ID NO: 11140 - protein, 6 aa, synthetic construct
  REGION 1..6: note = Synthetic Construct
EKPGHK

SEQ ID NO: 11141 - protein, 6 aa, synthetic construct
  REGION 1..6: note = Synthetic Construct
EKPGIK

SEQ ID NO: 11142 - protein, 6 aa, synthetic construct
  REGION 1..6: note = Synthetic Construct
EKPGLK

SEQ ID NO: 11143 - protein, 6 aa, synthetic construct
  REGION 1..6: note = Synthetic Construct
EKPGNK

SEQ ID NO: 11144 - protein, 6 aa, synthetic construct
  REGION 1..6: note = Synthetic Construct
EKPGQK

SEQ ID NO: 11145 - protein, 6 aa, synthetic construct
  REGION 1..6: note = Synthetic Construct
EKPGRK

SEQ ID NO: 11146 - protein, 6 aa, synthetic construct
  REGION 1..6: note = Synthetic Construct
EKPGSK

SEQ ID NO: 11147 - protein, 6 aa, synthetic construct
  REGION 1..6: note = Synthetic Construct
EKPGTK

SEQ ID NO: 11148 - protein, 6 aa, synthetic construct
  REGION 1..6: note = Synthetic Construct
EKPGYK

SEQ ID NO: 11149 - protein, 6 aa, synthetic construct
  REGION 1..6: note = Synthetic Construct
EKPHAK

SEQ ID NO: 11150 - protein, 6 aa, synthetic construct
  REGION 1..6: note = Synthetic Construct
EKPHDK

SEQ ID NO: 11151 - protein, 6 aa, synthetic construct
  REGION 1..6: note = Synthetic Construct
EKPHEK

SEQ ID NO: 11152 - protein, 6 aa, synthetic construct
  REGION 1..6: note = Synthetic Construct
EKPHFK

SEQ ID NO: 11153 - protein, 6 aa, synthetic construct
  REGION 1..6: note = Synthetic Construct
EKPHGK

SEQ ID NO: 11154 - protein, 6 aa, synthetic construct
  REGION 1..6: note = Synthetic Construct
EKPHHK

SEQ ID NO: 11155 - protein, 6 aa, synthetic construct
  REGION 1..6: note = Synthetic Construct
EKPHIK

SEQ ID NO: 11156 - protein, 6 aa, synthetic construct
  REGION 1..6: note = Synthetic Construct
EKPHLK

SEQ ID NO: 11157 - protein, 6 aa, synthetic construct
  REGION 1..6: note = Synthetic Construct
EKPHNK

SEQ ID NO: 11158 - protein, 6 aa, synthetic construct
  REGION 1..6: note = Synthetic Construct
EKPHQK

SEQ ID NO: 11159 - protein, 6 aa, synthetic construct
  REGION 1..6: note = Synthetic Construct
EKPHRK

SEQ ID NO: 11160 - protein, 6 aa, synthetic construct
  REGION 1..6: note = Synthetic Construct
EKPHSK

SEQ ID NO: 11161 - protein, 6 aa, synthetic construct
  REGION 1..6: note = Synthetic Construct
EKPHTK

SEQ ID NO: 11162 - protein, 6 aa, synthetic construct
  REGION 1..6: note = Synthetic Construct
EKPHYK

SEQ ID NO: 11163 - protein, 6 aa, synthetic construct
  REGION 1..6: note = Synthetic Construct
EKPIAK

SEQ ID NO: 11164 - protein, 6 aa, synthetic construct
  REGION 1..6: note = Synthetic Construct
EKPIDK

SEQ ID NO: 11165 - protein, 6 aa, synthetic construct
  REGION 1..6: note = Synthetic Construct
EKPIEK

SEQ ID NO: 11166 - protein, 6 aa, synthetic construct
  REGION 1..6: note = Synthetic Construct
EKPIFK

SEQ ID NO: 11167 - protein, 6 aa, synthetic construct
  REGION 1..6: note = Synthetic Construct
EKPIGK

SEQ ID NO: 11168 - protein, 6 aa, synthetic construct
  REGION 1..6: note = Synthetic Construct
EKPIHK

SEQ ID NO: 11169 - protein, 6 aa, synthetic construct
  REGION 1..6: note = Synthetic Construct
EKPIIK

SEQ ID NO: 11170 - protein, 6 aa, synthetic construct
  REGION 1..6: note = Synthetic Construct
EKPILK

SEQ ID NO: 11171 - protein, 6 aa, synthetic construct
  REGION 1..6: note = Synthetic Construct
EKPINK

SEQ ID NO: 11172 - protein, 6 aa, synthetic construct
  REGION 1..6: note = Synthetic Construct
EKPIQK

SEQ ID NO: 11173 - protein, 6 aa, synthetic construct
  REGION 1..6: note = Synthetic Construct
EKPIRK

SEQ ID NO: 11174 - protein, 6 aa, synthetic construct
  REGION 1..6: note = Synthetic Construct
EKPISK

SEQ ID NO: 11175 - protein, 6 aa, synthetic construct
  REGION 1..6: note = Synthetic Construct
EKPITK

SEQ ID NO: 11176 - protein, 6 aa, synthetic construct
  REGION 1..6: note = Synthetic Construct
EKPIYK

SEQ ID NO: 11177 - protein, 6 aa, synthetic construct
  REGION 1..6: note = Synthetic Construct
EKPLAK

SEQ ID NO: 11178 - protein, 6 aa, synthetic construct
  REGION 1..6: note = Synthetic Construct
EKPLDK

SEQ ID NO: 11179 - protein, 6 aa, synthetic construct
  REGION 1..6: note = Synthetic Construct
EKPLEK

SEQ ID NO: 11180 - protein, 6 aa, synthetic construct
  REGION 1..6: note = Synthetic Construct
EKPLFK

SEQ ID NO: 11181 - protein, 6 aa, synthetic construct
  REGION 1..6: note = Synthetic Construct
EKPLGK

SEQ ID NO: 11182 - protein, 6 aa, synthetic construct
  REGION 1..6: note = Synthetic Construct
EKPLHK

SEQ ID NO: 11183 - protein, 6 aa, synthetic construct
  REGION 1..6: note = Synthetic Construct
EKPLIK

SEQ ID NO: 11184 - protein, 6 aa, synthetic construct
  REGION 1..6: note = Synthetic Construct
EKPLLK

SEQ ID NO: 11185 - protein, 6 aa, synthetic construct
  REGION 1..6: note = Synthetic Construct
EKPLNK

SEQ ID NO: 11186 - protein, 6 aa, synthetic construct
  REGION 1..6: note = Synthetic Construct
EKPLQK

SEQ ID NO: 11187 - protein, 6 aa, synthetic construct
  REGION 1..6: note = Synthetic Construct
EKPLRK

SEQ ID NO: 11188 - protein, 6 aa, synthetic construct
  REGION 1..6: note = Synthetic Construct
EKPLSK

SEQ ID NO: 11189 - protein, 6 aa, synthetic construct
  REGION 1..6: note = Synthetic Construct
EKPLTK

SEQ ID NO: 11190 - protein, 6 aa, synthetic construct
  REGION 1..6: note = Synthetic Construct
EKPLYK

SEQ ID NO: 11191 - protein, 6 aa, synthetic construct
  REGION 1..6: note = Synthetic Construct
EKPNAK

SEQ ID NO: 11192 - protein, 6 aa, synthetic construct
  REGION 1..6: note = Synthetic Construct
EKPNDK

SEQ ID NO: 11193 - protein, 6 aa, synthetic construct
  REGION 1..6: note = Synthetic Construct
EKPNEK

SEQ ID NO: 11194 - protein, 6 aa, synthetic construct
  REGION 1..6: note = Synthetic Construct
EKPNFK

SEQ ID NO: 11195 - protein, 6 aa, synthetic construct
  REGION 1..6: note = Synthetic Construct
EKPNGK

SEQ ID NO: 11196 - protein, 6 aa, synthetic construct
  REGION 1..6: note = Synthetic Construct
EKPNHK

SEQ ID NO: 11197 - protein, 6 aa, synthetic construct
  REGION 1..6: note = Synthetic Construct
EKPNIK

SEQ ID NO: 11198 - protein, 6 aa, synthetic construct
  REGION 1..6: note = Synthetic Construct
EKPNLK

SEQ ID NO: 11199 - protein, 6 aa, synthetic construct
  REGION 1..6: note = Synthetic Construct
EKPNNK

SEQ ID NO: 11200 - protein, 6 aa, synthetic construct
  REGION 1..6: note = Synthetic Construct
EKPNQK

SEQ ID NO: 11201 - protein, 6 aa, synthetic construct
  REGION 1..6: note = Synthetic Construct
EKPNRK

SEQ ID NO: 11202 - protein, 6 aa, synthetic construct
  REGION 1..6: note = Synthetic Construct
EKPNSK

SEQ ID NO: 11203 - protein, 6 aa, synthetic construct
  REGION 1..6: note = Synthetic Construct
EKPNTK

SEQ ID NO: 11204 - protein, 6 aa, synthetic construct
  REGION 1..6: note = Synthetic Construct
EKPNYK

SEQ ID NO: 11205 - protein, 6 aa, synthetic construct
  REGION 1..6: note = Synthetic Construct
EKPQAK

SEQ ID NO: 11206 - protein, 6 aa, synthetic construct
  REGION 1..6: note = Synthetic Construct
EKPQDK

SEQ ID NO: 11207 - protein, 6 aa, synthetic construct
  REGION 1..6: note = Synthetic Construct
EKPQEK

SEQ ID NO: 11208 - protein, 6 aa, synthetic construct
  REGION 1..6: note = Synthetic Construct
EKPQFK

SEQ ID NO: 11209 - protein, 6 aa, synthetic construct
  REGION 1..6: note = Synthetic Construct
EKPQGK

SEQ ID NO: 11210 - protein, 6 aa, synthetic construct
  REGION 1..6: note = Synthetic Construct
EKPQHK

SEQ ID NO: 11211 - protein, 6 aa, synthetic construct
  REGION 1..6: note = Synthetic Construct
EKPQIK

SEQ ID NO: 11212 - protein, 6 aa, synthetic construct
  REGION 1..6: note = Synthetic Construct
EKPQLK

SEQ ID NO: 11213 - protein, 6 aa, synthetic construct
  REGION 1..6: note = Synthetic Construct
EKPQNK

SEQ ID NO: 11214 - protein, 6 aa, synthetic construct
  REGION 1..6: note = Synthetic Construct
EKPQQK

SEQ ID NO: 11215 - protein, 6 aa, synthetic construct
  REGION 1..6: note = Synthetic Construct
EKPQRK

SEQ ID NO: 11216 - protein, 6 aa, synthetic construct
  REGION 1..6: note = Synthetic Construct
EKPQSK

SEQ ID NO: 11217 - protein, 6 aa, synthetic construct
  REGION 1..6: note = Synthetic Construct
EKPQTK

SEQ ID NO: 11218 - protein, 6 aa, synthetic construct
  REGION 1..6: note = Synthetic Construct
EKPQYK

SEQ ID NO: 11219 - protein, 6 aa, synthetic construct
  REGION 1..6: note = Synthetic Construct
EKPRAK

SEQ ID NO: 11220 - protein, 6 aa, synthetic construct
  REGION 1..6: note = Synthetic Construct
EKPRDK

SEQ ID NO: 11221 - protein, 6 aa, synthetic construct
  REGION 1..6: note = Synthetic Construct
EKPREK

SEQ ID NO: 11222 - protein, 6 aa, synthetic construct
  REGION 1..6: note = Synthetic Construct
EKPRFK

SEQ ID NO: 11223 - protein, 6 aa, synthetic construct
  REGION 1..6: note = Synthetic Construct
EKPRGK

SEQ ID NO: 11224 - protein, 6 aa, synthetic construct
  REGION 1..6: note = Synthetic Construct
EKPRHK

SEQ ID NO: 11225 - protein, 6 aa, synthetic construct
  REGION 1..6: note = Synthetic Construct
EKPRIK

SEQ ID NO: 11226 - protein, 6 aa, synthetic construct
  REGION 1..6: note = Synthetic Construct
EKPRLK

SEQ ID NO: 11227 - protein, 6 aa, synthetic construct
  REGION 1..6: note = Synthetic Construct
EKPRNK

SEQ ID NO: 11228 - protein, 6 aa, synthetic construct
  REGION 1..6: note = Synthetic Construct
EKPRQK

SEQ ID NO: 11229 - protein, 6 aa, synthetic construct
  REGION 1..6: note = Synthetic Construct
EKPRRK

SEQ ID NO: 11230 - protein, 6 aa, synthetic construct
  REGION 1..6: note = Synthetic Construct
EKPRSK

SEQ ID NO: 11231 - protein, 6 aa, synthetic construct
  REGION 1..6: note = Synthetic Construct
EKPRTK

SEQ ID NO: 11232 - protein, 6 aa, synthetic construct
  REGION 1..6: note = Synthetic Construct
EKPRYK

SEQ ID NO: 11233 - protein, 6 aa, synthetic construct
  REGION 1..6: note = Synthetic Construct
EKPSAK

SEQ ID NO: 11234 - protein, 6 aa, synthetic construct
  REGION 1..6: note = Synthetic Construct
EKPSDK

SEQ ID NO: 11235 - protein, 6 aa, synthetic construct
  REGION 1..6: note = Synthetic Construct
EKPSEK

SEQ ID NO: 11236 - protein, 6 aa, synthetic construct
  REGION 1..6: note = Synthetic Construct
EKPSFK

SEQ ID NO: 11237 - protein, 6 aa, synthetic construct
  REGION 1..6: note = Synthetic Construct
EKPSGK

SEQ ID NO: 11238 - protein, 6 aa, synthetic construct
  REGION 1..6: note = Synthetic Construct
EKPSHK

SEQ ID NO: 11239 - protein, 6 aa, synthetic construct
  REGION 1..6: note = Synthetic Construct
EKPSIK

SEQ ID NO: 11240 - protein, 6 aa, synthetic construct
  REGION 1..6: note = Synthetic Construct
EKPSLK

SEQ ID NO: 11241 - protein, 6 aa, synthetic construct
  REGION 1..6: note = Synthetic Construct
EKPSNK

SEQ ID NO: 11242 - protein, 6 aa, synthetic construct
  REGION 1..6: note = Synthetic Construct
EKPSQK

SEQ ID NO: 11243 - protein, 6 aa, synthetic construct
  REGION 1..6: note = Synthetic Construct
EKPSRK

SEQ ID NO: 11244 - protein, 6 aa, synthetic construct
  REGION 1..6: note = Synthetic Construct
EKPSSK

SEQ ID NO: 11245 - protein, 6 aa, synthetic construct
  REGION 1..6: note = Synthetic Construct
EKPSTK

SEQ ID NO: 11246 - protein, 6 aa, synthetic construct
  REGION 1..6: note = Synthetic Construct
EKPSYK

SEQ ID NO: 11247 - protein, 6 aa, synthetic construct
  REGION 1..6: note = Synthetic Construct
EKPTAK

SEQ ID NO: 11248 - protein, 6 aa, synthetic construct
  REGION 1..6: note = Synthetic Construct
EKPTDK

SEQ ID NO: 11249 - protein, 6 aa, synthetic construct
  REGION 1..6: note = Synthetic Construct
EKPTEK

SEQ ID NO: 11250 - protein, 6 aa, synthetic construct
  REGION 1..6: note = Synthetic Construct
EKPTFK

SEQ ID NO: 11251 - protein, 6 aa, synthetic construct
  REGION 1..6: note = Synthetic Construct
EKPTGK

SEQ ID NO: 11252 - protein, 6 aa, synthetic construct
  REGION 1..6: note = Synthetic Construct
EKPTHK

SEQ ID NO: 11253 - protein, 6 aa, synthetic construct
  REGION 1..6: note = Synthetic Construct
EKPTIK

SEQ ID NO: 11254 - protein, 6 aa, synthetic construct
  REGION 1..6: note = Synthetic Construct
EKPTLK

SEQ ID NO: 11255 - protein, 6 aa, synthetic construct
  REGION 1..6: note = Synthetic Construct
EKPTNK

SEQ ID NO: 11256 - protein, 6 aa, synthetic construct
  REGION 1..6: note = Synthetic Construct
EKPTQK

SEQ ID NO: 11257 - protein, 6 aa, synthetic construct
  REGION 1..6: note = Synthetic Construct
EKPTRK

SEQ ID NO: 11258 - protein, 6 aa, synthetic construct
  REGION 1..6: note = Synthetic Construct
EKPTSK

SEQ ID NO: 11259 - protein, 6 aa, synthetic construct
  REGION 1..6: note = Synthetic Construct
EKPTTK

SEQ ID NO: 11260 - protein, 6 aa, synthetic construct
  REGION 1..6: note = Synthetic Construct
EKPTYK

SEQ ID NO: 11261 - protein, 6 aa, synthetic construct
  REGION 1..6: note = Synthetic Construct
EKPYAK

SEQ ID NO: 11262 - protein, 6 aa, synthetic construct
  REGION 1..6: note = Synthetic Construct
EKPYDK

SEQ ID NO: 11263 - protein, 6 aa, synthetic construct
  REGION 1..6: note = Synthetic Construct
EKPYEK

SEQ ID NO: 11264 - protein, 6 aa, synthetic construct
  REGION 1..6: note = Synthetic Construct
EKPYFK

SEQ ID NO: 11265 - protein, 6 aa, synthetic construct
  REGION 1..6: note = Synthetic Construct
EKPYGK

SEQ ID NO: 11266 - protein, 6 aa, synthetic construct
  REGION 1..6: note = Synthetic Construct
EKPYHK

SEQ ID NO: 11267 - protein, 6 aa, synthetic construct
  REGION 1..6: note = Synthetic Construct
EKPYIK

SEQ ID NO: 11268 - protein, 6 aa, synthetic construct
  REGION 1..6: note = Synthetic Construct
EKPYLK

SEQ ID NO: 11269 - protein, 6 aa, synthetic construct
  REGION 1..6: note = Synthetic Construct
EKPYNK

SEQ ID NO: 11270 - protein, 6 aa, synthetic construct
  REGION 1..6: note = Synthetic Construct
EKPYQK

SEQ ID NO: 11271 - protein, 6 aa, synthetic construct
  REGION 1..6: note = Synthetic Construct
EKPYRK

SEQ ID NO: 11272 - protein, 6 aa, synthetic construct
  REGION 1..6: note = Synthetic Construct
EKPYSK

SEQ ID NO: 11273 - protein, 6 aa, synthetic construct
  REGION 1..6: note = Synthetic Construct
EKPYTK

SEQ ID NO: 11274 - protein, 6 aa, synthetic construct
  REGION 1..6: note = Synthetic Construct
EKPYYK

SEQ ID NO: 11275 - protein, 6 aa, synthetic construct
  REGION 1..6: note = Synthetic Construct
EKQAAK

SEQ ID NO: 11276 - protein, 6 aa, synthetic construct
  REGION 1..6: note = Synthetic Construct
EKQADK

SEQ ID NO: 11277 - protein, 6 aa, synthetic construct
  REGION 1..6: note = Synthetic Construct
EKQAEK

SEQ ID NO: 11278 - protein, 6 aa, synthetic construct
  REGION 1..6: note = Synthetic Construct
EKQAFK

SEQ ID NO: 11279 - protein, 6 aa, synthetic construct
  REGION 1..6: note = Synthetic Construct
EKQAGK

SEQ ID NO: 11280 - protein, 6 aa, synthetic construct
  REGION 1..6: note = Synthetic Construct
EKQAHK

SEQ ID NO: 11281 - protein, 6 aa, synthetic construct
  REGION 1..6: note = Synthetic Construct
EKQAIK

SEQ ID NO: 11282 - protein, 6 aa, synthetic construct
  REGION 1..6: note = Synthetic Construct
EKQALK

SEQ ID NO: 11283 - protein, 6 aa, synthetic construct
  REGION 1..6: note = Synthetic Construct
EKQANK

SEQ ID NO: 11284 - protein, 6 aa, synthetic construct
  REGION 1..6: note = Synthetic Construct
EKQAQK

SEQ ID NO: 11285 - protein, 6 aa, synthetic construct
  REGION 1..6: note = Synthetic Construct
EKQARK

SEQ ID NO: 11286 - protein, 6 aa, synthetic construct
  REGION 1..6: note = Synthetic Construct
EKQASK

SEQ ID NO: 11287 - protein, 6 aa, synthetic construct
  REGION 1..6: note = Synthetic Construct
EKQATK

SEQ ID NO: 11288 - protein, 6 aa, synthetic construct
  REGION 1..6: note = Synthetic Construct
EKQAYK

SEQ ID NO: 11289 - protein, 6 aa, synthetic construct
  REGION 1..6: note = Synthetic Construct
EKQDAK

SEQ ID NO: 11290 - protein, 6 aa, synthetic construct
  REGION 1..6: note = Synthetic Construct
EKQDDK

SEQ ID NO: 11291 - protein, 6 aa, synthetic construct
  REGION 1..6: note = Synthetic Construct
EKQDEK

SEQ ID NO: 11292 - protein, 6 aa, synthetic construct
  REGION 1..6: note = Synthetic Construct
EKQDFK

SEQ ID NO: 11293 - protein, 6 aa, synthetic construct
  REGION 1..6: note = Synthetic Construct
EKQDGK

SEQ ID NO: 11294 - protein, 6 aa, synthetic construct
  REGION 1..6: note = Synthetic Construct
EKQDHK

SEQ ID NO: 11295 - protein, 6 aa, synthetic construct
  REGION 1..6: note = Synthetic Construct
EKQDIK

SEQ ID NO: 11296 - protein, 6 aa, synthetic construct
  REGION 1..6: note = Synthetic Construct
EKQDLK

SEQ ID NO: 11297 - protein, 6 aa, synthetic construct
  REGION 1..6: note = Synthetic Construct
EKQDNK

SEQ ID NO: 11298 - protein, 6 aa, synthetic construct
  REGION 1..6: note = Synthetic Construct
EKQDQK

SEQ ID NO: 11299 - protein, 6 aa, synthetic construct
  REGION 1..6: note = Synthetic Construct
EKQDRK

SEQ ID NO: 11300 - protein, 6 aa, synthetic construct
  REGION 1..6: note = Synthetic Construct
EKQDSK

SEQ ID NO: 11301 - protein, 6 aa, synthetic construct
  REGION 1..6: note = Synthetic Construct
EKQDTK

SEQ ID NO: 11302 - protein, 6 aa, synthetic construct
  REGION 1..6: note = Synthetic Construct
EKQDYK

SEQ ID NO: 11303 - protein, 6 aa, synthetic construct
  REGION 1..6: note = Synthetic Construct
EKQEAK

SEQ ID NO: 11304 - protein, 6 aa, synthetic construct
  REGION 1..6: note = Synthetic Construct
EKQEDK

SEQ ID NO: 11305 - protein, 6 aa, synthetic construct
  REGION 1..6: note = Synthetic Construct
EKQEEK

SEQ ID NO: 11306 - protein, 6 aa, synthetic construct
  REGION 1..6: note = Synthetic Construct
EKQEFK

SEQ ID NO: 11307 - protein, 6 aa, synthetic construct
  REGION 1..6: note = Synthetic Construct
EKQEGK

SEQ ID NO: 11308 - protein, 6 aa, synthetic construct
  REGION 1..6: note = Synthetic Construct
EKQEHK

SEQ ID NO: 11309 - protein, 6 aa, synthetic construct
  REGION 1..6: note = Synthetic Construct
EKQEIK

SEQ ID NO: 11310 - protein, 6 aa, synthetic construct
  REGION 1..6: note = Synthetic Construct
EKQELK

SEQ ID NO: 11311 - protein, 6 aa, synthetic construct
  REGION 1..6: note = Synthetic Construct
EKQENK

SEQ ID NO: 11312 - protein, 6 aa, synthetic construct
  REGION 1..6: note = Synthetic Construct
EKQEQK

SEQ ID NO: 11313 - protein, 6 aa, synthetic construct
  REGION 1..6: note = Synthetic Construct
EKQERK

SEQ ID NO: 11314 - protein, 6 aa, synthetic construct
  REGION 1..6: note = Synthetic Construct
EKQESK

SEQ ID NO: 11315 - protein, 6 aa, synthetic construct
  REGION 1..6: note = Synthetic Construct
EKQETK

SEQ ID NO: 11316 - protein, 6 aa, synthetic construct
  REGION 1..6: note = Synthetic Construct
EKQEYK

SEQ ID NO: 11317 - protein, 6 aa, synthetic construct
  REGION 1..6: note = Synthetic Construct
EKQFAK

SEQ ID NO: 11318 - protein, 6 aa, synthetic construct
  REGION 1..6: note = Synthetic Construct
EKQFDK

SEQ ID NO: 11319 - protein, 6 aa, synthetic construct
  REGION 1..6: note = Synthetic Construct
EKQFEK

SEQ ID NO: 11320 - protein, 6 aa, synthetic construct
  REGION 1..6: note = Synthetic Construct
EKQFFK

SEQ ID NO: 11321 - protein, 6 aa, synthetic construct
  REGION 1..6: note = Synthetic Construct
EKQFGK

SEQ ID NO: 11322 - protein, 6 aa, synthetic construct
  REGION 1..6: note = Synthetic Construct
EKQFHK

SEQ ID NO: 11323 - protein, 6 aa, synthetic construct
  REGION 1..6: note = Synthetic Construct
EKQFIK

SEQ ID NO: 11324 - protein, 6 aa, synthetic construct
  REGION 1..6: note = Synthetic Construct
EKQFLK

SEQ ID NO: 11325 - protein, 6 aa, synthetic construct
  REGION 1..6: note = Synthetic Construct
EKQFNK

SEQ ID NO: 11326 - protein, 6 aa, synthetic construct
  REGION 1..6: note = Synthetic Construct
EKQFQK

SEQ ID NO: 11327 - protein, 6 aa, synthetic construct
  REGION 1..6: note = Synthetic Construct
EKQFRK

SEQ ID NO: 11328 - protein, 6 aa, synthetic construct
  REGION 1..6: note = Synthetic Construct
EKQFSK

SEQ ID NO: 11329 - protein, 6 aa, synthetic construct
  REGION 1..6: note = Synthetic Construct
EKQFTK

SEQ ID NO: 11330 - protein, 6 aa, synthetic construct
  REGION 1..6: note = Synthetic Construct
EKQFYK

SEQ ID NO: 11331 - protein, 6 aa, synthetic construct
  REGION 1..6: note = Synthetic Construct
EKQGAK

SEQ ID NO: 11332 - protein, 6 aa, synthetic construct
  REGION 1..6: note = Synthetic Construct
EKQGDK

SEQ ID NO: 11333 - protein, 6 aa, synthetic construct
  REGION 1..6: note = Synthetic Construct
EKQGEK

SEQ ID NO: 11334 - protein, 6 aa, synthetic construct
  REGION 1..6: note = Synthetic Construct
EKQGFK

SEQ ID NO: 11335 - protein, 6 aa, synthetic construct
  REGION 1..6: note = Synthetic Construct
EKQGGK

SEQ ID NO: 11336 - protein, 6 aa, synthetic construct
  REGION 1..6: note = Synthetic Construct
EKQGHK

SEQ ID NO: 11337 - protein, 6 aa, synthetic construct
  REGION 1..6: note = Synthetic Construct
EKQGIK

SEQ ID NO: 11338 - protein, 6 aa, synthetic construct
  REGION 1..6: note = Synthetic Construct
EKQGLK

SEQ ID NO: 11339 - protein, 6 aa, synthetic construct
  REGION 1..6: note = Synthetic Construct
EKQGNK

SEQ ID NO: 11340 - protein, 6 aa, synthetic construct
  REGION 1..6: note = Synthetic Construct
EKQGQK

SEQ ID NO: 11341 - protein, 6 aa, synthetic construct
  REGION 1..6: note = Synthetic Construct
EKQGRK

SEQ ID NO: 11342 - protein, 6 aa, synthetic construct
  REGION 1..6: note = Synthetic Construct
EKQGSK

SEQ ID NO: 11343 - protein, 6 aa, synthetic construct
  REGION 1..6: note = Synthetic Construct
EKQGTK

SEQ ID NO: 11344 - protein, 6 aa, synthetic construct
  REGION 1..6: note = Synthetic Construct
EKQGYK

SEQ ID NO: 11345 - protein, 6 aa, synthetic construct
  REGION 1..6: note = Synthetic Construct
EKQHAK

SEQ ID NO: 11346 - protein, 6 aa, synthetic construct
  REGION 1..6: note = Synthetic Construct
EKQHDK

SEQ ID NO: 11347 - protein, 6 aa, synthetic construct
  REGION 1..6: note = Synthetic Construct
EKQHEK

SEQ ID NO: 11348 - protein, 6 aa, synthetic construct
  REGION 1..6: note = Synthetic Construct
EKQHFK

SEQ ID NO: 11349 - protein, 6 aa, synthetic construct
  REGION 1..6: note = Synthetic Construct
EKQHGK

SEQ ID NO: 11350 - protein, 6 aa, synthetic construct
  REGION 1..6: note = Synthetic Construct
EKQHHK

SEQ ID NO: 11351 - protein, 6 aa, synthetic construct
  REGION 1..6: note = Synthetic Construct
EKQHIK

SEQ ID NO: 11352 - protein, 6 aa, synthetic construct
  REGION 1..6: note = Synthetic Construct
EKQHLK

SEQ ID NO: 11353 - protein, 6 aa, synthetic construct
  REGION 1..6: note = Synthetic Construct
EKQHNK

SEQ ID NO: 11354 - protein, 6 aa, synthetic construct
  REGION 1..6: note = Synthetic Construct
EKQHQK

SEQ ID NO: 11355 - protein, 6 aa, synthetic construct
  REGION 1..6: note = Synthetic Construct
EKQHRK

SEQ ID NO: 11356 - protein, 6 aa, synthetic construct
  REGION 1..6: note = Synthetic Construct
EKQHSK

SEQ ID NO: 11357 - protein, 6 aa, synthetic construct
  REGION 1..6: note = Synthetic Construct
EKQHTK

SEQ ID NO: 11358 - protein, 6 aa, synthetic construct
  REGION 1..6: note = Synthetic Construct
EKQHYK

SEQ ID NO: 11359 - protein, 6 aa, synthetic construct
  REGION 1..6: note = Synthetic Construct
EKQIAK

SEQ ID NO: 11360 - protein, 6 aa, synthetic construct
  REGION 1..6: note = Synthetic Construct
EKQIDK

SEQ ID NO: 11361 - protein, 6 aa, synthetic construct
  REGION 1..6: note = Synthetic Construct
EKQIEK

SEQ ID NO: 11362 - protein, 6 aa, synthetic construct
  REGION 1..6: note = Synthetic Construct
EKQIFK

SEQ ID NO: 11363 - protein, 6 aa, synthetic construct
  REGION 1..6: note = Synthetic Construct
EKQIGK

SEQ ID NO: 11364 - protein, 6 aa, synthetic construct
  REGION 1..6: note = Synthetic Construct
EKQIHK

SEQ ID NO: 11365 - protein, 6 aa, synthetic construct
  REGION 1..6: note = Synthetic Construct
EKQIIK

SEQ ID NO: 11366 - protein, 6 aa, synthetic construct
  REGION 1..6: note = Synthetic Construct
EKQILK

SEQ ID NO: 11367 - protein, 6 aa, synthetic construct
  REGION 1..6: note = Synthetic Construct
EKQINK

SEQ ID NO: 11368 - protein, 6 aa, synthetic construct
  REGION 1..6: note = Synthetic Construct
EKQIQK

SEQ ID NO: 11369 - protein, 6 aa, synthetic construct
  REGION 1..6: note = Synthetic Construct
EKQIRK

SEQ ID NO: 11370 - protein, 6 aa, synthetic construct
  REGION 1..6: note = Synthetic Construct
EKQISK

SEQ ID NO: 11371 - protein, 6 aa, synthetic construct
  REGION 1..6: note = Synthetic Construct
EKQITK

SEQ ID NO: 11372 - protein, 6 aa, synthetic construct
  REGION 1..6: note = Synthetic Construct
EKQIYK

SEQ ID NO: 11373 - protein, 6 aa, synthetic construct
  REGION 1..6: note = Synthetic Construct
EKQLAK

SEQ ID NO: 11374 - protein, 6 aa, synthetic construct
  REGION 1..6: note = Synthetic Construct
EKQLDK

SEQ ID NO: 11375 - protein, 6 aa, synthetic construct
  REGION 1..6: note = Synthetic Construct
EKQLEK

SEQ ID NO: 11376 - protein, 6 aa, synthetic construct
  REGION 1..6: note = Synthetic Construct
EKQLFK

SEQ ID NO: 11377 - protein, 6 aa, synthetic construct
  REGION 1..6: note = Synthetic Construct
EKQLGK

SEQ ID NO: 11378 - protein, 6 aa, synthetic construct
  REGION 1..6: note = Synthetic Construct
EKQLHK

SEQ ID NO: 11379 - protein, 6 aa, synthetic construct
  REGION 1..6: note = Synthetic Construct
EKQLIK

SEQ ID NO: 11380 - protein, 6 aa, synthetic construct
  REGION 1..6: note = Synthetic Construct
EKQLLK

SEQ ID NO: 11381 - protein, 6 aa, synthetic construct
  REGION 1..6: note = Synthetic Construct
EKQLNK

SEQ ID NO: 11382 - protein, 6 aa, synthetic construct
  REGION 1..6: note = Synthetic Construct
EKQLQK

SEQ ID NO: 11383 - protein, 6 aa, synthetic construct
  REGION 1..6: note = Synthetic Construct
EKQLRK

SEQ ID NO: 11384 - protein, 6 aa, synthetic construct
  REGION 1..6: note = Synthetic Construct
EKQLSK

SEQ ID NO: 11385 - protein, 6 aa, synthetic construct
  REGION 1..6: note = Synthetic Construct
EKQLTK

SEQ ID NO: 11386 - protein, 6 aa, synthetic construct
  REGION 1..6: note = Synthetic Construct
EKQLYK

SEQ ID NO: 11387 - protein, 6 aa, synthetic construct
  REGION 1..6: note = Synthetic Construct
EKQNAK

SEQ ID NO: 11388 - protein, 6 aa, synthetic construct
  REGION 1..6: note = Synthetic Construct
EKQNDK

SEQ ID NO: 11389 - protein, 6 aa, synthetic construct
  REGION 1..6: note = Synthetic Construct
EKQNEK

SEQ ID NO: 11390 - protein, 6 aa, synthetic construct
  REGION 1..6: note = Synthetic Construct
EKQNFK

SEQ ID NO: 11391 - protein, 6 aa, synthetic construct
  REGION 1..6: note = Synthetic Construct
EKQNGK

SEQ ID NO: 11392 - protein, 6 aa, synthetic construct
  REGION 1..6: note = Synthetic Construct
EKQNHK

SEQ ID NO: 11393 - protein, 6 aa, synthetic construct
  REGION 1..6: note = Synthetic Construct
EKQNIK

SEQ ID NO: 11394 - protein, 6 aa, synthetic construct
  REGION 1..6: note = Synthetic Construct
EKQNLK

SEQ ID NO: 11395 - protein, 6 aa, synthetic construct
  REGION 1..6: note = Synthetic Construct
EKQNNK

SEQ ID NO: 11396 - protein, 6 aa, synthetic construct
  REGION 1..6: note = Synthetic Construct
EKQNQK

SEQ ID NO: 11397 - protein, 6 aa, synthetic construct
  REGION 1..6: note = Synthetic Construct
EKQNRK

SEQ ID NO: 11398 - protein, 6 aa, synthetic construct
  REGION 1..6: note = Synthetic Construct
EKQNSK

SEQ ID NO: 11399 - protein, 6 aa, synthetic construct
  REGION 1..6: note = Synthetic Construct
EKQNTK

SEQ ID NO: 11400 - protein, 6 aa, synthetic construct
  REGION 1..6: note = Synthetic Construct
EKQNYK

SEQ ID NO: 11401 - protein, 6 aa, synthetic construct
  REGION 1..6: note = Synthetic Construct
EKQQAK

SEQ ID NO: 11402 - protein, 6 aa, synthetic construct
  REGION 1..6: note = Synthetic Construct
EKQQDK

SEQ ID NO: 11403 - protein, 6 aa, synthetic construct
  REGION 1..6: note = Synthetic Construct
EKQQEK

SEQ ID NO: 11404 - protein, 6 aa, synthetic construct
  REGION 1..6: note = Synthetic Construct
EKQQFK

SEQ ID NO: 11405 - protein, 6 aa, synthetic construct
  REGION 1..6: note = Synthetic Construct
EKQQGK

SEQ ID NO: 11406 - protein, 6 aa, synthetic construct
  REGION 1..6: note = Synthetic Construct
EKQQHK

SEQ ID NO: 11407 - protein, 6 aa, synthetic construct
  REGION 1..6: note = Synthetic Construct
EKQQIK

SEQ ID NO: 11408 - protein, 6 aa, synthetic construct
  REGION 1..6: note = Synthetic Construct
EKQQLK

SEQ ID NO: 11409 - protein, 6 aa, synthetic construct
  REGION 1..6: note = Synthetic Construct
EKQQNK

SEQ ID NO: 11410 - protein, 6 aa, synthetic construct
  REGION 1..6: note = Synthetic Construct
EKQQQK

SEQ ID NO: 11411 - protein, 6 aa, synthetic construct
  REGION 1..6: note = Synthetic Construct
EKQQRK

SEQ ID NO: 11412 - protein, 6 aa, synthetic construct
  REGION 1..6: note = Synthetic Construct
EKQQSK

SEQ ID NO: 11413 - protein, 6 aa, synthetic construct
  REGION 1..6: note = Synthetic Construct
EKQQTK

SEQ ID NO: 11414 - protein, 6 aa, synthetic construct
  REGION 1..6: note = Synthetic Construct
EKQQYK

SEQ ID NO: 11415 - protein, 6 aa, synthetic construct
  REGION 1..6: note = Synthetic Construct
EKQRAK

SEQ ID NO: 11416 - protein, 6 aa, synthetic construct
  REGION 1..6: note = Synthetic Construct
EKQRDK

SEQ ID NO: 11417 - protein, 6 aa, synthetic construct
  REGION 1..6: note = Synthetic Construct
EKQREK

SEQ ID NO: 11418 - protein, 6 aa, synthetic construct
  REGION 1..6: note = Synthetic Construct
EKQRFK

SEQ ID NO: 11419 - protein, 6 aa, synthetic construct
  REGION 1..6: note = Synthetic Construct
EKQRGK

SEQ ID NO: 11420 - protein, 6 aa, synthetic construct
  REGION 1..6: note = Synthetic Construct
EKQRHK

SEQ ID NO: 11421 - protein, 6 aa, synthetic construct
  REGION 1..6: note = Synthetic Construct
EKQRIK

SEQ ID NO: 11422 - protein, 6 aa, synthetic construct
  REGION 1..6: note = Synthetic Construct
EKQRLK

SEQ ID NO: 11423 - protein, 6 aa, synthetic construct
  REGION 1..6: note = Synthetic Construct
EKQRNK

SEQ ID NO: 11424 - protein, 6 aa, synthetic construct
  REGION 1..6: note = Synthetic Construct
EKQRQK

SEQ ID NO: 11425 - protein, 6 aa, synthetic construct
  REGION 1..6: note = Synthetic Construct
EKQRRK

SEQ ID NO: 11426 - protein, 6 aa, synthetic construct
  REGION 1..6: note = Synthetic Construct
EKQRSK

SEQ ID NO: 11427 - protein, 6 aa, synthetic construct
  REGION 1..6: note = Synthetic Construct
EKQRTK

SEQ ID NO: 11428 - protein, 6 aa, synthetic construct
  REGION 1..6: note = Synthetic Construct
EKQRYK

SEQ ID NO: 11429 - protein, 6 aa, synthetic construct
  REGION 1..6: note = Synthetic Construct
EKQSAK

SEQ ID NO: 11430 - protein, 6 aa, synthetic construct
  REGION 1..6: note = Synthetic Construct
EKQSDK

SEQ ID NO: 11431 - protein, 6 aa, synthetic construct
  REGION 1..6: note = Synthetic Construct
EKQSEK

SEQ ID NO: 11432 - protein, 6 aa, synthetic construct
  REGION 1..6: note = Synthetic Construct
EKQSFK

SEQ ID NO: 11433 - protein, 6 aa, synthetic construct
  REGION 1..6: note = Synthetic Construct
EKQSGK

SEQ ID NO: 11434 - protein, 6 aa, synthetic construct
  REGION 1..6: note = Synthetic Construct
EKQSHK

SEQ ID NO: 11435 - protein, 6 aa, synthetic construct
  REGION 1..6: note = Synthetic Construct
EKQSIK

SEQ ID NO: 11436 - protein, 6 aa, synthetic construct
  REGION 1..6: note = Synthetic Construct
EKQSLK

SEQ ID NO: 11437 - protein, 6 aa, synthetic construct
  REGION 1..6: note = Synthetic Construct
EKQSNK

SEQ ID NO: 11438 - protein, 6 aa, synthetic construct
  REGION 1..6: note = Synthetic Construct
EKQSQK

SEQ ID NO: 11439 - protein, 6 aa, synthetic construct
  REGION 1..6: note = Synthetic Construct
EKQSRK

SEQ ID NO: 11440 - protein, 6 aa, synthetic construct
  REGION 1..6: note = Synthetic Construct
EKQSSK

SEQ ID NO: 11441 - protein, 6 aa, synthetic construct
  REGION 1..6: note = Synthetic Construct
EKQSTK

SEQ ID NO: 11442 - protein, 6 aa, synthetic construct
  REGION 1..6: note = Synthetic Construct
EKQSYK

SEQ ID NO: 11443 - protein, 6 aa, synthetic construct
  REGION 1..6: note = Synthetic Construct
EKQTAK

SEQ ID NO: 11444 - protein, 6 aa, synthetic construct
  REGION 1..6: note = Synthetic Construct
EKQTDK

SEQ ID NO: 11445 - protein, 6 aa, synthetic construct
  REGION 1..6: note = Synthetic Construct
EKQTEK

SEQ ID NO: 11446 - protein, 6 aa, synthetic construct
  REGION 1..6: note = Synthetic Construct
EKQTFK

SEQ ID NO: 11447 - protein, 6 aa, synthetic construct
  REGION 1..6: note = Synthetic Construct
EKQTGK

SEQ ID NO: 11448 - protein, 6 aa, synthetic construct
  REGION 1..6: note = Synthetic Construct
EKQTHK

SEQ ID NO: 11449 - protein, 6 aa, synthetic construct
  REGION 1..6: note = Synthetic Construct
EKQTIK

SEQ ID NO: 11450 - protein, 6 aa, synthetic construct
  REGION 1..6: note = Synthetic Construct
EKQTLK

SEQ ID NO: 11451 - protein, 6 aa, synthetic construct
  REGION 1..6: note = Synthetic Construct
EKQTNK

SEQ ID NO: 11452 - protein, 6 aa, synthetic construct
  REGION 1..6: note = Synthetic Construct
EKQTQK

SEQ ID NO: 11453 - protein, 6 aa, synthetic construct
  REGION 1..6: note = Synthetic Construct
EKQTRK

SEQ ID NO: 11454 - protein, 6 aa, synthetic construct
  REGION 1..6: note = Synthetic Construct
EKQTSK

SEQ ID NO: 11455 - protein, 6 aa, synthetic construct
  REGION 1..6: note = Synthetic Construct
EKQTTK

SEQ ID NO: 11456 - protein, 6 aa, synthetic construct
  REGION 1..6: note = Synthetic Construct
EKQTYK

SEQ ID NO: 11457 - protein, 6 aa, synthetic construct
  REGION 1..6: note = Synthetic Construct
EKQYAK

SEQ ID NO: 11458 - protein, 6 aa, synthetic construct
  REGION 1..6: note = Synthetic Construct
EKQYDK

SEQ ID NO: 11459 - protein, 6 aa, synthetic construct
  REGION 1..6: note = Synthetic Construct
EKQYEK

SEQ ID NO: 11460 - protein, 6 aa, synthetic construct
  REGION 1..6: note = Synthetic Construct
EKQYFK

SEQ ID NO: 11461 - protein, 6 aa, synthetic construct
  REGION 1..6: note = Synthetic Construct
EKQYGK

SEQ ID NO: 11462 - protein, 6 aa, synthetic construct
  REGION 1..6: note = Synthetic Construct
EKQYHK

SEQ ID NO: 11463 - protein, 6 aa, synthetic construct
  REGION 1..6: note = Synthetic Construct
EKQYIK

SEQ ID NO: 11464 - protein, 6 aa, synthetic construct
  REGION 1..6: note = Synthetic Construct
EKQYLK

SEQ ID NO: 11465 - protein, 6 aa, synthetic construct
  REGION 1..6: note = Synthetic Construct
EKQYNK

SEQ ID NO: 11466 - protein, 6 aa, synthetic construct
  REGION 1..6: note = Synthetic Construct
EKQYQK

SEQ ID NO: 11467 - protein, 6 aa, synthetic construct
  REGION 1..6: note = Synthetic Construct
EKQYRK

SEQ ID NO: 11468 - protein, 6 aa, synthetic construct
  REGION 1..6: note = Synthetic Construct
EKQYSK

SEQ ID NO: 11469 - protein, 6 aa, synthetic construct
  REGION 1..6: note = Synthetic Construct
EKQYTK

SEQ ID NO: 11470 - protein, 6 aa, synthetic construct
  REGION 1..6: note = Synthetic Construct
EKQYYK

SEQ ID NO: 11471 - protein, 6 aa, synthetic construct
  REGION 1..6: note = Synthetic Construct
EKRAAK

SEQ ID NO: 11472 - protein, 6 aa, synthetic construct
  REGION 1..6: note = Synthetic Construct
EKRADK

SEQ ID NO: 11473 - protein, 6 aa, synthetic construct
  REGION 1..6: note = Synthetic Construct
EKRAEK

SEQ ID NO: 11474 - protein, 6 aa, synthetic construct
  REGION 1..6: note = Synthetic Construct
EKRAFK

SEQ ID NO: 11475 - protein, 6 aa, synthetic construct
  REGION 1..6: note = Synthetic Construct
EKRAGK

SEQ ID NO: 11476 - protein, 6 aa, synthetic construct
  REGION 1..6: note = Synthetic Construct
EKRAHK

SEQ ID NO: 11477 - protein, 6 aa, synthetic construct
  REGION 1..6: note = Synthetic Construct
EKRAIK

SEQ ID NO: 11478 - protein, 6 aa, synthetic construct
  REGION 1..6: note = Synthetic Construct
EKRALK

SEQ ID NO: 11479 - protein, 6 aa, synthetic construct
  REGION 1..6: note = Synthetic Construct
EKRANK

SEQ ID NO: 11480 - protein, 6 aa, synthetic construct
  REGION 1..6: note = Synthetic Construct
EKRAQK

SEQ ID NO: 11481 - protein, 6 aa, synthetic construct
  REGION 1..6: note = Synthetic Construct
EKRARK

SEQ ID NO: 11482 - protein, 6 aa, synthetic construct
  REGION 1..6: note = Synthetic Construct
EKRASK

SEQ ID NO: 11483 - protein, 6 aa, synthetic construct
  REGION 1..6: note = Synthetic Construct
EKRATK

SEQ ID NO: 11484 - protein, 6 aa, synthetic construct
  REGION 1..6: note = Synthetic Construct
EKRAYK

SEQ ID NO: 11485 - protein, 6 aa, synthetic construct
  REGION 1..6: note = Synthetic Construct
EKRDAK

SEQ ID NO: 11486 - protein, 6 aa, synthetic construct
  REGION 1..6: note = Synthetic Construct
EKRDDK

SEQ ID NO: 11487 - protein, 6 aa, synthetic construct
  REGION 1..6: note = Synthetic Construct
EKRDEK

SEQ ID NO: 11488 - protein, 6 aa, synthetic construct
  REGION 1..6: note = Synthetic Construct
EKRDFK

SEQ ID NO: 11489 - protein, 6 aa, synthetic construct
  REGION 1..6: note = Synthetic Construct
EKRDGK

SEQ ID NO: 11490 - protein, 6 aa, synthetic construct
  REGION 1..6: note = Synthetic Construct
EKRDHK

SEQ ID NO: 11491 - protein, 6 aa, synthetic construct
  REGION 1..6: note = Synthetic Construct
EKRDIK

SEQ ID NO: 11492 - protein, 6 aa, synthetic construct
  REGION 1..6: note = Synthetic Construct
EKRDLK

SEQ ID NO: 11493 - protein, 6 aa, synthetic construct
  REGION 1..6: note = Synthetic Construct
EKRDNK

SEQ ID NO: 11494 - protein, 6 aa, synthetic construct
  REGION 1..6: note = Synthetic Construct
EKRDQK

SEQ ID NO: 11495 - protein, 6 aa, synthetic construct
  REGION 1..6: note = Synthetic Construct
EKRDRK

SEQ ID NO: 11496 - protein, 6 aa, synthetic construct
  REGION 1..6: note = Synthetic Construct
EKRDSK

SEQ ID NO: 11497 - protein, 6 aa, synthetic construct
  REGION 1..6: note = Synthetic Construct
EKRDTK

SEQ ID NO: 11498 - protein, 6 aa, synthetic construct
  REGION 1..6: note = Synthetic Construct
EKRDYK

SEQ ID NO: 11499 - protein, 6 aa, synthetic construct
  REGION 1..6: note = Synthetic Construct
EKREAK

SEQ ID NO: 11500 - protein, 6 aa, synthetic construct
  REGION 1..6: note = Synthetic Construct
EKREDK

SEQ ID NO: 11501 - protein, 6 aa, synthetic construct
  REGION 1..6: note = Synthetic Construct
EKREEK

SEQ ID NO: 11502 - protein, 6 aa, synthetic construct
  REGION 1..6: note = Synthetic Construct
EKREFK

SEQ ID NO: 11503 - protein, 6 aa, synthetic construct
  REGION 1..6: note = Synthetic Construct
EKREGK

SEQ ID NO: 11504 - protein, 6 aa, synthetic construct
  REGION 1..6: note = Synthetic Construct
EKREHK

SEQ ID NO: 11505 - protein, 6 aa, synthetic construct
  REGION 1..6: note = Synthetic Construct
EKREIK

SEQ ID NO: 11506 - protein, 6 aa, synthetic construct
  REGION 1..6: note = Synthetic Construct
EKRELK

SEQ ID NO: 11507 - protein, 6 aa, synthetic construct
  REGION 1..6: note = Synthetic Construct
EKRENK

SEQ ID NO: 11508 - protein, 6 aa, synthetic construct
  REGION 1..6: note = Synthetic Construct
EKREQK

SEQ ID NO: 11509 - protein, 6 aa, synthetic construct
  REGION 1..6: note = Synthetic Construct
EKRERK

SEQ ID NO: 11510 - protein, 6 aa, synthetic construct
  REGION 1..6: note = Synthetic Construct
EKRESK

SEQ ID NO: 11511 - protein, 6 aa, synthetic construct
  REGION 1..6: note = Synthetic Construct
EKRETK

SEQ ID NO: 11512 - protein, 6 aa, synthetic construct
  REGION 1..6: note = Synthetic Construct
EKREYK

SEQ ID NO: 11513 - protein, 6 aa, synthetic construct
  REGION 1..6: note = Synthetic Construct
EKRFAK

SEQ ID NO: 11514 - protein, 6 aa, synthetic construct
  REGION 1..6: note = Synthetic Construct
EKRFDK

SEQ ID NO: 11515 - protein, 6 aa, synthetic construct
  REGION 1..6: note = Synthetic Construct
EKRFEK

SEQ ID NO: 11516 - protein, 6 aa, synthetic construct
  REGION 1..6: note = Synthetic Construct
EKRFFK

SEQ ID NO: 11517 - protein, 6 aa, synthetic construct
  REGION 1..6: note = Synthetic Construct
EKRFGK

SEQ ID NO: 11518 - protein, 6 aa, synthetic construct
  REGION 1..6: note = Synthetic Construct
EKRFHK

SEQ ID NO: 11519 - protein, 6 aa, synthetic construct
  REGION 1..6: note = Synthetic Construct
EKRFIK

SEQ ID NO: 11520 - protein, 6 aa, synthetic construct
  REGION 1..6: note = Synthetic Construct
EKRFLK

SEQ ID NO: 11521 - protein, 6 aa, synthetic construct
  REGION 1..6: note = Synthetic Construct
EKRFNK

SEQ ID NO: 11522 - protein, 6 aa, synthetic construct
  REGION 1..6: note = Synthetic Construct
EKRFQK

SEQ ID NO: 11523 - protein, 6 aa, synthetic construct
  REGION 1..6: note = Synthetic Construct
EKRFRK

SEQ ID NO: 11524 - protein, 6 aa, synthetic construct
  REGION 1..6: note = Synthetic Construct
EKRFSK

SEQ ID NO: 11525 - protein, 6 aa, synthetic construct
  REGION 1..6: note = Synthetic Construct
EKRFTK

SEQ ID NO: 11526 - protein, 6 aa, synthetic construct
  REGION 1..6: note = Synthetic Construct
EKRFYK

SEQ ID NO: 11527 - protein, 6 aa, synthetic construct
  REGION 1..6: note = Synthetic Construct
EKRGAK

SEQ ID NO: 11528 - protein, 6 aa, synthetic construct
  REGION 1..6: note = Synthetic Construct
EKRGDK

SEQ ID NO: 11529 - protein, 6 aa, synthetic construct
  REGION 1..6: note = Synthetic Construct
EKRGEK

SEQ ID NO: 11530 - protein, 6 aa, synthetic construct
  REGION 1..6: note = Synthetic Construct
EKRGFK

SEQ ID NO: 11531 - protein, 6 aa, synthetic construct
  REGION 1..6: note = Synthetic Construct
EKRGGK

SEQ ID NO: 11532 - protein, 6 aa, synthetic construct
  REGION 1..6: note = Synthetic Construct
EKRGHK

SEQ ID NO: 11533 - protein, 6 aa, synthetic construct
  REGION 1..6: note = Synthetic Construct
EKRGIK

SEQ ID NO: 11534 - protein, 6 aa, synthetic construct
  REGION 1..6: note = Synthetic Construct
EKRGLK

SEQ ID NO: 11535 - protein, 6 aa, synthetic construct
  REGION 1..6: note = Synthetic Construct
EKRGNK

SEQ ID NO: 11536 - protein, 6 aa, synthetic construct
  REGION 1..6: note = Synthetic Construct
EKRGQK

SEQ ID NO: 11537 - protein, 6 aa, synthetic construct
  REGION 1..6: note = Synthetic Construct
EKRGRK

SEQ ID NO: 11538 - protein, 6 aa, synthetic construct
  REGION 1..6: note = Synthetic Construct
EKRGSK

SEQ ID NO: 11539 - protein, 6 aa, synthetic construct
  REGION 1..6: note = Synthetic Construct
EKRGTK

SEQ ID NO: 11540 - protein, 6 aa, synthetic construct
  REGION 1..6: note = Synthetic Construct
EKRGYK

SEQ ID NO: 11541 - protein, 6 aa, synthetic construct
  REGION 1..6: note = Synthetic Construct
EKRHAK

SEQ ID NO: 11542 - protein, 6 aa, synthetic construct
  REGION 1..6: note = Synthetic Construct
EKRHDK

SEQ ID NO: 11543 - protein, 6 aa, synthetic construct
  REGION 1..6: note = Synthetic Construct
EKRHEK

SEQ ID NO: 11544 - protein, 6 aa, synthetic construct
  REGION 1..6: note = Synthetic Construct
EKRHFK

SEQ ID NO: 11545 - protein, 6 aa, synthetic construct
  REGION 1..6: note = Synthetic Construct
EKRHGK

SEQ ID NO: 11546 - protein, 6 aa, synthetic construct
  REGION 1..6: note = Synthetic Construct
EKRHHK

SEQ ID NO: 11547 - protein, 6 aa, synthetic construct
  REGION 1..6: note = Synthetic Construct
EKRHIK

SEQ ID NO: 11548 - protein, 6 aa, synthetic construct
  REGION 1..6: note = Synthetic Construct
EKRHLK

SEQ ID NO: 11549 - protein, 6 aa, synthetic construct
  REGION 1..6: note = Synthetic Construct
EKRHNK

SEQ ID NO: 11550 - protein, 6 aa, synthetic construct
  REGION 1..6: note = Synthetic Construct
EKRHQK

SEQ ID NO: 11551 - protein, 6 aa, synthetic construct
  REGION 1..6: note = Synthetic Construct
EKRHRK

SEQ ID NO: 11552 - protein, 6 aa, synthetic construct
  REGION 1..6: note = Synthetic Construct
EKRHSK

SEQ ID NO: 11553 - protein, 6 aa, synthetic construct
  REGION 1..6: note = Synthetic Construct
EKRHTK

SEQ ID NO: 11554 - protein, 6 aa, synthetic construct
  REGION 1..6: note = Synthetic Construct
EKRHYK

SEQ ID NO: 11555 - protein, 6 aa, synthetic construct
  REGION 1..6: note = Synthetic Construct
EKRIAK

SEQ ID NO: 11556 - protein, 6 aa, synthetic construct
  REGION 1..6: note = Synthetic Construct
EKRIDK

SEQ ID NO: 11557 - protein, 6 aa, synthetic construct
  REGION 1..6: note = Synthetic Construct
EKRIEK

SEQ ID NO: 11558 - protein, 6 aa, synthetic construct
  REGION 1..6: note = Synthetic Construct
EKRIFK

SEQ ID NO: 11559 - protein, 6 aa, synthetic construct
  REGION 1..6: note = Synthetic Construct
EKRIGK

SEQ ID NO: 11560 - protein, 6 aa, synthetic construct
  REGION 1..6: note = Synthetic Construct
EKRIHK

SEQ ID NO: 11561 - protein, 6 aa, synthetic construct
  REGION 1..6: note = Synthetic Construct
EKRIIK

SEQ ID NO: 11562 - protein, 6 aa, synthetic construct
  REGION 1..6: note = Synthetic Construct
EKRILK

SEQ ID NO: 11563 - protein, 6 aa, synthetic construct
  REGION 1..6: note = Synthetic Construct
EKRINK

SEQ ID NO: 11564 - protein, 6 aa, synthetic construct
  REGION 1..6: note = Synthetic Construct
EKRIQK

SEQ ID NO: 11565 - protein, 6 aa, synthetic construct
  REGION 1..6: note = Synthetic Construct
EKRIRK

SEQ ID NO: 11566 - protein, 6 aa, synthetic construct
  REGION 1..6: note = Synthetic Construct
EKRISK

SEQ ID NO: 11567 - protein, 6 aa, synthetic construct
  REGION 1..6: note = Synthetic Construct
EKRITK

SEQ ID NO: 11568 - protein, 6 aa, synthetic construct
  REGION 1..6: note = Synthetic Construct
EKRIYK

SEQ ID NO: 11569 - protein, 6 aa, synthetic construct
  REGION 1..6: note = Synthetic Construct
EKRLAK

SEQ ID NO: 11570 - protein, 6 aa, synthetic construct
  REGION 1..6: note = Synthetic Construct
EKRLDK

SEQ ID NO: 11571 - protein, 6 aa, synthetic construct
  REGION 1..6: note = Synthetic Construct
EKRLEK

SEQ ID NO: 11572 - protein, 6 aa, synthetic construct
  REGION 1..6: note = Synthetic Construct
EKRLFK

SEQ ID NO: 11573 - protein, 6 aa, synthetic construct
  REGION 1..6: note = Synthetic Construct
EKRLGK

SEQ ID NO: 11574 - protein, 6 aa, synthetic construct
  REGION 1..6: note = Synthetic Construct
EKRLHK

SEQ ID NO: 11575 - protein, 6 aa, synthetic construct
  REGION 1..6: note = Synthetic Construct
EKRLIK

SEQ ID NO: 11576 - protein, 6 aa, synthetic construct
  REGION 1..6: note = Synthetic Construct
EKRLLK

SEQ ID NO: 11577 - protein, 6 aa, synthetic construct
  REGION 1..6: note = Synthetic Construct
EKRLNK

SEQ ID NO: 11578 - protein, 6 aa, synthetic construct
  REGION 1..6: note = Synthetic Construct
EKRLQK

SEQ ID NO: 11579 - protein, 6 aa, synthetic construct
  REGION 1..6: note = Synthetic Construct
EKRLRK

SEQ ID NO: 11580 - protein, 6 aa, synthetic construct
  REGION 1..6: note = Synthetic Construct
EKRLSK

SEQ ID NO: 11581 - protein, 6 aa, synthetic construct
  REGION 1..6: note = Synthetic Construct
EKRLTK

SEQ ID NO: 11582 - protein, 6 aa, synthetic construct
  REGION 1..6: note = Synthetic Construct
EKRLYK

SEQ ID NO: 11583 - protein, 6 aa, synthetic construct
  REGION 1..6: note = Synthetic Construct
EKRNAK

SEQ ID NO: 11584 - protein, 6 aa, synthetic construct
  REGION 1..6: note = Synthetic Construct
EKRNDK

SEQ ID NO: 11585 - protein, 6 aa, synthetic construct
  REGION 1..6: note = Synthetic Construct
EKRNEK

SEQ ID NO: 11586 - protein, 6 aa, synthetic construct
  REGION 1..6: note = Synthetic Construct
EKRNFK

SEQ ID NO: 11587 - protein, 6 aa, synthetic construct
  REGION 1..6: note = Synthetic Construct
EKRNGK

SEQ ID NO: 11588 - protein, 6 aa, synthetic construct
  REGION 1..6: note = Synthetic Construct
EKRNHK

SEQ ID NO: 11589 - protein, 6 aa, synthetic construct
  REGION 1..6: note = Synthetic Construct
EKRNIK

SEQ ID NO: 11590 - protein, 6 aa, synthetic construct
  REGION 1..6: note = Synthetic Construct
EKRNLK

SEQ ID NO: 11591 - protein, 6 aa, synthetic construct
  REGION 1..6: note = Synthetic Construct
EKRNNK

SEQ ID NO: 11592 - protein, 6 aa, synthetic construct
  REGION 1..6: note = Synthetic Construct
EKRNQK

SEQ ID NO: 11593 - protein, 6 aa, synthetic construct
  REGION 1..6: note = Synthetic Construct
EKRNRK

SEQ ID NO: 11594 - protein, 6 aa, synthetic construct
  REGION 1..6: note = Synthetic Construct
EKRNSK

SEQ ID NO: 11595 - protein, 6 aa, synthetic construct
  REGION 1..6: note = Synthetic Construct
EKRNTK

SEQ ID NO: 11596 - protein, 6 aa, synthetic construct
  REGION 1..6: note = Synthetic Construct
EKRNYK

SEQ ID NO: 11597 - protein, 6 aa, synthetic construct
  REGION 1..6: note = Synthetic Construct
EKRQAK

SEQ ID NO: 11598 - protein, 6 aa, synthetic construct
  REGION 1..6: note = Synthetic Construct
EKRQDK

SEQ ID NO: 11599 - protein, 6 aa, synthetic construct
  REGION 1..6: note = Synthetic Construct
EKRQEK

SEQ ID NO: 11600 - protein, 6 aa, synthetic construct
  REGION 1..6: note = Synthetic Construct
EKRQFK

SEQ ID NO: 11601 - protein, 6 aa, synthetic construct
  REGION 1..6: note = Synthetic Construct
EKRQGK

SEQ ID NO: 11602 - protein, 6 aa, synthetic construct
  REGION 1..6: note = Synthetic Construct
EKRQHK

SEQ ID NO: 11603 - protein, 6 aa, synthetic construct
  REGION 1..6: note = Synthetic Construct
EKRQIK

SEQ ID NO: 11604 - protein, 6 aa, synthetic construct
  REGION 1..6: note = Synthetic Construct
EKRQLK

SEQ ID NO: 11605 - protein, 6 aa, synthetic construct
  REGION 1..6: note = Synthetic Construct
EKRQNK

SEQ ID NO: 11606 - protein, 6 aa, synthetic construct
  REGION 1..6: note = Synthetic Construct
EKRQQK

SEQ ID NO: 11607 - protein, 6 aa, synthetic construct
  REGION 1..6: note = Synthetic Construct
EKRQRK

SEQ ID NO: 11608 - protein, 6 aa, synthetic construct
  REGION 1..6: note = Synthetic Construct
EKRQSK

SEQ ID NO: 11609 - protein, 6 aa, synthetic construct
  REGION 1..6: note = Synthetic Construct
EKRQTK

SEQ ID NO: 11610 - protein, 6 aa, synthetic construct
  REGION 1..6: note = Synthetic Construct
EKRQYK

SEQ ID NO: 11611 - protein, 6 aa, synthetic construct
  REGION 1..6: note = Synthetic Construct
EKRRAK

SEQ ID NO: 11612 - protein, 6 aa, synthetic construct
  REGION 1..6: note = Synthetic Construct
EKRRDK

SEQ ID NO: 11613 - protein, 6 aa, synthetic construct
  REGION 1..6: note = Synthetic Construct
EKRREK

SEQ ID NO: 11614 - protein, 6 aa, synthetic construct
  REGION 1..6: note = Synthetic Construct
EKRRFK

SEQ ID NO: 11615 - protein, 6 aa, synthetic construct
  REGION 1..6: note = Synthetic Construct
EKRRGK

SEQ ID NO: 11616 - protein, 6 aa, synthetic construct
  REGION 1..6: note = Synthetic Construct
EKRRHK

SEQ ID NO: 11617 - protein, 6 aa, synthetic construct
  REGION 1..6: note = Synthetic Construct
EKRRIK

SEQ ID NO: 11618 - protein, 6 aa, synthetic construct
  REGION 1..6: note = Synthetic Construct
EKRRLK

SEQ ID NO: 11619 - protein, 6 aa, synthetic construct
  REGION 1..6: note = Synthetic Construct
EKRRNK

SEQ ID NO: 11620 - protein, 6 aa, synthetic construct
  REGION 1..6: note = Synthetic Construct
EKRRQK

SEQ ID NO: 11621 - protein, 6 aa, synthetic construct
  REGION 1..6: note = Synthetic Construct
EKRRRK

SEQ ID NO: 11622 - protein, 6 aa, synthetic construct
  REGION 1..6: note = Synthetic Construct
EKRRSK

SEQ ID NO: 11623 - protein, 6 aa, synthetic construct
  REGION 1..6: note = Synthetic Construct
EKRRTK

SEQ ID NO: 11624 - protein, 6 aa, synthetic construct
  REGION 1..6: note = Synthetic Construct
EKRRYK

SEQ ID NO: 11625 - protein, 6 aa, synthetic construct
  REGION 1..6: note = Synthetic Construct
EKRSAK

SEQ ID NO: 11626 - protein, 6 aa, synthetic construct
  REGION 1..6: note = Synthetic Construct
EKRSDK

SEQ ID NO: 11627 - protein, 6 aa, synthetic construct
  REGION 1..6: note = Synthetic Construct
EKRSEK

SEQ ID NO: 11628 - protein, 6 aa, synthetic construct
  REGION 1..6: note = Synthetic Construct
EKRSFK

SEQ ID NO: 11629 - protein, 6 aa, synthetic construct
  REGION 1..6: note = Synthetic Construct
EKRSGK

SEQ ID NO: 11630 - protein, 6 aa, synthetic construct
  REGION 1..6: note = Synthetic Construct
EKRSHK

SEQ ID NO: 11631 - protein, 6 aa, synthetic construct
  REGION 1..6: note = Synthetic Construct
EKRSIK

SEQ ID NO: 11632 - protein, 6 aa, synthetic construct
  REGION 1..6: note = Synthetic Construct
EKRSLK

SEQ ID NO: 11633 - protein, 6 aa, synthetic construct
  REGION 1..6: note = Synthetic Construct
EKRSNK

SEQ ID NO: 11634 - protein, 6 aa, synthetic construct
  REGION 1..6: note = Synthetic Construct
EKRSQK

SEQ ID NO: 11635 - protein, 6 aa, synthetic construct
  REGION 1..6: note = Synthetic Construct
EKRSRK

SEQ ID NO: 11636 - protein, 6 aa, synthetic construct
  REGION 1..6: note = Synthetic Construct
EKRSSK

SEQ ID NO: 11637 - protein, 6 aa, synthetic construct
  REGION 1..6: note = Synthetic Construct
EKRSTK

SEQ ID NO: 11638 - protein, 6 aa, synthetic construct
  REGION 1..6: note = Synthetic Construct
EKRSYK

SEQ ID NO: 11639 - protein, 6 aa, synthetic construct
  REGION 1..6: note = Synthetic Construct
EKRTAK

SEQ ID NO: 11640 - protein, 6 aa, synthetic construct
  REGION 1..6: note = Synthetic Construct
EKRTDK

SEQ ID NO: 11641 - protein, 6 aa, synthetic construct
  REGION 1..6: note = Synthetic Construct
EKRTEK

SEQ ID NO: 11642 - protein, 6 aa, synthetic construct
  REGION 1..6: note = Synthetic Construct
EKRTFK

SEQ ID NO: 11643 - protein, 6 aa, synthetic construct
  REGION 1..6: note = Synthetic Construct
EKRTGK

SEQ ID NO: 11644 - protein, 6 aa, synthetic construct
  REGION 1..6: note = Synthetic Construct
EKRTHK

SEQ ID NO: 11645 - protein, 6 aa, synthetic construct
  REGION 1..6: note = Synthetic Construct
EKRTIK

SEQ ID NO: 11646 - protein, 6 aa, synthetic construct
  REGION 1..6: note = Synthetic Construct
EKRTLK

SEQ ID NO: 11647 - protein, 6 aa, synthetic construct
  REGION 1..6: note = Synthetic Construct
EKRTNK

SEQ ID NO: 11648 - protein, 6 aa, synthetic construct
  REGION 1..6: note = Synthetic Construct
EKRTQK

SEQ ID NO: 11649 - protein, 6 aa, synthetic construct
  REGION 1..6: note = Synthetic Construct
EKRTRK

SEQ ID NO: 11650 - protein, 6 aa, synthetic construct
  REGION 1..6: note = Synthetic Construct
EKRTSK

SEQ ID NO: 11651 - protein, 6 aa, synthetic construct
  REGION 1..6: note = Synthetic Construct
EKRTTK

SEQ ID NO: 11652 - protein, 6 aa, synthetic construct
  REGION 1..6: note = Synthetic Construct
EKRTYK

SEQ ID NO: 11653 - protein, 6 aa, synthetic construct
  REGION 1..6: note = Synthetic Construct
EKRYAK

SEQ ID NO: 11654 - protein, 6 aa, synthetic construct
  REGION 1..6: note = Synthetic Construct
EKRYDK

SEQ ID NO: 11655 - protein, 6 aa, synthetic construct
  REGION 1..6: note = Synthetic Construct
EKRYEK

SEQ ID NO: 11656 - protein, 6 aa, synthetic construct
  REGION 1..6: note = Synthetic Construct
EKRYFK

SEQ ID NO: 11657 - protein, 6 aa, synthetic construct
  REGION 1..6: note = Synthetic Construct
EKRYGK

SEQ ID NO: 11658 - protein, 6 aa, synthetic construct
  REGION 1..6: note = Synthetic Construct
EKRYHK

SEQ ID NO: 11659 - protein, 6 aa, synthetic construct
  REGION 1..6: note = Synthetic Construct
EKRYIK

SEQ ID NO: 11660 - protein, 6 aa, synthetic construct
  REGION 1..6: note = Synthetic Construct
EKRYLK

SEQ ID NO: 11661 - protein, 6 aa, synthetic construct
  REGION 1..6: note = Synthetic Construct
EKRYNK

SEQ ID NO: 11662 - protein, 6 aa, synthetic construct
  REGION 1..6: note = Synthetic Construct
EKRYQK

SEQ ID NO: 11663 - protein, 6 aa, synthetic construct
  REGION 1..6: note = Synthetic Construct
EKRYRK

SEQ ID NO: 11664 - protein, 6 aa, synthetic construct
  REGION 1..6: note = Synthetic Construct
EKRYSK

SEQ ID NO: 11665 - protein, 6 aa, synthetic construct
  REGION 1..6: note = Synthetic Construct
EKRYTK

SEQ ID NO: 11666 - protein, 6 aa, synthetic construct
  REGION 1..6: note = Synthetic Construct
EKRYYK

SEQ ID NO: 11667 - protein, 6 aa, synthetic construct
  REGION 1..6: note = Synthetic Construct
EKSAAK

SEQ ID NO: 11668 - protein, 6 aa, synthetic construct
  REGION 1..6: note = Synthetic Construct
EKSADK

SEQ ID NO: 11669 - protein, 6 aa, synthetic construct
  REGION 1..6: note = Synthetic Construct
EKSAEK

SEQ ID NO: 11670 - protein, 6 aa, synthetic construct
  REGION 1..6: note = Synthetic Construct
EKSAFK

SEQ ID NO: 11671 - protein, 6 aa, synthetic construct
  REGION 1..6: note = Synthetic Construct
EKSAGK

SEQ ID NO: 11672 - protein, 6 aa, synthetic construct
  REGION 1..6: note = Synthetic Construct
EKSAHK

SEQ ID NO: 11673 - protein, 6 aa, synthetic construct
  REGION 1..6: note = Synthetic Construct
EKSAIK

SEQ ID NO: 11674 - protein, 6 aa, synthetic construct
  REGION 1..6: note = Synthetic Construct
EKSALK

SEQ ID NO: 11675 - protein, 6 aa, synthetic construct
  REGION 1..6: note = Synthetic Construct
EKSANK

SEQ ID NO: 11676 - protein, 6 aa, synthetic construct
  REGION 1..6: note = Synthetic Construct
EKSAQK

SEQ ID NO: 11677 - protein, 6 aa, synthetic construct
  REGION 1..6: note = Synthetic Construct
EKSARK

SEQ ID NO: 11678 - protein, 6 aa, synthetic construct
  REGION 1..6: note = Synthetic Construct
EKSASK

SEQ ID NO: 11679 - protein, 6 aa, synthetic construct
  REGION 1..6: note = Synthetic Construct
EKSATK

SEQ ID NO: 11680 - protein, 6 aa, synthetic construct
  REGION 1..6: note = Synthetic Construct
EKSAYK

SEQ ID NO: 11681 - protein, 6 aa, synthetic construct
  REGION 1..6: note = Synthetic Construct
EKSDAK

SEQ ID NO: 11682 - protein, 6 aa, synthetic construct
  REGION 1..6: note = Synthetic Construct
EKSDDK

SEQ ID NO: 11683 - protein, 6 aa, synthetic construct
  REGION 1..6: note = Synthetic Construct
EKSDEK

SEQ ID NO: 11684 - protein, 6 aa, synthetic construct
  REGION 1..6: note = Synthetic Construct
EKSDFK

SEQ ID NO: 11685 - protein, 6 aa, synthetic construct
  REGION 1..6: note = Synthetic Construct
EKSDGK

SEQ ID NO: 11686 - protein, 6 aa, synthetic construct
  REGION 1..6: note = Synthetic Construct
EKSDHK

SEQ ID NO: 11687 - protein, 6 aa, synthetic construct
  REGION 1..6: note = Synthetic Construct
EKSDIK

SEQ ID NO: 11688 - protein, 6 aa, synthetic construct
  REGION 1..6: note = Synthetic Construct
EKSDLK

SEQ ID NO: 11689 - protein, 6 aa, synthetic construct
  REGION 1..6: note = Synthetic Construct
EKSDNK

SEQ ID NO: 11690 - protein, 6 aa, synthetic construct
  REGION 1..6: note = Synthetic Construct
EKSDQK

SEQ ID NO: 11691 - protein, 6 aa, synthetic construct
  REGION 1..6: note = Synthetic Construct
EKSDRK

SEQ ID NO: 11692 - protein, 6 aa, synthetic construct
  REGION 1..6: note = Synthetic Construct
EKSDSK

SEQ ID NO: 11693 - protein, 6 aa, synthetic construct
  REGION 1..6: note = Synthetic Construct
EKSDTK

SEQ ID NO: 11694 - protein, 6 aa, synthetic construct
  REGION 1..6: note = Synthetic Construct
EKSDYK

SEQ ID NO: 11695 - protein, 6 aa, synthetic construct
  REGION 1..6: note = Synthetic Construct
EKSEAK

SEQ ID NO: 11696 - protein, 6 aa, synthetic construct
  REGION 1..6: note = Synthetic Construct
EKSEDK

SEQ ID NO: 11697 - protein, 6 aa, synthetic construct
  REGION 1..6: note = Synthetic Construct
EKSEEK

SEQ ID NO: 11698 - protein, 6 aa, synthetic construct
  REGION 1..6: note = Synthetic Construct
EKSEFK

SEQ ID NO: 11699 - protein, 6 aa, synthetic construct
  REGION 1..6: note = Synthetic Construct
EKSEGK

SEQ ID NO: 11700 - protein, 6 aa, synthetic construct
  REGION 1..6: note = Synthetic Construct
EKSEHK

SEQ ID NO: 11701 - protein, 6 aa, synthetic construct
  REGION 1..6: note = Synthetic Construct
EKSEIK

SEQ ID NO: 11702 - protein, 6 aa, synthetic construct
  REGION 1..6: note = Synthetic Construct
EKSELK

SEQ ID NO: 11703 - protein, 6 aa, synthetic construct
  REGION 1..6: note = Synthetic Construct
EKSENK

SEQ ID NO: 11704 - protein, 6 aa, synthetic construct
  REGION 1..6: note = Synthetic Construct
EKSEQK

SEQ ID NO: 11705 - protein, 6 aa, synthetic construct
  REGION 1..6: note = Synthetic Construct
EKSERK

SEQ ID NO: 11706 - protein, 6 aa, synthetic construct
  REGION 1..6: note = Synthetic Construct
EKSESK

SEQ ID NO: 11707 - protein, 6 aa, synthetic construct
  REGION 1..6: note = Synthetic Construct
EKSETK

SEQ ID NO: 11708 - protein, 6 aa, synthetic construct
  REGION 1..6: note = Synthetic Construct
EKSEYK

SEQ ID NO: 11709 - protein, 6 aa, synthetic construct
  REGION 1..6: note = Synthetic Construct
EKSFAK

SEQ ID NO: 11710 - protein, 6 aa, synthetic construct
  REGION 1..6: note = Synthetic Construct
EKSFDK

SEQ ID NO: 11711 - protein, 6 aa, synthetic construct
  REGION 1..6: note = Synthetic Construct
EKSFEK

SEQ ID NO: 11712 - protein, 6 aa, synthetic construct
  REGION 1..6: note = Synthetic Construct
EKSFFK

SEQ ID NO: 11713 - protein, 6 aa, synthetic construct
  REGION 1..6: note = Synthetic Construct
EKSFGK

SEQ ID NO: 11714 - protein, 6 aa, synthetic construct
  REGION 1..6: note = Synthetic Construct
EKSFHK

SEQ ID NO: 11715 - protein, 6 aa, synthetic construct
  REGION 1..6: note = Synthetic Construct
EKSFIK

SEQ ID NO: 11716 - protein, 6 aa, synthetic construct
  REGION 1..6: note = Synthetic Construct
EKSFLK

SEQ ID NO: 11717 - protein, 6 aa, synthetic construct
  REGION 1..6: note = Synthetic Construct
EKSFNK

SEQ ID NO: 11718 - protein, 6 aa, synthetic construct
  REGION 1..6: note = Synthetic Construct
EKSFQK

SEQ ID NO: 11719 - protein, 6 aa, synthetic construct
  REGION 1..6: note = Synthetic Construct
EKSFRK

SEQ ID NO: 11720 - protein, 6 aa, synthetic construct
  REGION 1..6: note = Synthetic Construct
EKSFSK

SEQ ID NO: 11721 - protein, 6 aa, synthetic construct
  REGION 1..6: note = Synthetic Construct
EKSFTK

SEQ ID NO: 11722 - protein, 6 aa, synthetic construct
  REGION 1..6: note = Synthetic Construct
EKSFYK

SEQ ID NO: 11723 - protein, 6 aa, synthetic construct
  REGION 1..6: note = Synthetic Construct
EKSGAK

SEQ ID NO: 11724 - protein, 6 aa, synthetic construct
  REGION 1..6: note = Synthetic Construct
EKSGDK

SEQ ID NO: 11725 - protein, 6 aa, synthetic construct
  REGION 1..6: note = Synthetic Construct
EKSGEK

SEQ ID NO: 11726 - protein, 6 aa, synthetic construct
  REGION 1..6: note = Synthetic Construct
EKSGFK

SEQ ID NO: 11727 - protein, 6 aa, synthetic construct
  REGION 1..6: note = Synthetic Construct
EKSGGK

SEQ ID NO: 11728 - protein, 6 aa, synthetic construct
  REGION 1..6: note = Synthetic Construct
EKSGHK

SEQ ID NO: 11729 - protein, 6 aa, synthetic construct
  REGION 1..6: note = Synthetic Construct
EKSGIK

SEQ ID NO: 11730 - protein, 6 aa, synthetic construct
  REGION 1..6: note = Synthetic Construct
EKSGLK

SEQ ID NO: 11731 - protein, 6 aa, synthetic construct
  REGION 1..6: note = Synthetic Construct
EKSGNK

SEQ ID NO: 11732 - protein, 6 aa, synthetic construct
  REGION 1..6: note = Synthetic Construct
EKSGQK

SEQ ID NO: 11733 - protein, 6 aa, synthetic construct
  REGION 1..6: note = Synthetic Construct
EKSGRK

SEQ ID NO: 11734 - protein, 6 aa, synthetic construct
  REGION 1..6: note = Synthetic Construct
EKSGSK

SEQ ID NO: 11735 - protein, 6 aa, synthetic construct
  REGION 1..6: note = Synthetic Construct
EKSGTK

SEQ ID NO: 11736 - protein, 6 aa, synthetic construct
  REGION 1..6: note = Synthetic Construct
EKSGYK

SEQ ID NO: 11737 - protein, 6 aa, synthetic construct
  REGION 1..6: note = Synthetic Construct
EKSHAK

SEQ ID NO: 11738 - protein, 6 aa, synthetic construct
  REGION 1..6: note = Synthetic Construct
EKSHDK

SEQ ID NO: 11739 - protein, 6 aa, synthetic construct
  REGION 1..6: note = Synthetic Construct
EKSHEK

SEQ ID NO: 11740 - protein, 6 aa, synthetic construct
  REGION 1..6: note = Synthetic Construct
EKSHFK

SEQ ID NO: 11741 - protein, 6 aa, synthetic construct
  REGION 1..6: note = Synthetic Construct
EKSHGK

SEQ ID NO: 11742 - protein, 6 aa, synthetic construct
  REGION 1..6: note = Synthetic Construct
EKSHHK

SEQ ID NO: 11743 - protein, 6 aa, synthetic construct
  REGION 1..6: note = Synthetic Construct
EKSHIK

SEQ ID NO: 11744 - protein, 6 aa, synthetic construct
  REGION 1..6: note = Synthetic Construct
EKSHLK

SEQ ID NO: 11745 - protein, 6 aa, synthetic construct
  REGION 1..6: note = Synthetic Construct
EKSHNK

SEQ ID NO: 11746 - protein, 6 aa, synthetic construct
  REGION 1..6: note = Synthetic Construct
EKSHQK

SEQ ID NO: 11747 - protein, 6 aa, synthetic construct
  REGION 1..6: note = Synthetic Construct
EKSHRK

SEQ ID NO: 11748 - protein, 6 aa, synthetic construct
  REGION 1..6: note = Synthetic Construct
EKSHSK

SEQ ID NO: 11749 - protein, 6 aa, synthetic construct
  REGION 1..6: note = Synthetic Construct
EKSHTK

SEQ ID NO: 11750 - protein, 6 aa, synthetic construct
  REGION 1..6: note = Synthetic Construct
EKSHYK

SEQ ID NO: 11751 - protein, 6 aa, synthetic construct
  REGION 1..6: note = Synthetic Construct
EKSIAK

SEQ ID NO: 11752 - protein, 6 aa, synthetic construct
  REGION 1..6: note = Synthetic Construct
EKSIDK

SEQ ID NO: 11753 - protein, 6 aa, synthetic construct
  REGION 1..6: note = Synthetic Construct
EKSIEK

SEQ ID NO: 11754 - protein, 6 aa, synthetic construct
  REGION 1..6: note = Synthetic Construct
EKSIFK

SEQ ID NO: 11755 - protein, 6 aa, synthetic construct
  REGION 1..6: note = Synthetic Construct
EKSIGK

SEQ ID NO: 11756 - protein, 6 aa, synthetic construct
  REGION 1..6: note = Synthetic Construct
EKSIHK

SEQ ID NO: 11757 - protein, 6 aa, synthetic construct
  REGION 1..6: note = Synthetic Construct
EKSIIK

SEQ ID NO: 11758 - protein, 6 aa, synthetic construct
  REGION 1..6: note = Synthetic Construct
EKSILK

SEQ ID NO: 11759 - protein, 6 aa, synthetic construct
  REGION 1..6: note = Synthetic Construct
EKSINK

SEQ ID NO: 11760 - protein, 6 aa, synthetic construct
  REGION 1..6: note = Synthetic Construct
EKSIQK

SEQ ID NO: 11761 - protein, 6 aa, synthetic construct
  REGION 1..6: note = Synthetic Construct
EKSIRK

SEQ ID NO: 11762 - protein, 6 aa, synthetic construct
  REGION 1..6: note = Synthetic Construct
EKSISK

SEQ ID NO: 11763 - protein, 6 aa, synthetic construct
  REGION 1..6: note = Synthetic Construct
EKSITK

SEQ ID NO: 11764 - protein, 6 aa, synthetic construct
  REGION 1..6: note = Synthetic Construct
EKSIYK

SEQ ID NO: 11765 - protein, 6 aa, synthetic construct
  REGION 1..6: note = Synthetic Construct
EKSLAK

SEQ ID NO: 11766 - protein, 6 aa, synthetic construct
  REGION 1..6: note = Synthetic Construct
EKSLDK

SEQ ID NO: 11767 - protein, 6 aa, synthetic construct
  REGION 1..6: note = Synthetic Construct
EKSLEK

SEQ ID NO: 11768 - protein, 6 aa, synthetic construct
  REGION 1..6: note = Synthetic Construct
EKSLFK

SEQ ID NO: 11769 - protein, 6 aa, synthetic construct
  REGION 1..6: note = Synthetic Construct
EKSLGK

SEQ ID NO: 11770 - protein, 6 aa, synthetic construct
  REGION 1..6: note = Synthetic Construct
EKSLHK

SEQ ID NO: 11771 - protein, 6 aa, synthetic construct
  REGION 1..6: note = Synthetic Construct
EKSLIK

SEQ ID NO: 11772 - protein, 6 aa, synthetic construct
  REGION 1..6: note = Synthetic Construct
EKSLLK

SEQ ID NO: 11773 - protein, 6 aa, synthetic construct
  REGION 1..6: note = Synthetic Construct
EKSLNK

SEQ ID NO: 11774 - protein, 6 aa, synthetic construct
  REGION 1..6: note = Synthetic Construct
EKSLQK

SEQ ID NO: 11775 - protein, 6 aa, synthetic construct
  REGION 1..6: note = Synthetic Construct
EKSLRK

SEQ ID NO: 11776 - protein, 6 aa, synthetic construct
  REGION 1..6: note = Synthetic Construct
EKSLSK

SEQ ID NO: 11777 - protein, 6 aa, synthetic construct
  REGION 1..6: note = Synthetic Construct
EKSLTK

SEQ ID NO: 11778 - protein, 6 aa, synthetic construct
  REGION 1..6: note = Synthetic Construct
EKSLYK

SEQ ID NO: 11779 - protein, 6 aa, synthetic construct
  REGION 1..6: note = Synthetic Construct
EKSNAK

SEQ ID NO: 11780 - protein, 6 aa, synthetic construct
  REGION 1..6: note = Synthetic Construct
EKSNDK

SEQ ID NO: 11781 - protein, 6 aa, synthetic construct
  REGION 1..6: note = Synthetic Construct
EKSNEK

SEQ ID NO: 11782 - protein, 6 aa, synthetic construct
  REGION 1..6: note = Synthetic Construct
EKSNFK

SEQ ID NO: 11783 - protein, 6 aa, synthetic construct
  REGION 1..6: note = Synthetic Construct
EKSNGK

SEQ ID NO: 11784 - protein, 6 aa, synthetic construct
  REGION 1..6: note = Synthetic Construct
EKSNHK

SEQ ID NO: 11785 - protein, 6 aa, synthetic construct
  REGION 1..6: note = Synthetic Construct
EKSNIK

SEQ ID NO: 11786 - protein, 6 aa, synthetic construct
  REGION 1..6: note = Synthetic Construct
EKSNLK

SEQ ID NO: 11787 - protein, 6 aa, synthetic construct
  REGION 1..6: note = Synthetic Construct
EKSNNK

SEQ ID NO: 11788 - protein, 6 aa, synthetic construct
  REGION 1..6: note = Synthetic Construct
EKSNQK

SEQ ID NO: 11789 - protein, 6 aa, synthetic construct
  REGION 1..6: note = Synthetic Construct
EKSNRK

SEQ ID NO: 11790 - protein, 6 aa, synthetic construct
  REGION 1..6: note = Synthetic Construct
EKSNSK

SEQ ID NO: 11791 - protein, 6 aa, synthetic construct
  REGION 1..6: note = Synthetic Construct
EKSNTK

SEQ ID NO: 11792 - protein, 6 aa, synthetic construct
  REGION 1..6: note = Synthetic Construct
EKSNYK

SEQ ID NO: 11793 - protein, 6 aa, synthetic construct
  REGION 1..6: note = Synthetic Construct
EKSQAK

SEQ ID NO: 11794 - protein, 6 aa, synthetic construct
  REGION 1..6: note = Synthetic Construct
EKSQDK

SEQ ID NO: 11795 - protein, 6 aa, synthetic construct
  REGION 1..6: note = Synthetic Construct
EKSQEK

SEQ ID NO: 11796 - protein, 6 aa, synthetic construct
  REGION 1..6: note = Synthetic Construct
EKSQFK

SEQ ID NO: 11797 - protein, 6 aa, synthetic construct
  REGION 1..6: note = Synthetic Construct
EKSQGK

SEQ ID NO: 11798 - protein, 6 aa, synthetic construct
  REGION 1..6: note = Synthetic Construct
EKSQHK

SEQ ID NO: 11799 - protein, 6 aa, synthetic construct
  REGION 1..6: note = Synthetic Construct
EKSQIK

SEQ ID NO: 11800 - protein, 6 aa, synthetic construct
  REGION 1..6: note = Synthetic Construct
EKSQLK

SEQ ID NO: 11801 - protein, 6 aa, synthetic construct
  REGION 1..6: note = Synthetic Construct
EKSQNK

SEQ ID NO: 11802 - protein, 6 aa, synthetic construct
  REGION 1..6: note = Synthetic Construct
EKSQQK

SEQ ID NO: 11803 - protein, 6 aa, synthetic construct
  REGION 1..6: note = Synthetic Construct
EKSQRK

SEQ ID NO: 11804 - protein, 6 aa, synthetic construct
  REGION 1..6: note = Synthetic Construct
EKSQSK

SEQ ID NO: 11805 - protein, 6 aa, synthetic construct
  REGION 1..6: note = Synthetic Construct
EKSQTK

SEQ ID NO: 11806 - protein, 6 aa, synthetic construct
  REGION 1..6: note = Synthetic Construct
EKSQYK

SEQ ID NO: 11807 - protein, 6 aa, synthetic construct
  REGION 1..6: note = Synthetic Construct
EKSRAK

SEQ ID NO: 11808 - protein, 6 aa, synthetic construct
  REGION 1..6: note = Synthetic Construct
EKSRDK

SEQ ID NO: 11809 - protein, 6 aa, synthetic construct
  REGION 1..6: note = Synthetic Construct
EKSREK

SEQ ID NO: 11810 - protein, 6 aa, synthetic construct
  REGION 1..6: note = Synthetic Construct
EKSRFK

SEQ ID NO: 11811 - protein, 6 aa, synthetic construct
  REGION 1..6: note = Synthetic Construct
EKSRGK

SEQ ID NO: 11812 - protein, 6 aa, synthetic construct
  REGION 1..6: note = Synthetic Construct
EKSRHK

SEQ ID NO: 11813 - protein, 6 aa, synthetic construct
  REGION 1..6: note = Synthetic Construct
EKSRIK

SEQ ID NO: 11814 - protein, 6 aa, synthetic construct
  REGION 1..6: note = Synthetic Construct
EKSRLK

SEQ ID NO: 11815 - protein, 6 aa, synthetic construct
  REGION 1..6: note = Synthetic Construct
EKSRNK

SEQ ID NO: 11816 - protein, 6 aa, synthetic construct
  REGION 1..6: note = Synthetic Construct
EKSRQK

SEQ ID NO: 11817 - protein, 6 aa, synthetic construct
  REGION 1..6: note = Synthetic Construct
EKSRRK

SEQ ID NO: 11818 - protein, 6 aa, synthetic construct
  REGION 1..6: note = Synthetic Construct
EKSRSK

SEQ ID NO: 11819 - protein, 6 aa, synthetic construct
  REGION 1..6: note = Synthetic Construct
EKSRTK

SEQ ID NO: 11820 - protein, 6 aa, synthetic construct
  REGION 1..6: note = Synthetic Construct
EKSRYK

SEQ ID NO: 11821 - protein, 6 aa, synthetic construct
  REGION 1..6: note = Synthetic Construct
EKSSAK

SEQ ID NO: 11822 - protein, 6 aa, synthetic construct
  REGION 1..6: note = Synthetic Construct
EKSSDK

SEQ ID NO: 11823 - protein, 6 aa, synthetic construct
  REGION 1..6: note = Synthetic Construct
EKSSEK

SEQ ID NO: 11824 - protein, 6 aa, synthetic construct
  REGION 1..6: note = Synthetic Construct
EKSSFK

SEQ ID NO: 11825 - protein, 6 aa, synthetic construct
  REGION 1..6: note = Synthetic Construct
EKSSGK

SEQ ID NO: 11826 - protein, 6 aa, synthetic construct
  REGION 1..6: note = Synthetic Construct
EKSSHK

SEQ ID NO: 11827 - protein, 6 aa, synthetic construct
  REGION 1..6: note = Synthetic Construct
EKSSIK

SEQ ID NO: 11828 - protein, 6 aa, synthetic construct
  REGION 1..6: note = Synthetic Construct
EKSSLK

SEQ ID NO: 11829 - protein, 6 aa, synthetic construct
  REGION 1..6: note = Synthetic Construct
EKSSNK

SEQ ID NO: 11830 - protein, 6 aa, synthetic construct
  REGION 1..6: note = Synthetic Construct
EKSSQK

SEQ ID NO: 11831 - protein, 6 aa, synthetic construct
  REGION 1..6: note = Synthetic Construct
EKSSRK

SEQ ID NO: 11832 - protein, 6 aa, synthetic construct
  REGION 1..6: note = Synthetic Construct
EKSSSK

SEQ ID NO: 11833 - protein, 6 aa, synthetic construct
  REGION 1..6: note = Synthetic Construct
EKSSTK

SEQ ID NO: 11834 - protein, 6 aa, synthetic construct
  REGION 1..6: note = Synthetic Construct
EKSSYK

SEQ ID NO: 11835 - protein, 6 aa, synthetic construct
  REGION 1..6: note = Synthetic Construct
EKSTAK

SEQ ID NO: 11836 - protein, 6 aa, synthetic construct
  REGION 1..6: note = Synthetic Construct
EKSTDK

SEQ ID NO: 11837 - protein, 6 aa, synthetic construct
  REGION 1..6: note = Synthetic Construct
EKSTEK

SEQ ID NO: 11838 - protein, 6 aa, synthetic construct
  REGION 1..6: note = Synthetic Construct
EKSTFK

SEQ ID NO: 11839 - protein, 6 aa, synthetic construct
  REGION 1..6: note = Synthetic Construct
EKSTGK

SEQ ID NO: 11840 - protein, 6 aa, synthetic construct
  REGION 1..6: note = Synthetic Construct
EKSTHK

SEQ ID NO: 11841 - protein, 6 aa, synthetic construct
  REGION 1..6: note = Synthetic Construct
EKSTIK

SEQ ID NO: 11842 - protein, 6 aa, synthetic construct
  REGION 1..6: note = Synthetic Construct
EKSTLK

SEQ ID NO: 11843 - protein, 6 aa, synthetic construct
  REGION 1..6: note = Synthetic Construct
EKSTNK

SEQ ID NO: 11844 - protein, 6 aa, synthetic construct
  REGION 1..6: note = Synthetic Construct
EKSTQK

SEQ ID NO: 11845 - protein, 6 aa, synthetic construct
  REGION 1..6: note = Synthetic Construct
EKSTRK

SEQ ID NO: 11846 - protein, 6 aa, synthetic construct
  REGION 1..6: note = Synthetic Construct
EKSTSK

SEQ ID NO: 11847 - protein, 6 aa, synthetic construct
  REGION 1..6: note = Synthetic Construct
EKSTTK

SEQ ID NO: 11848 - protein, 6 aa, synthetic construct
  REGION 1..6: note = Synthetic Construct
EKSTYK

SEQ ID NO: 11849 - protein, 6 aa, synthetic construct
  REGION 1..6: note = Synthetic Construct
EKSYAK

SEQ ID NO: 11850 - protein, 6 aa, synthetic construct
  REGION 1..6: note = Synthetic Construct
EKSYDK

SEQ ID NO: 11851 - protein, 6 aa, synthetic construct
  REGION 1..6: note = Synthetic Construct
EKSYEK

SEQ ID NO: 11852 - protein, 6 aa, synthetic construct
  REGION 1..6: note = Synthetic Construct
EKSYFK

SEQ ID NO: 11853 - protein, 6 aa, synthetic construct
  REGION 1..6: note = Synthetic Construct
EKSYGK

SEQ ID NO: 11854 - protein, 6 aa, synthetic construct
  REGION 1..6: note = Synthetic Construct
EKSYHK

SEQ ID NO: 11855 - protein, 6 aa, synthetic construct
  REGION 1..6: note = Synthetic Construct
EKSYIK

SEQ ID NO: 11856 - protein, 6 aa, synthetic construct
  REGION 1..6: note = Synthetic Construct
EKSYLK

SEQ ID NO: 11857 - protein, 6 aa, synthetic construct
  REGION 1..6: note = Synthetic Construct
EKSYNK

SEQ ID NO: 11858 - protein, 6 aa, synthetic construct
  REGION 1..6: note = Synthetic Construct
EKSYQK

SEQ ID NO: 11859 - protein, 6 aa, synthetic construct
  REGION 1..6: note = Synthetic Construct
EKSYRK

SEQ ID NO: 11860 - protein, 6 aa, synthetic construct
  REGION 1..6: note = Synthetic Construct
EKSYSK

SEQ ID NO: 11861 - protein, 6 aa, synthetic construct
  REGION 1..6: note = Synthetic Construct
EKSYTK

SEQ ID NO: 11862 - protein, 6 aa, synthetic construct
  REGION 1..6: note = Synthetic Construct
EKSYYK

SEQ ID NO: 11863 - protein, 6 aa, synthetic construct
  REGION 1..6: note = Synthetic Construct
EKTAAK

SEQ ID NO: 11864 - protein, 6 aa, synthetic construct
  REGION 1..6: note = Synthetic Construct
EKTADK

SEQ ID NO: 11865 - protein, 6 aa, synthetic construct
  REGION 1..6: note = Synthetic Construct
EKTAEK

SEQ ID NO: 11866 - protein, 6 aa, synthetic construct
  REGION 1..6: note = Synthetic Construct
EKTAFK

SEQ ID NO: 11867 - protein, 6 aa, synthetic construct
  REGION 1..6: note = Synthetic Construct
EKTAGK

SEQ ID NO: 11868 - protein, 6 aa, synthetic construct
  REGION 1..6: note = Synthetic Construct
EKTAHK

SEQ ID NO: 11869 - protein, 6 aa, synthetic construct
  REGION 1..6: note = Synthetic Construct
EKTAIK

SEQ ID NO: 11870 - protein, 6 aa, synthetic construct
  REGION 1..6: note = Synthetic Construct
EKTALK

SEQ ID NO: 11871 - protein, 6 aa, synthetic construct
  REGION 1..6: note = Synthetic Construct
EKTANK

SEQ ID NO: 11872 - protein, 6 aa, synthetic construct
  REGION 1..6: note = Synthetic Construct
EKTAQK

SEQ ID NO: 11873 - protein, 6 aa, synthetic construct
  REGION 1..6: note = Synthetic Construct
EKTARK

SEQ ID NO: 11874 - protein, 6 aa, synthetic construct
  REGION 1..6: note = Synthetic Construct
EKTASK

SEQ ID NO: 11875 - protein, 6 aa, synthetic construct
  REGION 1..6: note = Synthetic Construct
EKTATK

SEQ ID NO: 11876 - protein, 6 aa, synthetic construct
  REGION 1..6: note = Synthetic Construct
EKTAYK

SEQ ID NO: 11877 - protein, 6 aa, synthetic construct
  REGION 1..6: note = Synthetic Construct
EKTDAK

SEQ ID NO: 11878 - protein, 6 aa, synthetic construct
  REGION 1..6: note = Synthetic Construct
EKTDDK

SEQ ID NO: 11879 - protein, 6 aa, synthetic construct
  REGION 1..6: note = Synthetic Construct
EKTDEK

SEQ ID NO: 11880 - protein, 6 aa, synthetic construct
  REGION 1..6: note = Synthetic Construct
EKTDFK

SEQ ID NO: 11881 - protein, 6 aa, synthetic construct
  REGION 1..6: note = Synthetic Construct
EKTDGK

SEQ ID NO: 11882 - protein, 6 aa, synthetic construct
  REGION 1..6: note = Synthetic Construct
EKTDHK

SEQ ID NO: 11883 - protein, 6 aa, synthetic construct
  REGION 1..6: note = Synthetic Construct
EKTDIK

SEQ ID NO: 11884 - protein, 6 aa, synthetic construct
  REGION 1..6: note = Synthetic Construct
EKTDLK

SEQ ID NO: 11885 - protein, 6 aa, synthetic construct
  REGION 1..6: note = Synthetic Construct
EKTDNK

SEQ ID NO: 11886 - protein, 6 aa, synthetic construct
  REGION 1..6: note = Synthetic Construct
EKTDQK

SEQ ID NO: 11887 - protein, 6 aa, synthetic construct
  REGION 1..6: note = Synthetic Construct
EKTDRK

SEQ ID NO: 11888 - protein, 6 aa, synthetic construct
  REGION 1..6: note = Synthetic Construct
EKTDSK

SEQ ID NO: 11889 - protein, 6 aa, synthetic construct
  REGION 1..6: note = Synthetic Construct
EKTDTK

SEQ ID NO: 11890 - protein, 6 aa, synthetic construct
  REGION 1..6: note = Synthetic Construct
EKTDYK

SEQ ID NO: 11891 - protein, 6 aa, synthetic construct
  REGION 1..6: note = Synthetic Construct
EKTEAK

SEQ ID NO: 11892 - protein, 6 aa, synthetic construct
  REGION 1..6: note = Synthetic Construct
EKTEDK

SEQ ID NO: 11893 - protein, 6 aa, synthetic construct
  REGION 1..6: note = Synthetic Construct
EKTEEK

SEQ ID NO: 11894 - protein, 6 aa, synthetic construct
  REGION 1..6: note = Synthetic Construct
EKTEFK

SEQ ID NO: 11895 - protein, 6 aa, synthetic construct
  REGION 1..6: note = Synthetic Construct
EKTEGK

SEQ ID NO: 11896 - protein, 6 aa, synthetic construct
  REGION 1..6: note = Synthetic Construct
EKTEHK

SEQ ID NO: 11897 - protein, 6 aa, synthetic construct
  REGION 1..6: note = Synthetic Construct
EKTEIK

SEQ ID NO: 11898 - protein, 6 aa, synthetic construct
  REGION 1..6: note = Synthetic Construct
EKTELK

SEQ ID NO: 11899 - protein, 6 aa, synthetic construct
  REGION 1..6: note = Synthetic Construct
EKTENK

SEQ ID NO: 11900 - protein, 6 aa, synthetic construct
  REGION 1..6: note = Synthetic Construct
EKTEQK

SEQ ID NO: 11901 - protein, 6 aa, synthetic construct
  REGION 1..6: note = Synthetic Construct
EKTERK

SEQ ID NO: 11902 - protein, 6 aa, synthetic construct
  REGION 1..6: note = Synthetic Construct
EKTESK

SEQ ID NO: 11903 - protein, 6 aa, synthetic construct
  REGION 1..6: note = Synthetic Construct
EKTETK

SEQ ID NO: 11904 - protein, 6 aa, synthetic construct
  REGION 1..6: note = Synthetic Construct
EKTEYK

SEQ ID NO: 11905 - protein, 6 aa, synthetic construct
  REGION 1..6: note = Synthetic Construct
EKTFAK

SEQ ID NO: 11906 - protein, 6 aa, synthetic construct
  REGION 1..6: note = Synthetic Construct
EKTFDK

SEQ ID NO: 11907 - protein, 6 aa, synthetic construct
  REGION 1..6: note = Synthetic Construct
EKTFEK

SEQ ID NO: 11908 - protein, 6 aa, synthetic construct
  REGION 1..6: note = Synthetic Construct
EKTFFK

SEQ ID NO: 11909 - protein, 6 aa, synthetic construct
  REGION 1..6: note = Synthetic Construct
EKTFGK

SEQ ID NO: 11910 - protein, 6 aa, synthetic construct
  REGION 1..6: note = Synthetic Construct
EKTFHK

SEQ ID NO: 11911 - protein, 6 aa, synthetic construct
  REGION 1..6: note = Synthetic Construct
EKTFIK

SEQ ID NO: 11912 - protein, 6 aa, synthetic construct
  REGION 1..6: note = Synthetic Construct
EKTFLK

SEQ ID NO: 11913 - protein, 6 aa, synthetic construct
  REGION 1..6: note = Synthetic Construct
EKTFNK

SEQ ID NO: 11914 - protein, 6 aa, synthetic construct
  REGION 1..6: note = Synthetic Construct
EKTFQK

SEQ ID NO: 11915 - protein, 6 aa, synthetic construct
  REGION 1..6: note = Synthetic Construct
EKTFRK

SEQ ID NO: 11916 - protein, 6 aa, synthetic construct
  REGION 1..6: note = Synthetic Construct
EKTFSK

SEQ ID NO: 11917 - protein, 6 aa, synthetic construct
  REGION 1..6: note = Synthetic Construct
EKTFTK

SEQ ID NO: 11918 - protein, 6 aa, synthetic construct
  REGION 1..6: note = Synthetic Construct
EKTFYK

SEQ ID NO: 11919 - protein, 6 aa, synthetic construct
  REGION 1..6: note = Synthetic Construct
EKTGAK

SEQ ID NO: 11920 - protein, 6 aa, synthetic construct
  REGION 1..6: note = Synthetic Construct
EKTGDK

SEQ ID NO: 11921 - protein, 6 aa, synthetic construct
  REGION 1..6: note = Synthetic Construct
EKTGEK

SEQ ID NO: 11922 - protein, 6 aa, synthetic construct
  REGION 1..6: note = Synthetic Construct
EKTGFK

SEQ ID NO: 11923 - protein, 6 aa, synthetic construct
  REGION 1..6: note = Synthetic Construct
EKTGGK

SEQ ID NO: 11924 - protein, 6 aa, synthetic construct
  REGION 1..6: note = Synthetic Construct
EKTGHK

SEQ ID NO: 11925 - protein, 6 aa, synthetic construct
  REGION 1..6: note = Synthetic Construct
EKTGIK

SEQ ID NO: 11926 - protein, 6 aa, synthetic construct
  REGION 1..6: note = Synthetic Construct
EKTGLK

SEQ ID NO: 11927 - protein, 6 aa, synthetic construct
  REGION 1..6: note = Synthetic Construct
EKTGNK

SEQ ID NO: 11928 - protein, 6 aa, synthetic construct
  REGION 1..6: note = Synthetic Construct
EKTGQK

SEQ ID NO: 11929 - protein, 6 aa, synthetic construct
  REGION 1..6: note = Synthetic Construct
EKTGRK

SEQ ID NO: 11930 - protein, 6 aa, synthetic construct
  REGION 1..6: note = Synthetic Construct
EKTGSK

SEQ ID NO: 11931 - protein, 6 aa, synthetic construct
  REGION 1..6: note = Synthetic Construct
EKTGTK

SEQ ID NO: 11932 - protein, 6 aa, synthetic construct
  REGION 1..6: note = Synthetic Construct
EKTGYK

SEQ ID NO: 11933 - protein, 6 aa, synthetic construct
  REGION 1..6: note = Synthetic Construct
EKTHAK

SEQ ID NO: 11934 - protein, 6 aa, synthetic construct
  REGION 1..6: note = Synthetic Construct
EKTHDK

SEQ ID NO: 11935 - protein, 6 aa, synthetic construct
  REGION 1..6: note = Synthetic Construct
EKTHEK

SEQ ID NO: 11936 - protein, 6 aa, synthetic construct
  REGION 1..6: note = Synthetic Construct
EKTHFK

SEQ ID NO: 11937 - protein, 6 aa, synthetic construct
  REGION 1..6: note = Synthetic Construct
EKTHGK

SEQ ID NO: 11938 - protein, 6 aa, synthetic construct
  REGION 1..6: note = Synthetic Construct
EKTHHK

SEQ ID NO: 11939 - protein, 6 aa, synthetic construct
  REGION 1..6: note = Synthetic Construct
EKTHIK

SEQ ID NO: 11940 - protein, 6 aa, synthetic construct
  REGION 1..6: note = Synthetic Construct
EKTHLK

SEQ ID NO: 11941 - protein, 6 aa, synthetic construct
  REGION 1..6: note = Synthetic Construct
EKTHNK

SEQ ID NO: 11942 - protein, 6 aa, synthetic construct
  REGION 1..6: note = Synthetic Construct
EKTHQK

SEQ ID NO: 11943 - protein, 6 aa, synthetic construct
  REGION 1..6: note = Synthetic Construct
EKTHRK

SEQ ID NO: 11944 - protein, 6 aa, synthetic construct
  REGION 1..6: note = Synthetic Construct
EKTHSK

SEQ ID NO: 11945 - protein, 6 aa, synthetic construct
  REGION 1..6: note = Synthetic Construct
EKTHTK

SEQ ID NO: 11946 - protein, 6 aa, synthetic construct
  REGION 1..6: note = Synthetic Construct
EKTHYK

SEQ ID NO: 11947 - protein, 6 aa, synthetic construct
  REGION 1..6: note = Synthetic Construct
EKTIAK

SEQ ID NO: 11948 - protein, 6 aa, synthetic construct
  REGION 1..6: note = Synthetic Construct
EKTIDK

SEQ ID NO: 11949 - protein, 6 aa, synthetic construct
  REGION 1..6: note = Synthetic Construct
EKTIEK

SEQ ID NO: 11950 - protein, 6 aa, synthetic construct
  REGION 1..6: note = Synthetic Construct
EKTIFK

SEQ ID NO: 11951 - protein, 6 aa, synthetic construct
  REGION 1..6: note = Synthetic Construct
EKTIGK

SEQ ID NO: 11952 - protein, 6 aa, synthetic construct
  REGION 1..6: note = Synthetic Construct
EKTIHK

SEQ ID NO: 11953 - protein, 6 aa, synthetic construct
  REGION 1..6: note = Synthetic Construct
EKTIIK

SEQ ID NO: 11954 - protein, 6 aa, synthetic construct
  REGION 1..6: note = Synthetic Construct
EKTILK

SEQ ID NO: 11955 - protein, 6 aa, synthetic construct
  REGION 1..6: note = Synthetic Construct
EKTINK

SEQ ID NO: 11956 - protein, 6 aa, synthetic construct
  REGION 1..6: note = Synthetic Construct
EKTIQK

SEQ ID NO: 11957 - protein, 6 aa, synthetic construct
  REGION 1..6: note = Synthetic Construct
EKTIRK

SEQ ID NO: 11958 - protein, 6 aa, synthetic construct
  REGION 1..6: note = Synthetic Construct
EKTISK

SEQ ID NO: 11959 - protein, 6 aa, synthetic construct
  REGION 1..6: note = Synthetic Construct
EKTITK

SEQ ID NO: 11960 - protein, 6 aa, synthetic construct
  REGION 1..6: note = Synthetic Construct
EKTIYK

SEQ ID NO: 11961 - protein, 6 aa, synthetic construct
  REGION 1..6: note = Synthetic Construct
EKTLAK

SEQ ID NO: 11962 - protein, 6 aa, synthetic construct
  REGION 1..6: note = Synthetic Construct
EKTLDK

SEQ ID NO: 11963 - protein, 6 aa, synthetic construct
  REGION 1..6: note = Synthetic Construct
EKTLEK

SEQ ID NO: 11964 - protein, 6 aa, synthetic construct
  REGION 1..6: note = Synthetic Construct
EKTLFK

SEQ ID NO: 11965 - protein, 6 aa, synthetic construct
  REGION 1..6: note = Synthetic Construct
EKTLGK

SEQ ID NO: 11966 - protein, 6 aa, synthetic construct
  REGION 1..6: note = Synthetic Construct
EKTLHK

SEQ ID NO: 11967 - protein, 6 aa, synthetic construct
  REGION 1..6: note = Synthetic Construct
EKTLIK

SEQ ID NO: 11968 - protein, 6 aa, synthetic construct
  REGION 1..6: note = Synthetic Construct
EKTLLK

SEQ ID NO: 11969 - protein, 6 aa, synthetic construct
  REGION 1..6: note = Synthetic Construct
EKTLNK

SEQ ID NO: 11970 - protein, 6 aa, synthetic construct
  REGION 1..6: note = Synthetic Construct
EKTLQK

SEQ ID NO: 11971 - protein, 6 aa, synthetic construct
  REGION 1..6: note = Synthetic Construct
EKTLRK

SEQ ID NO: 11972 - protein, 6 aa, synthetic construct
  REGION 1..6: note = Synthetic Construct
EKTLSK

SEQ ID NO: 11973 - protein, 6 aa, synthetic construct
  REGION 1..6: note = Synthetic Construct
EKTLTK

SEQ ID NO: 11974 - protein, 6 aa, synthetic construct
  REGION 1..6: note = Synthetic Construct
EKTLYK

SEQ ID NO: 11975 - protein, 6 aa, synthetic construct
  REGION 1..6: note = Synthetic Construct
EKTNAK

SEQ ID NO: 11976 - protein, 6 aa, synthetic construct
  REGION 1..6: note = Synthetic Construct
EKTNDK

SEQ ID NO: 11977 - protein, 6 aa, synthetic construct
  REGION 1..6: note = Synthetic Construct
EKTNEK

SEQ ID NO: 11978 - protein, 6 aa, synthetic construct
  REGION 1..6: note = Synthetic Construct
EKTNFK

SEQ ID NO: 11979 - protein, 6 aa, synthetic construct
  REGION 1..6: note = Synthetic Construct
EKTNGK

SEQ ID NO: 11980 - protein, 6 aa, synthetic construct
  REGION 1..6: note = Synthetic Construct
EKTNHK

SEQ ID NO: 11981 - protein, 6 aa, synthetic construct
  REGION 1..6: note = Synthetic Construct
EKTNIK

SEQ ID NO: 11982 - protein, 6 aa, synthetic construct
  REGION 1..6: note = Synthetic Construct
EKTNLK

SEQ ID NO: 11983 - protein, 6 aa, synthetic construct
  REGION 1..6: note = Synthetic Construct
EKTNNK

SEQ ID NO: 11984 - protein, 6 aa, synthetic construct
  REGION 1..6: note = Synthetic Construct
EKTNQK

SEQ ID NO: 11985 - protein, 6 aa, synthetic construct
  REGION 1..6: note = Synthetic Construct
EKTNRK

SEQ ID NO: 11986 - protein, 6 aa, synthetic construct
  REGION 1..6: note = Synthetic Construct
EKTNSK

SEQ ID NO: 11987 - protein, 6 aa, synthetic construct
  REGION 1..6: note = Synthetic Construct
EKTNTK

SEQ ID NO: 11988 - protein, 6 aa, synthetic construct
  REGION 1..6: note = Synthetic Construct
EKTNYK

SEQ ID NO: 11989 - protein, 6 aa, synthetic construct
  REGION 1..6: note = Synthetic Construct
EKTQAK

SEQ ID NO: 11990 - protein, 6 aa, synthetic construct
  REGION 1..6: note = Synthetic Construct
EKTQDK

SEQ ID NO: 11991 - protein, 6 aa, synthetic construct
  REGION 1..6: note = Synthetic Construct
EKTQEK

SEQ ID NO: 11992 - protein, 6 aa, synthetic construct
  REGION 1..6: note = Synthetic Construct
EKTQFK

SEQ ID NO: 11993 - protein, 6 aa, synthetic construct
  REGION 1..6: note = Synthetic Construct
EKTQGK

SEQ ID NO: 11994 - protein, 6 aa, synthetic construct
  REGION 1..6: note = Synthetic Construct
EKTQHK

SEQ ID NO: 11995 - protein, 6 aa, synthetic construct
  REGION 1..6: note = Synthetic Construct
EKTQIK

SEQ ID NO: 11996 - protein, 6 aa, synthetic construct
  REGION 1..6: note = Synthetic Construct
EKTQLK

SEQ ID NO: 11997 - protein, 6 aa, synthetic construct
  REGION 1..6: note = Synthetic Construct
EKTQNK

SEQ ID NO: 11998 - protein, 6 aa, synthetic construct
  REGION 1..6: note = Synthetic Construct
EKTQQK

SEQ ID NO: 11999 - protein, 6 aa, synthetic construct
  REGION 1..6: note = Synthetic Construct
EKTQRK

SEQ ID NO: 12000 - protein, 6 aa, synthetic construct
  REGION 1..6: note = Synthetic Construct
EKTQSK

SEQ ID NO: 12001 - protein, 6 aa, synthetic construct
  REGION 1..6: note = Synthetic Construct
EKTQTK

SEQ ID NO: 12002 - protein, 6 aa, synthetic construct
  REGION 1..6: note = Synthetic Construct
EKTQYK

SEQ ID NO: 12003 - protein, 6 aa, synthetic construct
  REGION 1..6: note = Synthetic Construct
EKTRAK

SEQ ID NO: 12004 - protein, 6 aa, synthetic construct
  REGION 1..6: note = Synthetic Construct
EKTRDK

SEQ ID NO: 12005 - protein, 6 aa, synthetic construct
  REGION 1..6: note = Synthetic Construct
EKTREK

SEQ ID NO: 12006 - protein, 6 aa, synthetic construct
  REGION 1..6: note = Synthetic Construct
EKTRFK

SEQ ID NO: 12007 - protein, 6 aa, synthetic construct
  REGION 1..6: note = Synthetic Construct
EKTRGK

SEQ ID NO: 12008 - protein, 6 aa, synthetic construct
  REGION 1..6: note = Synthetic Construct
EKTRHK

SEQ ID NO: 12009 - protein, 6 aa, synthetic construct
  REGION 1..6: note = Synthetic Construct
EKTRIK

SEQ ID NO: 12010 - protein, 6 aa, synthetic construct
  REGION 1..6: note = Synthetic Construct
EKTRLK

SEQ ID NO: 12011 - protein, 6 aa, synthetic construct
  REGION 1..6: note = Synthetic Construct
EKTRNK

SEQ ID NO: 12012 - protein, 6 aa, synthetic construct
  REGION 1..6: note = Synthetic Construct
EKTRQK

SEQ ID NO: 12013 - protein, 6 aa, synthetic construct
  REGION 1..6: note = Synthetic Construct
EKTRRK

SEQ ID NO: 12014 - protein, 6 aa, synthetic construct
  REGION 1..6: note = Synthetic Construct
EKTRSK

SEQ ID NO: 12015 - protein, 6 aa, synthetic construct
  REGION 1..6: note = Synthetic Construct
EKTRTK

SEQ ID NO: 12016 - protein, 6 aa, synthetic construct
  REGION 1..6: note = Synthetic Construct
EKTRYK

SEQ ID NO: 12017 - protein, 6 aa, synthetic construct
  REGION 1..6: note = Synthetic Construct
EKTSAK

SEQ ID NO: 12018 - protein, 6 aa, synthetic construct
  REGION 1..6: note = Synthetic Construct
EKTSDK

SEQ ID NO: 12019 - protein, 6 aa, synthetic construct
  REGION 1..6: note = Synthetic Construct
EKTSEK

SEQ ID NO: 12020 - protein, 6 aa, synthetic construct
  REGION 1..6: note = Synthetic Construct
EKTSFK

SEQ ID NO: 12021 - protein, 6 aa, synthetic construct
  REGION 1..6: note = Synthetic Construct
EKTSGK

SEQ ID NO: 12022 - protein, 6 aa, synthetic construct
  REGION 1..6: note = Synthetic Construct
EKTSHK

SEQ ID NO: 12023 - protein, 6 aa, synthetic construct
  REGION 1..6: note = Synthetic Construct
EKTSIK

SEQ ID NO: 12024 - protein, 6 aa, synthetic construct
  REGION 1..6: note = Synthetic Construct
EKTSLK

SEQ ID NO: 12025 - protein, 6 aa, synthetic construct
  REGION 1..6: note = Synthetic Construct
EKTSNK

SEQ ID NO: 12026 - protein, 6 aa, synthetic construct
  REGION 1..6: note = Synthetic Construct
EKTSQK

SEQ ID NO: 12027 - protein, 6 aa, synthetic construct
  REGION 1..6: note = Synthetic Construct
EKTSRK

SEQ ID NO: 12028 - protein, 6 aa, synthetic construct
  REGION 1..6: note = Synthetic Construct
EKTSSK

SEQ ID NO: 12029 - protein, 6 aa, synthetic construct
  REGION 1..6: note = Synthetic Construct
EKTSTK

SEQ ID NO: 12030 - protein, 6 aa, synthetic construct
  REGION 1..6: note = Synthetic Construct
EKTSYK

SEQ ID NO: 12031 - protein, 6 aa, synthetic construct
  REGION 1..6: note = Synthetic Construct
EKTTAK

SEQ ID NO: 12032 - protein, 6 aa, synthetic construct
  REGION 1..6: note = Synthetic Construct
EKTTDK

SEQ ID NO: 12033 - protein, 6 aa, synthetic construct
  REGION 1..6: note = Synthetic Construct
EKTTEK

SEQ ID NO: 12034 - protein, 6 aa, synthetic construct
  REGION 1..6: note = Synthetic Construct
EKTTFK

SEQ ID NO: 12035 - protein, 6 aa, synthetic construct
  REGION 1..6: note = Synthetic Construct
EKTTGK

SEQ ID NO: 12036 - protein, 6 aa, synthetic construct
  REGION 1..6: note = Synthetic Construct
EKTTHK

SEQ ID NO: 12037 - protein, 6 aa, synthetic construct
  REGION 1..6: note = Synthetic Construct
EKTTIK

SEQ ID NO: 12038 - protein, 6 aa, synthetic construct
  REGION 1..6: note = Synthetic Construct
EKTTLK

SEQ ID NO: 12039 - protein, 6 aa, synthetic construct
  REGION 1..6: note = Synthetic Construct
EKTTNK

SEQ ID NO: 12040 - protein, 6 aa, synthetic construct
  REGION 1..6: note = Synthetic Construct
EKTTQK

SEQ ID NO: 12041 - protein, 6 aa, synthetic construct
  REGION 1..6: note = Synthetic Construct
EKTTRK

SEQ ID NO: 12042 - protein, 6 aa, synthetic construct
  REGION 1..6: note = Synthetic Construct
EKTTSK

SEQ ID NO: 12043 - protein, 6 aa, synthetic construct
  REGION 1..6: note = Synthetic Construct
EKTTTK

SEQ ID NO: 12044 - protein, 6 aa, synthetic construct
  REGION 1..6: note = Synthetic Construct
EKTTYK

SEQ ID NO: 12045 - protein, 6 aa, synthetic construct
  REGION 1..6: note = Synthetic Construct
EKTYAK

SEQ ID NO: 12046 - protein, 6 aa, synthetic construct
  REGION 1..6: note = Synthetic Construct
EKTYDK

SEQ ID NO: 12047 - protein, 6 aa, synthetic construct
  REGION 1..6: note = Synthetic Construct
EKTYEK

SEQ ID NO: 12048 - protein, 6 aa, synthetic construct
  REGION 1..6: note = Synthetic Construct
EKTYFK

SEQ ID NO: 12049 - protein, 6 aa, synthetic construct
  REGION 1..6: note = Synthetic Construct
EKTYGK

SEQ ID NO: 12050 - protein, 6 aa, synthetic construct
  REGION 1..6: note = Synthetic Construct
EKTYHK

SEQ ID NO: 12051 - protein, 6 aa, synthetic construct
  REGION 1..6: note = Synthetic Construct
EKTYIK

SEQ ID NO: 12052 - protein, 6 aa, synthetic construct
  REGION 1..6: note = Synthetic Construct
EKTYLK

SEQ ID NO: 12053 - protein, 6 aa, synthetic construct
  REGION 1..6: note = Synthetic Construct
EKTYNK

SEQ ID NO: 12054 - protein, 6 aa, synthetic construct
  REGION 1..6: note = Synthetic Construct
EKTYQK

SEQ ID NO: 12055 - protein, 6 aa, synthetic construct
  REGION 1..6: note = Synthetic Construct
EKTYRK

SEQ ID NO: 12056 - protein, 6 aa, synthetic construct
  REGION 1..6: note = Synthetic Construct
EKTYSK

SEQ ID NO: 12057 - protein, 6 aa, synthetic construct
  REGION 1..6: note = Synthetic Construct
EKTYTK

SEQ ID NO: 12058 - protein, 6 aa, synthetic construct
  REGION 1..6: note = Synthetic Construct
EKTYYK

SEQ ID NO: 12059 - protein, 6 aa, synthetic construct
  REGION 1..6: note = Synthetic Construct
EKYAAK

SEQ ID NO: 12060 - protein, 6 aa, synthetic construct
  REGION 1..6: note = Synthetic Construct
EKYADK

SEQ ID NO: 12061 - protein, 6 aa, synthetic construct
  REGION 1..6: note = Synthetic Construct
EKYAEK

SEQ ID NO: 12062 - protein, 6 aa, synthetic construct
  REGION 1..6: note = Synthetic Construct
EKYAFK

SEQ ID NO: 12063 - protein, 6 aa, synthetic construct
  REGION 1..6: note = Synthetic Construct
EKYAGK

SEQ ID NO: 12064 - protein, 6 aa, synthetic construct
  REGION 1..6: note = Synthetic Construct
EKYAHK

SEQ ID NO: 12065 - protein, 6 aa, synthetic construct
  REGION 1..6: note = Synthetic Construct
EKYAIK

SEQ ID NO: 12066 - protein, 6 aa, synthetic construct
  REGION 1..6: note = Synthetic Construct
EKYALK

SEQ ID NO: 12067 - protein, 6 aa, synthetic construct
  REGION 1..6: note = Synthetic Construct
EKYANK

SEQ ID NO: 12068 - protein, 6 aa, synthetic construct
  REGION 1..6: note = Synthetic Construct
EKYAQK

SEQ ID NO: 12069 - protein, 6 aa, synthetic construct
  REGION 1..6: note = Synthetic Construct
EKYARK

SEQ ID NO: 12070 - protein, 6 aa, synthetic construct
  REGION 1..6: note = Synthetic Construct
EKYASK

SEQ ID NO: 12071 - protein, 6 aa, synthetic construct
  REGION 1..6: note = Synthetic Construct
EKYATK

SEQ ID NO: 12072 - protein, 6 aa, synthetic construct
  REGION 1..6: note = Synthetic Construct
EKYAYK

SEQ ID NO: 12073 - protein, 6 aa, synthetic construct
  REGION 1..6: note = Synthetic Construct
EKYDAK

SEQ ID NO: 12074 - protein, 6 aa, synthetic construct
  REGION 1..6: note = Synthetic Construct
EKYDDK

SEQ ID NO: 12075 - protein, 6 aa, synthetic construct
  REGION 1..6: note = Synthetic Construct
EKYDEK

SEQ ID NO: 12076 - protein, 6 aa, synthetic construct
  REGION 1..6: note = Synthetic Construct
EKYDFK

SEQ ID NO: 12077 - protein, 6 aa, synthetic construct
  REGION 1..6: note = Synthetic Construct
EKYDGK

SEQ ID NO: 12078 - protein, 6 aa, synthetic construct
  REGION 1..6: note = Synthetic Construct
EKYDHK

SEQ ID NO: 12079 - protein, 6 aa, synthetic construct
  REGION 1..6: note = Synthetic Construct
EKYDIK

SEQ ID NO: 12080 - protein, 6 aa, synthetic construct
  REGION 1..6: note = Synthetic Construct
EKYDLK

SEQ ID NO: 12081 - protein, 6 aa, synthetic construct
  REGION 1..6: note = Synthetic Construct
EKYDNK

SEQ ID NO: 12082 - protein, 6 aa, synthetic construct
  REGION 1..6: note = Synthetic Construct
EKYDQK

SEQ ID NO: 12083 - protein, 6 aa, synthetic construct
  REGION 1..6: note = Synthetic Construct
EKYDRK

SEQ ID NO: 12084 - protein, 6 aa, synthetic construct
  REGION 1..6: note = Synthetic Construct
EKYDSK

SEQ ID NO: 12085 - protein, 6 aa, synthetic construct
  REGION 1..6: note = Synthetic Construct
EKYDTK

SEQ ID NO: 12086 - protein, 6 aa, synthetic construct
  REGION 1..6: note = Synthetic Construct
EKYDYK

SEQ ID NO: 12087 - protein, 6 aa, synthetic construct
  REGION 1..6: note = Synthetic Construct
EKYEAK

SEQ ID NO: 12088 - protein, 6 aa, synthetic construct
  REGION 1..6: note = Synthetic Construct
EKYEDK

SEQ ID NO: 12089 - protein, 6 aa, synthetic construct
  REGION 1..6: note = Synthetic Construct
EKYEEK

SEQ ID NO: 12090 - protein, 6 aa, synthetic construct
  REGION 1..6: note = Synthetic Construct
EKYEFK

SEQ ID NO: 12091 - protein, 6 aa, synthetic construct
  REGION 1..6: note = Synthetic Construct
EKYEGK

SEQ ID NO: 12092 - protein, 6 aa, synthetic construct
  REGION 1..6: note = Synthetic Construct
EKYEHK

SEQ ID NO: 12093 - protein, 6 aa, synthetic construct
  REGION 1..6: note = Synthetic Construct
EKYEIK

SEQ ID NO: 12094 - protein, 6 aa, synthetic construct
  REGION 1..6: note = Synthetic Construct
EKYELK

SEQ ID NO: 12095 - protein, 6 aa, synthetic construct
  REGION 1..6: note = Synthetic Construct
EKYENK

SEQ ID NO: 12096 - protein, 6 aa, synthetic construct
  REGION 1..6: note = Synthetic Construct
EKYEQK

SEQ ID NO: 12097 - protein, 6 aa, synthetic construct
  REGION 1..6: note = Synthetic Construct
EKYERK

SEQ ID NO: 12098 - protein, 6 aa, synthetic construct
  REGION 1..6: note = Synthetic Construct
EKYESK

SEQ ID NO: 12099 - protein, 6 aa, synthetic construct
  REGION 1..6: note = Synthetic Construct
EKYETK

SEQ ID NO: 12100 - protein, 6 aa, synthetic construct
  REGION 1..6: note = Synthetic Construct
EKYEYK

SEQ ID NO: 12101 - protein, 6 aa, synthetic construct
  REGION 1..6: note = Synthetic Construct
EKYFAK

SEQ ID NO: 12102 - protein, 6 aa, synthetic construct
  REGION 1..6: note = Synthetic Construct
EKYFDK

SEQ ID NO: 12103 - protein, 6 aa, synthetic construct
  REGION 1..6: note = Synthetic Construct
EKYFEK

SEQ ID NO: 12104 - protein, 6 aa, synthetic construct
  REGION 1..6: note = Synthetic Construct
EKYFFK

SEQ ID NO: 12105 - protein, 6 aa, synthetic construct
  REGION 1..6: note = Synthetic Construct
EKYFGK

SEQ ID NO: 12106 - protein, 6 aa, synthetic construct
  REGION 1..6: note = Synthetic Construct
EKYFHK

SEQ ID NO: 12107 - protein, 6 aa, synthetic construct
  REGION 1..6: note = Synthetic Construct
EKYFIK

SEQ ID NO: 12108 - protein, 6 aa, synthetic construct
  REGION 1..6: note = Synthetic Construct
EKYFLK

SEQ ID NO: 12109 - protein, 6 aa, synthetic construct
  REGION 1..6: note = Synthetic Construct
EKYFNK

SEQ ID NO: 12110 - protein, 6 aa, synthetic construct
  REGION 1..6: note = Synthetic Construct
EKYFQK

SEQ ID NO: 12111 - protein, 6 aa, synthetic construct
  REGION 1..6: note = Synthetic Construct
EKYFRK

SEQ ID NO: 12112 - protein, 6 aa, synthetic construct
  REGION 1..6: note = Synthetic Construct
EKYFSK

SEQ ID NO: 12113 - protein, 6 aa, synthetic construct
  REGION 1..6: note = Synthetic Construct
EKYFTK

SEQ ID NO: 12114 - protein, 6 aa, synthetic construct
  REGION 1..6: note = Synthetic Construct
EKYFYK

SEQ ID NO: 12115 - protein, 6 aa, synthetic construct
  REGION 1..6: note = Synthetic Construct
EKYGAK

SEQ ID NO: 12116 - protein, 6 aa, synthetic construct
  REGION 1..6: note = Synthetic Construct
EKYGDK

SEQ ID NO: 12117 - protein, 6 aa, synthetic construct
  REGION 1..6: note = Synthetic Construct
EKYGEK

SEQ ID NO: 12118 - protein, 6 aa, synthetic construct
  REGION 1..6: note = Synthetic Construct
EKYGFK

SEQ ID NO: 12119 - protein, 6 aa, synthetic construct
  REGION 1..6: note = Synthetic Construct
EKYGGK

SEQ ID NO: 12120 - protein, 6 aa, synthetic construct
  REGION 1..6: note = Synthetic Construct
EKYGHK

SEQ ID NO: 12121 - protein, 6 aa, synthetic construct
  REGION 1..6: note = Synthetic Construct
EKYGIK

SEQ ID NO: 12122 - protein, 6 aa, synthetic construct
  REGION 1..6: note = Synthetic Construct
EKYGLK

SEQ ID NO: 12123 - protein, 6 aa, synthetic construct
  REGION 1..6: note = Synthetic Construct
EKYGNK

SEQ ID NO: 12124 - protein, 6 aa, synthetic construct
  REGION 1..6: note = Synthetic Construct
EKYGQK

SEQ ID NO: 12125 - protein, 6 aa, synthetic construct
  REGION 1..6: note = Synthetic Construct
EKYGRK

SEQ ID NO: 12126 - protein, 6 aa, synthetic construct
  REGION 1..6: note = Synthetic Construct
EKYGSK

SEQ ID NO: 12127 - protein, 6 aa, synthetic construct
  REGION 1..6: note = Synthetic Construct
EKYGTK

SEQ ID NO: 12128 - protein, 6 aa, synthetic construct
  REGION 1..6: note = Synthetic Construct
EKYGYK

SEQ ID NO: 12129 - protein, 6 aa, synthetic construct
  REGION 1..6: note = Synthetic Construct
EKYHAK

SEQ ID NO: 12130 - protein, 6 aa, synthetic construct
  REGION 1..6: note = Synthetic Construct
EKYHDK

SEQ ID NO: 12131 - protein, 6 aa, synthetic construct
  REGION 1..6: note = Synthetic Construct
EKYHEK

SEQ ID NO: 12132 - protein, 6 aa, synthetic construct
  REGION 1..6: note = Synthetic Construct
EKYHFK

SEQ ID NO: 12133 - protein, 6 aa, synthetic construct
  REGION 1..6: note = Synthetic Construct
EKYHGK

SEQ ID NO: 12134 - protein, 6 aa, synthetic construct
  REGION 1..6: note = Synthetic Construct
EKYHHK

SEQ ID NO: 12135 - protein, 6 aa, synthetic construct
  REGION 1..6: note = Synthetic Construct
EKYHIK

SEQ ID NO: 12136 - protein, 6 aa, synthetic construct
  REGION 1..6: note = Synthetic Construct
EKYHLK

SEQ ID NO: 12137 - protein, 6 aa, synthetic construct
  REGION 1..6: note = Synthetic Construct
EKYHNK

SEQ ID NO: 12138 - protein, 6 aa, synthetic construct
  REGION 1..6: note = Synthetic Construct
EKYHQK

SEQ ID NO: 12139 - protein, 6 aa, synthetic construct
  REGION 1..6: note = Synthetic Construct
EKYHRK

SEQ ID NO: 12140 - protein, 6 aa, synthetic construct
  REGION 1..6: note = Synthetic Construct
EKYHSK

SEQ ID NO: 12141 - protein, 6 aa, synthetic construct
  REGION 1..6: note = Synthetic Construct
EKYHTK

SEQ ID NO: 12142 - protein, 6 aa, synthetic construct
  REGION 1..6: note = Synthetic Construct
EKYHYK

SEQ ID NO: 12143 - protein, 6 aa, synthetic construct
  REGION 1..6: note = Synthetic Construct
EKYIAK

SEQ ID NO: 12144 - protein, 6 aa, synthetic construct
  REGION 1..6: note = Synthetic Construct
EKYIDK

SEQ ID NO: 12145 - protein, 6 aa, synthetic construct
  REGION 1..6: note = Synthetic Construct
EKYIEK

SEQ ID NO: 12146 - protein, 6 aa, synthetic construct
  REGION 1..6: note = Synthetic Construct
EKYIFK

SEQ ID NO: 12147 - protein, 6 aa, synthetic construct
  REGION 1..6: note = Synthetic Construct
EKYIGK

SEQ ID NO: 12148 - protein, 6 aa, synthetic construct
  REGION 1..6: note = Synthetic Construct
EKYIHK

SEQ ID NO: 12149 - protein, 6 aa, synthetic construct
  REGION 1..6: note = Synthetic Construct
EKYIIK

SEQ ID NO: 12150 - protein, 6 aa, synthetic construct
  REGION 1..6: note = Synthetic Construct
EKYILK

SEQ ID NO: 12151 - protein, 6 aa, synthetic construct
  REGION 1..6: note = Synthetic Construct
EKYINK

SEQ ID NO: 12152 - protein, 6 aa, synthetic construct
  REGION 1..6: note = Synthetic Construct
EKYIQK

SEQ ID NO: 12153 - protein, 6 aa, synthetic construct
  REGION 1..6: note = Synthetic Construct
EKYIRK

SEQ ID NO: 12154 - protein, 6 aa, synthetic construct
  REGION 1..6: note = Synthetic Construct
EKYISK

SEQ ID NO: 12155 - protein, 6 aa, synthetic construct
  REGION 1..6: note = Synthetic Construct
EKYITK

SEQ ID NO: 12156 - protein, 6 aa, synthetic construct
  REGION 1..6: note = Synthetic Construct
EKYIYK

SEQ ID NO: 12157 - protein, 6 aa, synthetic construct
  REGION 1..6: note = Synthetic Construct
EKYLAK

SEQ ID NO: 12158 - protein, 6 aa, synthetic construct
  REGION 1..6: note = Synthetic Construct
EKYLDK

SEQ ID NO: 12159 - protein, 6 aa, synthetic construct
  REGION 1..6: note = Synthetic Construct
EKYLEK

SEQ ID NO: 12160 - protein, 6 aa, synthetic construct
  REGION 1..6: note = Synthetic Construct
EKYLFK

SEQ ID NO: 12161 - protein, 6 aa, synthetic construct
  REGION 1..6: note = Synthetic Construct
EKYLGK

SEQ ID NO: 12162 - protein, 6 aa, synthetic construct
  REGION 1..6: note = Synthetic Construct
EKYLHK

SEQ ID NO: 12163 - protein, 6 aa, synthetic construct
  REGION 1..6: note = Synthetic Construct
EKYLIK

SEQ ID NO: 12164 - protein, 6 aa, synthetic construct
  REGION 1..6: note = Synthetic Construct
EKYLLK

SEQ ID NO: 12165 - protein, 6 aa, synthetic construct
  REGION 1..6: note = Synthetic Construct
EKYLNK

SEQ ID NO: 12166 - protein, 6 aa, synthetic construct
  REGION 1..6: note = Synthetic Construct
EKYLQK

SEQ ID NO: 12167 - protein, 6 aa, synthetic construct
  REGION 1..6: note = Synthetic Construct
EKYLRK

SEQ ID NO: 12168 - protein, 6 aa, synthetic construct
  REGION 1..6: note = Synthetic Construct
EKYLSK

SEQ ID NO: 12169 - protein, 6 aa, synthetic construct
  REGION 1..6: note = Synthetic Construct
EKYLTK

SEQ ID NO: 12170 - protein, 6 aa, synthetic construct
  REGION 1..6: note = Synthetic Construct
EKYLYK

SEQ ID NO: 12171 - protein, 6 aa, synthetic construct
  REGION 1..6: note = Synthetic Construct
EKYNAK

SEQ ID NO: 12172 - protein, 6 aa, synthetic construct
  REGION 1..6: note = Synthetic Construct
EKYNDK

SEQ ID NO: 12173 - protein, 6 aa, synthetic construct
  REGION 1..6: note = Synthetic Construct
EKYNEK

SEQ ID NO: 12174 - protein, 6 aa, synthetic construct
  REGION 1..6: note = Synthetic Construct
EKYNFK

SEQ ID NO: 12175 - protein, 6 aa, synthetic construct
  REGION 1..6: note = Synthetic Construct
EKYNGK

SEQ ID NO: 12176 - protein, 6 aa, synthetic construct
  REGION 1..6: note = Synthetic Construct
EKYNHK

SEQ ID NO: 12177 - protein, 6 aa, synthetic construct
  REGION 1..6: note = Synthetic Construct
EKYNIK

SEQ ID NO: 12178 - protein, 6 aa, synthetic construct
  REGION 1..6: note = Synthetic Construct
EKYNLK

SEQ ID NO: 12179 - protein, 6 aa, synthetic construct
  REGION 1..6: note = Synthetic Construct
EKYNNK

SEQ ID NO: 12180 - protein, 6 aa, synthetic construct
  REGION 1..6: note = Synthetic Construct
EKYNQK

SEQ ID NO: 12181 - protein, 6 aa, synthetic construct
  REGION 1..6: note = Synthetic Construct
EKYNRK

SEQ ID NO: 12182 - protein, 6 aa, synthetic construct
  REGION 1..6: note = Synthetic Construct
EKYNSK

SEQ ID NO: 12183 - protein, 6 aa, synthetic construct
  REGION 1..6: note = Synthetic Construct
EKYNTK

SEQ ID NO: 12184 - protein, 6 aa, synthetic construct
  REGION 1..6: note = Synthetic Construct
EKYNYK

SEQ ID NO: 12185 - protein, 6 aa, synthetic construct
  REGION 1..6: note = Synthetic Construct
EKYQAK

SEQ ID NO: 12186 - protein, 6 aa, synthetic construct
  REGION 1..6: note = Synthetic Construct
EKYQDK

SEQ ID NO: 12187 - protein, 6 aa, synthetic construct
  REGION 1..6: note = Synthetic Construct
EKYQEK

SEQ ID NO: 12188 - protein, 6 aa, synthetic construct
  REGION 1..6: note = Synthetic Construct
EKYQFK

SEQ ID NO: 12189 - protein, 6 aa, synthetic construct
  REGION 1..6: note = Synthetic Construct
EKYQGK

SEQ ID NO: 12190 - protein, 6 aa, synthetic construct
  REGION 1..6: note = Synthetic Construct
EKYQHK

SEQ ID NO: 12191 - protein, 6 aa, synthetic construct
  REGION 1..6: note = Synthetic Construct
EKYQIK

SEQ ID NO: 12192 - protein, 6 aa, synthetic construct
  REGION 1..6: note = Synthetic Construct
EKYQLK

SEQ ID NO: 12193 - protein, 6 aa, synthetic construct
  REGION 1..6: note = Synthetic Construct
EKYQNK

SEQ ID NO: 12194 - protein, 6 aa, synthetic construct
  REGION 1..6: note = Synthetic Construct
EKYQQK

SEQ ID NO: 12195 - protein, 6 aa, synthetic construct
  REGION 1..6: note = Synthetic Construct
EKYQRK

SEQ ID NO: 12196 - protein, 6 aa, synthetic construct
  REGION 1..6: note = Synthetic Construct
EKYQSK

SEQ ID NO: 12197 - protein, 6 aa, synthetic construct
  REGION 1..6: note = Synthetic Construct
EKYQTK

SEQ ID NO: 12198 - protein, 6 aa, synthetic construct
  REGION 1..6: note = Synthetic Construct
EKYQYK

SEQ ID NO: 12199 - protein, 6 aa, synthetic construct
  REGION 1..6: note = Synthetic Construct
EKYRAK

SEQ ID NO: 12200 - protein, 6 aa, synthetic construct
  REGION 1..6: note = Synthetic Construct
EKYRDK

SEQ ID NO: 12201 - protein, 6 aa, synthetic construct
  REGION 1..6: note = Synthetic Construct
EKYREK

SEQ ID NO: 12202 - protein, 6 aa, synthetic construct
  REGION 1..6: note = Synthetic Construct
EKYRFK

SEQ ID NO: 12203 - protein, 6 aa, synthetic construct
  REGION 1..6: note = Synthetic Construct
EKYRGK

SEQ ID NO: 12204 - protein, 6 aa, synthetic construct
  REGION 1..6: note = Synthetic Construct
EKYRHK

SEQ ID NO: 12205 - protein, 6 aa, synthetic construct
  REGION 1..6: note = Synthetic Construct
EKYRIK

SEQ ID NO: 12206 - protein, 6 aa, synthetic construct
  REGION 1..6: note = Synthetic Construct
EKYRLK

SEQ ID NO: 12207 - protein, 6 aa, synthetic construct
  REGION 1..6: note = Synthetic Construct
EKYRNK

SEQ ID NO: 12208 - protein, 6 aa, synthetic construct
  REGION 1..6: note = Synthetic Construct
EKYRQK

SEQ ID NO: 12209 - protein, 6 aa, synthetic construct
  REGION 1..6: note = Synthetic Construct
EKYRRK

SEQ ID NO: 12210 - protein, 6 aa, synthetic construct
  REGION 1..6: note = Synthetic Construct
EKYRSK

SEQ ID NO: 12211 - protein, 6 aa, synthetic construct
  REGION 1..6: note = Synthetic Construct
EKYRTK

SEQ ID NO: 12212 - protein, 6 aa, synthetic construct
  REGION 1..6: note = Synthetic Construct
EKYRYK

SEQ ID NO: 12213 - protein, 6 aa, synthetic construct
  REGION 1..6: note = Synthetic Construct
EKYSAK

SEQ ID NO: 12214 - protein, 6 aa, synthetic construct
  REGION 1..6: note = Synthetic Construct
EKYSDK

SEQ ID NO: 12215 - protein, 6 aa, synthetic construct
  REGION 1..6: note = Synthetic Construct
EKYSEK

SEQ ID NO: 12216 - protein, 6 aa, synthetic construct
  REGION 1..6: note = Synthetic Construct
EKYSFK

SEQ ID NO: 12217 - protein, 6 aa, synthetic construct
  REGION 1..6: note = Synthetic Construct
EKYSGK

SEQ ID NO: 12218 - protein, 6 aa, synthetic construct
  REGION 1..6: note = Synthetic Construct
EKYSHK

SEQ ID NO: 12219 - protein, 6 aa, synthetic construct
  REGION 1..6: note = Synthetic Construct
EKYSIK

SEQ ID NO: 12220 - protein, 6 aa, synthetic construct
  REGION 1..6: note = Synthetic Construct
EKYSLK

SEQ ID NO: 12221 - protein, 6 aa, synthetic construct
  REGION 1..6: note = Synthetic Construct
EKYSNK

SEQ ID NO: 12222 - protein, 6 aa, synthetic construct
  REGION 1..6: note = Synthetic Construct
EKYSQK

SEQ ID NO: 12223 - protein, 6 aa, synthetic construct
  REGION 1..6: note = Synthetic Construct
EKYSRK

SEQ ID NO: 12224 - protein, 6 aa, synthetic construct
  REGION 1..6: note = Synthetic Construct
EKYSSK

SEQ ID NO: 12225 - protein, 6 aa, synthetic construct
  REGION 1..6: note = Synthetic Construct
EKYSTK

SEQ ID NO: 12226 - protein, 6 aa, synthetic construct
  REGION 1..6: note = Synthetic Construct
EKYSYK

SEQ ID NO: 12227 - protein, 6 aa, synthetic construct
  REGION 1..6: note = Synthetic Construct
EKYTAK

SEQ ID NO: 12228 - protein, 6 aa, synthetic construct
  REGION 1..6: note = Synthetic Construct
EKYTDK

SEQ ID NO: 12229 - protein, 6 aa, synthetic construct
  REGION 1..6: note = Synthetic Construct
EKYTEK

SEQ ID NO: 12230 - protein, 6 aa, synthetic construct
  REGION 1..6: note = Synthetic Construct
EKYTFK

SEQ ID NO: 12231 - protein, 6 aa, synthetic construct
  REGION 1..6: note = Synthetic Construct
EKYTGK

SEQ ID NO: 12232 - protein, 6 aa, synthetic construct
  REGION 1..6: note = Synthetic Construct
EKYTHK

SEQ ID NO: 12233 - protein, 6 aa, synthetic construct
  REGION 1..6: note = Synthetic Construct
EKYTIK

SEQ ID NO: 12234 - protein, 6 aa, synthetic construct
  REGION 1..6: note = Synthetic Construct
EKYTLK

SEQ ID NO: 12235 - protein, 6 aa, synthetic construct
  REGION 1..6: note = Synthetic Construct
EKYTNK

SEQ ID NO: 12236 - protein, 6 aa, synthetic construct
  REGION 1..6: note = Synthetic Construct
EKYTQK

SEQ ID NO: 12237 - protein, 6 aa, synthetic construct
  REGION 1..6: note = Synthetic Construct
EKYTRK

SEQ ID NO: 12238 - protein, 6 aa, synthetic construct
  REGION 1..6: note = Synthetic Construct
EKYTSK

SEQ ID NO: 12239 - protein, 6 aa, synthetic construct
  REGION 1..6: note = Synthetic Construct
EKYTTK

SEQ ID NO: 12240 - protein, 6 aa, synthetic construct
  REGION 1..6: note = Synthetic Construct
EKYTYK

SEQ ID NO: 12241 - protein, 6 aa, synthetic construct
  REGION 1..6: note = Synthetic Construct
EKYYAK

SEQ ID NO: 12242 - protein, 6 aa, synthetic construct
  REGION 1..6: note = Synthetic Construct
EKYYDK

SEQ ID NO: 12243 - protein, 6 aa, synthetic construct
  REGION 1..6: note = Synthetic Construct
EKYYEK

SEQ ID NO: 12244 - protein, 6 aa, synthetic construct
  REGION 1..6: note = Synthetic Construct
EKYYFK

SEQ ID NO: 12245 - protein, 6 aa, synthetic construct
  REGION 1..6: note = Synthetic Construct
EKYYGK

SEQ ID NO: 12246 - protein, 6 aa, synthetic construct
  REGION 1..6: note = Synthetic Construct
EKYYHK

SEQ ID NO: 12247 - protein, 6 aa, synthetic construct
  REGION 1..6: note = Synthetic Construct
EKYYIK

SEQ ID NO: 12248 - protein, 6 aa, synthetic construct
  REGION 1..6: note = Synthetic Construct
EKYYLK

SEQ ID NO: 12249 - protein, 6 aa, synthetic construct
  REGION 1..6: note = Synthetic Construct
EKYYNK

SEQ ID NO: 12250 - protein, 6 aa, synthetic construct
  REGION 1..6: note = Synthetic Construct
EKYYQK

SEQ ID NO: 12251 - protein, 6 aa, synthetic construct
  REGION 1..6: note = Synthetic Construct
EKYYRK

SEQ ID NO: 12252 - protein, 6 aa, synthetic construct
  REGION 1..6: note = Synthetic Construct
EKYYSK

SEQ ID NO: 12253 - protein, 6 aa, synthetic construct
  REGION 1..6: note = Synthetic Construct
EKYYTK

SEQ ID NO: 12254 - protein, 6 aa, synthetic construct
  REGION 1..6: note = Synthetic Construct
EKYYYK

SEQ ID NO: 12255 - protein, 6 aa, synthetic construct
  REGION 1..6: note = Synthetic Construct
GKAAAK

SEQ ID NO: 12256 - protein, 6 aa, synthetic construct
  REGION 1..6: note = Synthetic Construct
GKAADK

SEQ ID NO: 12257 - protein, 6 aa, synthetic construct
  REGION 1..6: note = Synthetic Construct
GKAAEK

SEQ ID NO: 12258 - protein, 6 aa, synthetic construct
  REGION 1..6: note = Synthetic Construct
GKAAFK

SEQ ID NO: 12259 - protein, 6 aa, synthetic construct
  REGION 1..6: note = Synthetic Construct
GKAAGK

SEQ ID NO: 12260 - protein, 6 aa, synthetic construct
  REGION 1..6: note = Synthetic Construct
GKAAHK

SEQ ID NO: 12261 - protein, 6 aa, synthetic construct
  REGION 1..6: note = Synthetic Construct
GKAAIK

SEQ ID NO: 12262 - protein, 6 aa, synthetic construct
  REGION 1..6: note = Synthetic Construct
GKAALK

SEQ ID NO: 12263 - protein, 6 aa, synthetic construct
  REGION 1..6: note = Synthetic Construct
GKAANK

SEQ ID NO: 12264 - protein, 6 aa, synthetic construct
  REGION 1..6: note = Synthetic Construct
GKAAQK

SEQ ID NO: 12265 - protein, 6 aa, synthetic construct
  REGION 1..6: note = Synthetic Construct
GKAARK

SEQ ID NO: 12266 - protein, 6 aa, synthetic construct
  REGION 1..6: note = Synthetic Construct
GKAASK

SEQ ID NO: 12267 - protein, 6 aa, synthetic construct
  REGION 1..6: note = Synthetic Construct
GKAATK

SEQ ID NO: 12268 - protein, 6 aa, synthetic construct
  REGION 1..6: note = Synthetic Construct
GKAAYK

SEQ ID NO: 12269 - protein, 6 aa, synthetic construct
  REGION 1..6: note = Synthetic Construct
GKADAK

SEQ ID NO: 12270 - protein, 6 aa, synthetic construct
  REGION 1..6: note = Synthetic Construct
GKADDK

SEQ ID NO: 12271 - protein, 6 aa, synthetic construct
  REGION 1..6: note = Synthetic Construct
GKADEK

SEQ ID NO: 12272 - protein, 6 aa, synthetic construct
  REGION 1..6: note = Synthetic Construct
GKADFK

SEQ ID NO: 12273 - protein, 6 aa, synthetic construct
  REGION 1..6: note = Synthetic Construct
GKADGK

SEQ ID NO: 12274 - protein, 6 aa, synthetic construct
  REGION 1..6: note = Synthetic Construct
GKADHK

SEQ ID NO: 12275 - protein, 6 aa, synthetic construct
  REGION 1..6: note = Synthetic Construct
GKADIK

SEQ ID NO: 12276 - protein, 6 aa, synthetic construct
  REGION 1..6: note = Synthetic Construct
GKADLK

SEQ ID NO: 12277 - protein, 6 aa, synthetic construct
  REGION 1..6: note = Synthetic Construct
GKADNK

SEQ ID NO: 12278 - protein, 6 aa, synthetic construct
  REGION 1..6: note = Synthetic Construct
GKADQK

SEQ ID NO: 12279 - protein, 6 aa, synthetic construct
  REGION 1..6: note = Synthetic Construct
GKADRK

SEQ ID NO: 12280 - protein, 6 aa, synthetic construct
  REGION 1..6: note = Synthetic Construct
GKADSK

SEQ ID NO: 12281 - protein, 6 aa, synthetic construct
  REGION 1..6: note = Synthetic Construct
GKADTK

SEQ ID NO: 12282 - protein, 6 aa, synthetic construct
  REGION 1..6: note = Synthetic Construct
GKADYK

SEQ ID NO: 12283 - protein, 6 aa, synthetic construct
  REGION 1..6: note = Synthetic Construct
GKAEAK

SEQ ID NO: 12284 - protein, 6 aa, synthetic construct
  REGION 1..6: note = Synthetic Construct
GKAEDK

SEQ ID NO: 12285 - protein, 6 aa, synthetic construct
  REGION 1..6: note = Synthetic Construct
GKAEEK

SEQ ID NO: 12286 - protein, 6 aa, synthetic construct
  REGION 1..6: note = Synthetic Construct
GKAEFK

SEQ ID NO: 12287 - protein, 6 aa, synthetic construct
  REGION 1..6: note = Synthetic Construct
GKAEGK

SEQ ID NO: 12288 - protein, 6 aa, synthetic construct
  REGION 1..6: note = Synthetic Construct
GKAEHK

SEQ ID NO: 12289 - protein, 6 aa, synthetic construct
  REGION 1..6: note = Synthetic Construct
GKAEIK

SEQ ID NO: 12290 - protein, 6 aa, synthetic construct
  REGION 1..6: note = Synthetic Construct
GKAELK

SEQ ID NO: 12291 - protein, 6 aa, synthetic construct
  REGION 1..6: note = Synthetic Construct
GKAENK

SEQ ID NO: 12292 - protein, 6 aa, synthetic construct
  REGION 1..6: note = Synthetic Construct
GKAEQK

SEQ ID NO: 12293 - protein, 6 aa, synthetic construct
  REGION 1..6: note = Synthetic Construct
GKAERK

SEQ ID NO: 12294 - protein, 6 aa, synthetic construct
  REGION 1..6: note = Synthetic Construct
GKAESK

SEQ ID NO: 12295 - protein, 6 aa, synthetic construct
  REGION 1..6: note = Synthetic Construct
GKAETK

SEQ ID NO: 12296 - protein, 6 aa, synthetic construct
  REGION 1..6: note = Synthetic Construct
GKAEYK

SEQ ID NO: 12297 - protein, 6 aa, synthetic construct
  REGION 1..6: note = Synthetic Construct
GKAFAK

SEQ ID NO: 12298 - protein, 6 aa, synthetic construct
  REGION 1..6: note = Synthetic Construct
GKAFDK

SEQ ID NO: 12299 - protein, 6 aa, synthetic construct
  REGION 1..6: note = Synthetic Construct
GKAFEK

SEQ ID NO: 12300 - protein, 6 aa, synthetic construct
  REGION 1..6: note = Synthetic Construct
GKAFFK

SEQ ID NO: 12301 - protein, 6 aa, synthetic construct
  REGION 1..6: note = Synthetic Construct
GKAFGK

SEQ ID NO: 12302 - protein, 6 aa, synthetic construct
  REGION 1..6: note = Synthetic Construct
GKAFHK

SEQ ID NO: 12303 - protein, 6 aa, synthetic construct
  REGION 1..6: note = Synthetic Construct
GKAFIK

SEQ ID NO: 12304 - protein, 6 aa, synthetic construct
  REGION 1..6: note = Synthetic Construct
GKAFLK

SEQ ID NO: 12305 - protein, 6 aa, synthetic construct
  REGION 1..6: note = Synthetic Construct
GKAFNK

SEQ ID NO: 12306 - protein, 6 aa, synthetic construct
  REGION 1..6: note = Synthetic Construct
GKAFQK

SEQ ID NO: 12307 - protein, 6 aa, synthetic construct
  REGION 1..6: note = Synthetic Construct
GKAFRK

SEQ ID NO: 12308 - protein, 6 aa, synthetic construct
  REGION 1..6: note = Synthetic Construct
GKAFSK

SEQ ID NO: 12309 - protein, 6 aa, synthetic construct
  REGION 1..6: note = Synthetic Construct
GKAFTK

SEQ ID NO: 12310 - protein, 6 aa, synthetic construct
  REGION 1..6: note = Synthetic Construct
GKAFYK

SEQ ID NO: 12311 - protein, 6 aa, synthetic construct
  REGION 1..6: note = Synthetic Construct
GKAGAK

SEQ ID NO: 12312 - protein, 6 aa, synthetic construct
  REGION 1..6: note = Synthetic Construct
GKAGDK

SEQ ID NO: 12313 - protein, 6 aa, synthetic construct
  REGION 1..6: note = Synthetic Construct
GKAGEK

SEQ ID NO: 12314 - protein, 6 aa, synthetic construct
  REGION 1..6: note = Synthetic Construct
GKAGFK

SEQ ID NO: 12315 - protein, 6 aa, synthetic construct
  REGION 1..6: note = Synthetic Construct
GKAGGK

SEQ ID NO: 12316 - protein, 6 aa, synthetic construct
  REGION 1..6: note = Synthetic Construct
GKAGHK

SEQ ID NO: 12317 - protein, 6 aa, synthetic construct
  REGION 1..6: note = Synthetic Construct
GKAGIK

SEQ ID NO: 12318 - protein, 6 aa, synthetic construct
  REGION 1..6: note = Synthetic Construct
GKAGLK

SEQ ID NO: 12319 - protein, 6 aa, synthetic construct
  REGION 1..6: note = Synthetic Construct
GKAGNK

SEQ ID NO: 12320 - protein, 6 aa, synthetic construct
  REGION 1..6: note = Synthetic Construct
GKAGQK

SEQ ID NO: 12321 - protein, 6 aa, synthetic construct
  REGION 1..6: note = Synthetic Construct
GKAGRK

SEQ ID NO: 12322 - protein, 6 aa, synthetic construct
  REGION 1..6: note = Synthetic Construct
GKAGSK

SEQ ID NO: 12323 - protein, 6 aa, synthetic construct
  REGION 1..6: note = Synthetic Construct
GKAGTK

SEQ ID NO: 12324 - protein, 6 aa, synthetic construct
  REGION 1..6: note = Synthetic Construct
GKAGYK

SEQ ID NO: 12325 - protein, 6 aa, synthetic construct
  REGION 1..6: note = Synthetic Construct
GKAHAK

SEQ ID NO: 12326 - protein, 6 aa, synthetic construct
  REGION 1..6: note = Synthetic Construct
GKAHDK

SEQ ID NO: 12327 - protein, 6 aa, synthetic construct
  REGION 1..6: note = Synthetic Construct
GKAHEK

SEQ ID NO: 12328 - protein, 6 aa, synthetic construct
  REGION 1..6: note = Synthetic Construct
GKAHFK

SEQ ID NO: 12329 - protein, 6 aa, synthetic construct
  REGION 1..6: note = Synthetic Construct
GKAHGK

SEQ ID NO: 12330 - protein, 6 aa, synthetic construct
  REGION 1..6: note = Synthetic Construct
GKAHHK

SEQ ID NO: 12331 - protein, 6 aa, synthetic construct
  REGION 1..6: note = Synthetic Construct
GKAHIK

SEQ ID NO: 12332 - protein, 6 aa, synthetic construct
  REGION 1..6: note = Synthetic Construct
GKAHLK

SEQ ID NO: 12333 - protein, 6 aa, synthetic construct
  REGION 1..6: note = Synthetic Construct
GKAHNK

SEQ ID NO: 12334 - protein, 6 aa, synthetic construct
  REGION 1..6: note = Synthetic Construct
GKAHQK

SEQ ID NO: 12335 - protein, 6 aa, synthetic construct
  REGION 1..6: note = Synthetic Construct
GKAHRK

SEQ ID NO: 12336 - protein, 6 aa, synthetic construct
  REGION 1..6: note = Synthetic Construct
GKAHSK

SEQ ID NO: 12337 - protein, 6 aa, synthetic construct
  REGION 1..6: note = Synthetic Construct
GKAHTK

SEQ ID NO: 12338 - protein, 6 aa, synthetic construct
  REGION 1..6: note = Synthetic Construct
GKAHYK

SEQ ID NO: 12339 - protein, 6 aa, synthetic construct
  REGION 1..6: note = Synthetic Construct
GKAIAK

SEQ ID NO: 12340 - protein, 6 aa, synthetic construct
  REGION 1..6: note = Synthetic Construct
GKAIDK

SEQ ID NO: 12341 - protein, 6 aa, synthetic construct
  REGION 1..6: note = Synthetic Construct
GKAIEK

SEQ ID NO: 12342 - protein, 6 aa, synthetic construct
  REGION 1..6: note = Synthetic Construct
GKAIFK

SEQ ID NO: 12343 - protein, 6 aa, synthetic construct
  REGION 1..6: note = Synthetic Construct
GKAIGK

SEQ ID NO: 12344 - protein, 6 aa, synthetic construct
  REGION 1..6: note = Synthetic Construct
GKAIHK

SEQ ID NO: 12345 - protein, 6 aa, synthetic construct
  REGION 1..6: note = Synthetic Construct
GKAIIK

SEQ ID NO: 12346 - protein, 6 aa, synthetic construct
  REGION 1..6: note = Synthetic Construct
GKAILK

SEQ ID NO: 12347 - protein, 6 aa, synthetic construct
  REGION 1..6: note = Synthetic Construct
GKAINK

SEQ ID NO: 12348 - protein, 6 aa, synthetic construct
  REGION 1..6: note = Synthetic Construct
GKAIQK

SEQ ID NO: 12349 - protein, 6 aa, synthetic construct
  REGION 1..6: note = Synthetic Construct
GKAIRK

SEQ ID NO: 12350 - protein, 6 aa, synthetic construct
  REGION 1..6: note = Synthetic Construct
GKAISK

SEQ ID NO: 12351 - protein, 6 aa, synthetic construct
  REGION 1..6: note = Synthetic Construct
GKAITK

SEQ ID NO: 12352 - protein, 6 aa, synthetic construct
  REGION 1..6: note = Synthetic Construct
GKAIYK

SEQ ID NO: 12353 - protein, 6 aa, synthetic construct
  REGION 1..6: note = Synthetic Construct
GKALAK

SEQ ID NO: 12354 - protein, 6 aa, synthetic construct
  REGION 1..6: note = Synthetic Construct
GKALDK

SEQ ID NO: 12355 - protein, 6 aa, synthetic construct
  REGION 1..6: note = Synthetic Construct
GKALEK

SEQ ID NO: 12356 - protein, 6 aa, synthetic construct
  REGION 1..6: note = Synthetic Construct
GKALFK

SEQ ID NO: 12357 - protein, 6 aa, synthetic construct
  REGION 1..6: note = Synthetic Construct
GKALGK

SEQ ID NO: 12358 - protein, 6 aa, synthetic construct
  REGION 1..6: note = Synthetic Construct
GKALHK

SEQ ID NO: 12359 - protein, 6 aa, synthetic construct
  REGION 1..6: note = Synthetic Construct
GKALIK

SEQ ID NO: 12360 - protein, 6 aa, synthetic construct
  REGION 1..6: note = Synthetic Construct
GKALLK

SEQ ID NO: 12361 - protein, 6 aa, synthetic construct
  REGION 1..6: note = Synthetic Construct
GKALNK

SEQ ID NO: 12362 - protein, 6 aa, synthetic construct
  REGION 1..6: note = Synthetic Construct
GKALQK

SEQ ID NO: 12363 - protein, 6 aa, synthetic construct
  REGION 1..6: note = Synthetic Construct
GKALRK

SEQ ID NO: 12364 - protein, 6 aa, synthetic construct
  REGION 1..6: note = Synthetic Construct
GKALSK

SEQ ID NO: 12365 - protein, 6 aa, synthetic construct
  REGION 1..6: note = Synthetic Construct
GKALTK

SEQ ID NO: 12366 - protein, 6 aa, synthetic construct
  REGION 1..6: note = Synthetic Construct
GKALYK

SEQ ID NO: 12367 - protein, 6 aa, synthetic construct
  REGION 1..6: note = Synthetic Construct
GKANAK

SEQ ID NO: 12368 - protein, 6 aa, synthetic construct
  REGION 1..6: note = Synthetic Construct
GKANDK

SEQ ID NO: 12369 - protein, 6 aa, synthetic construct
  REGION 1..6: note = Synthetic Construct
GKANEK

SEQ ID NO: 12370 - protein, 6 aa, synthetic construct
  REGION 1..6: note = Synthetic Construct
GKANFK

SEQ ID NO: 12371 - protein, 6 aa, synthetic construct
  REGION 1..6: note = Synthetic Construct
GKANGK

SEQ ID NO: 12372 - protein, 6 aa, synthetic construct
  REGION 1..6: note = Synthetic Construct
GKANHK

SEQ ID NO: 12373 - protein, 6 aa, synthetic construct
  REGION 1..6: note = Synthetic Construct
GKANIK

SEQ ID NO: 12374 - protein, 6 aa, synthetic construct
  REGION 1..6: note = Synthetic Construct
GKANLK

SEQ ID NO: 12375 - protein, 6 aa, synthetic construct
  REGION 1..6: note = Synthetic Construct
GKANNK

SEQ ID NO: 12376 - protein, 6 aa, synthetic construct
  REGION 1..6: note = Synthetic Construct
GKANQK

SEQ ID NO: 12377 - protein, 6 aa, synthetic construct
  REGION 1..6: note = Synthetic Construct
GKANRK

SEQ ID NO: 12378 - protein, 6 aa, synthetic construct
  REGION 1..6: note = Synthetic Construct
GKANSK

SEQ ID NO: 12379 - protein, 6 aa, synthetic construct
  REGION 1..6: note = Synthetic Construct
GKANTK

SEQ ID NO: 12380 - protein, 6 aa, synthetic construct
  REGION 1..6: note = Synthetic Construct
GKANYK

SEQ ID NO: 12381 - protein, 6 aa, synthetic construct
  REGION 1..6: note = Synthetic Construct
GKAQAK

SEQ ID NO: 12382 - protein, 6 aa, synthetic construct
  REGION 1..6: note = Synthetic Construct
GKAQDK

SEQ ID NO: 12383 - protein, 6 aa, synthetic construct
  REGION 1..6: note = Synthetic Construct
GKAQEK

SEQ ID NO: 12384 - protein, 6 aa, synthetic construct
  REGION 1..6: note = Synthetic Construct
GKAQFK

SEQ ID NO: 12385 - protein, 6 aa, synthetic construct
  REGION 1..6: note = Synthetic Construct
GKAQGK

SEQ ID NO: 12386 - protein, 6 aa, synthetic construct
  REGION 1..6: note = Synthetic Construct
GKAQHK

SEQ ID NO: 12387 - protein, 6 aa, synthetic construct
  REGION 1..6: note = Synthetic Construct
GKAQIK

SEQ ID NO: 12388 - protein, 6 aa, synthetic construct
  REGION 1..6: note = Synthetic Construct
GKAQLK

SEQ ID NO: 12389 - protein, 6 aa, synthetic construct
  REGION 1..6: note = Synthetic Construct
GKAQNK

SEQ ID NO: 12390 - protein, 6 aa, synthetic construct
  REGION 1..6: note = Synthetic Construct
GKAQQK

SEQ ID NO: 12391 - protein, 6 aa, synthetic construct
  REGION 1..6: note = Synthetic Construct
GKAQRK

SEQ ID NO: 12392 - protein, 6 aa, synthetic construct
  REGION 1..6: note = Synthetic Construct
GKAQSK

SEQ ID NO: 12393 - protein, 6 aa, synthetic construct
  REGION 1..6: note = Synthetic Construct
GKAQTK

SEQ ID NO: 12394 - protein, 6 aa, synthetic construct
  REGION 1..6: note = Synthetic Construct
GKAQYK

SEQ ID NO: 12395 - protein, 6 aa, synthetic construct
  REGION 1..6: note = Synthetic Construct
GKARAK

SEQ ID NO: 12396 - protein, 6 aa, synthetic construct
  REGION 1..6: note = Synthetic Construct
GKARDK

SEQ ID NO: 12397 - protein, 6 aa, synthetic construct
  REGION 1..6: note = Synthetic Construct
GKAREK

SEQ ID NO: 12398 - protein, 6 aa, synthetic construct
  REGION 1..6: note = Synthetic Construct
GKARFK

SEQ ID NO: 12399 - protein, 6 aa, synthetic construct
  REGION 1..6: note = Synthetic Construct
GKARGK

SEQ ID NO: 12400 - protein, 6 aa, synthetic construct
  REGION 1..6: note = Synthetic Construct
GKARHK

SEQ ID NO: 12401 - protein, 6 aa, synthetic construct
  REGION 1..6: note = Synthetic Construct
GKARIK

SEQ ID NO: 12402 - protein, 6 aa, synthetic construct
  REGION 1..6: note = Synthetic Construct
GKARLK

SEQ ID NO: 12403 - protein, 6 aa, synthetic construct
  REGION 1..6: note = Synthetic Construct
GKARNK

SEQ ID NO: 12404 - protein, 6 aa, synthetic construct
  REGION 1..6: note = Synthetic Construct
GKARQK

SEQ ID NO: 12405 - protein, 6 aa, synthetic construct
  REGION 1..6: note = Synthetic Construct
GKARRK

SEQ ID NO: 12406 - protein, 6 aa, synthetic construct
  REGION 1..6: note = Synthetic Construct
GKARSK

SEQ ID NO: 12407 - protein, 6 aa, synthetic construct
  REGION 1..6: note = Synthetic Construct
GKARTK

SEQ ID NO: 12408 - protein, 6 aa, synthetic construct
  REGION 1..6: note = Synthetic Construct
GKARYK

SEQ ID NO: 12409 - protein, 6 aa, synthetic construct
  REGION 1..6: note = Synthetic Construct
GKASAK

SEQ ID NO: 12410 - protein, 6 aa, synthetic construct
  REGION 1..6: note = Synthetic Construct
GKASDK

SEQ ID NO: 12411 - protein, 6 aa, synthetic construct
  REGION 1..6: note = Synthetic Construct
GKASEK

SEQ ID NO: 12412 - protein, 6 aa, synthetic construct
  REGION 1..6: note = Synthetic Construct
GKASFK

SEQ ID NO: 12413 - protein, 6 aa, synthetic construct
  REGION 1..6: note = Synthetic Construct
GKASGK

SEQ ID NO: 12414 - protein, 6 aa, synthetic construct
  REGION 1..6: note = Synthetic Construct
GKASHK

SEQ ID NO: 12415 - protein, 6 aa, synthetic construct
  REGION 1..6: note = Synthetic Construct
GKASIK

SEQ ID NO: 12416 - protein, 6 aa, synthetic construct
  REGION 1..6: note = Synthetic Construct
GKASLK

SEQ ID NO: 12417 - protein, 6 aa, synthetic construct
  REGION 1..6: note = Synthetic Construct
GKASNK

SEQ ID NO: 12418 - protein, 6 aa, synthetic construct
  REGION 1..6: note = Synthetic Construct
GKASQK

SEQ ID NO: 12419 - protein, 6 aa, synthetic construct
  REGION 1..6: note = Synthetic Construct
GKASRK

SEQ ID NO: 12420 - protein, 6 aa, synthetic construct
  REGION 1..6: note = Synthetic Construct
GKASSK

SEQ ID NO: 12421 - protein, 6 aa, synthetic construct
  REGION 1..6: note = Synthetic Construct
GKASTK

SEQ ID NO: 12422 - protein, 6 aa, synthetic construct
  REGION 1..6: note = Synthetic Construct
GKASYK

SEQ ID NO: 12423 - protein, 6 aa, synthetic construct
  REGION 1..6: note = Synthetic Construct
GKATAK

SEQ ID NO: 12424 - protein, 6 aa, synthetic construct
  REGION 1..6: note = Synthetic Construct
GKATDK

SEQ ID NO: 12425 - protein, 6 aa, synthetic construct
  REGION 1..6: note = Synthetic Construct
GKATEK

SEQ ID NO: 12426 - protein, 6 aa, synthetic construct
  REGION 1..6: note = Synthetic Construct
GKATFK

SEQ ID NO: 12427 - protein, 6 aa, synthetic construct
  REGION 1..6: note = Synthetic Construct
GKATGK

SEQ ID NO: 12428 - protein, 6 aa, synthetic construct
  REGION 1..6: note = Synthetic Construct
GKATHK

SEQ ID NO: 12429 - protein, 6 aa, synthetic construct
  REGION 1..6: note = Synthetic Construct
GKATIK

SEQ ID NO: 12430 - protein, 6 aa, synthetic construct
  REGION 1..6: note = Synthetic Construct
GKATLK

SEQ ID NO: 12431 - protein, 6 aa, synthetic construct
  REGION 1..6: note = Synthetic Construct
GKATNK

SEQ ID NO: 12432 - protein, 6 aa, synthetic construct
  REGION 1..6: note = Synthetic Construct
GKATQK

SEQ ID NO: 12433 - protein, 6 aa, synthetic construct
  REGION 1..6: note = Synthetic Construct
GKATRK

SEQ ID NO: 12434 - protein, 6 aa, synthetic construct
  REGION 1..6: note = Synthetic Construct
GKATSK

SEQ ID NO: 12435 - protein, 6 aa, synthetic construct
  REGION 1..6: note = Synthetic Construct
GKATTK

SEQ ID NO: 12436 - protein, 6 aa, synthetic construct
  REGION 1..6: note = Synthetic Construct
GKATYK

SEQ ID NO: 12437 - protein, 6 aa, synthetic construct
  REGION 1..6: note = Synthetic Construct
GKAYAK

SEQ ID NO: 12438 - protein, 6 aa, synthetic construct
  REGION 1..6: note = Synthetic Construct
GKAYDK

SEQ ID NO: 12439 - protein, 6 aa, synthetic construct
  REGION 1..6: note = Synthetic Construct
GKAYEK

SEQ ID NO: 12440 - protein, 6 aa, synthetic construct
  REGION 1..6: note = Synthetic Construct
GKAYFK

SEQ ID NO: 12441 - protein, 6 aa, synthetic construct
  REGION 1..6: note = Synthetic Construct
GKAYGK

SEQ ID NO: 12442 - protein, 6 aa, synthetic construct
  REGION 1..6: note = Synthetic Construct
GKAYHK

SEQ ID NO: 12443 - protein, 6 aa, synthetic construct
  REGION 1..6: note = Synthetic Construct
GKAYIK

SEQ ID NO: 12444 - protein, 6 aa, synthetic construct
  REGION 1..6: note = Synthetic Construct
GKAYLK

SEQ ID NO: 12445 - protein, 6 aa, synthetic construct
  REGION 1..6: note = Synthetic Construct
GKAYNK

SEQ ID NO: 12446 - protein, 6 aa, synthetic construct
  REGION 1..6: note = Synthetic Construct
GKAYQK

SEQ ID NO: 12447 - protein, 6 aa, synthetic construct
  REGION 1..6: note = Synthetic Construct
GKAYRK

SEQ ID NO: 12448 - protein, 6 aa, synthetic construct
  REGION 1..6: note = Synthetic Construct
GKAYSK

SEQ ID NO: 12449 - protein, 6 aa, synthetic construct
  REGION 1..6: note = Synthetic Construct
GKAYTK

SEQ ID NO: 12450 - protein, 6 aa, synthetic construct
  REGION 1..6: note = Synthetic Construct
GKAYYK

SEQ ID NO: 12451 - protein, 6 aa, synthetic construct
  REGION 1..6: note = Synthetic Construct
GKDAAK

SEQ ID NO: 12452 - protein, 6 aa, synthetic construct
  REGION 1..6: note = Synthetic Construct
GKDADK

SEQ ID NO: 12453 - protein, 6 aa, synthetic construct
  REGION 1..6: note = Synthetic Construct
GKDAEK

SEQ ID NO: 12454 - protein, 6 aa, synthetic construct
  REGION 1..6: note = Synthetic Construct
GKDAFK

SEQ ID NO: 12455 - protein, 6 aa, synthetic construct
  REGION 1..6: note = Synthetic Construct
GKDAGK

SEQ ID NO: 12456 - protein, 6 aa, synthetic construct
  REGION 1..6: note = Synthetic Construct
GKDAHK

SEQ ID NO: 12457 - protein, 6 aa, synthetic construct
  REGION 1..6: note = Synthetic Construct
GKDAIK

SEQ ID NO: 12458 - protein, 6 aa, synthetic construct
  REGION 1..6: note = Synthetic Construct
GKDALK

SEQ ID NO: 12459 - protein, 6 aa, synthetic construct
  REGION 1..6: note = Synthetic Construct
GKDANK

SEQ ID NO: 12460 - protein, 6 aa, synthetic construct
  REGION 1..6: note = Synthetic Construct
GKDAQK

SEQ ID NO: 12461 - protein, 6 aa, synthetic construct
  REGION 1..6: note = Synthetic Construct
GKDARK

SEQ ID NO: 12462 - protein, 6 aa, synthetic construct
  REGION 1..6: note = Synthetic Construct
GKDASK

SEQ ID NO: 12463 - protein, 6 aa, synthetic construct
  REGION 1..6: note = Synthetic Construct
GKDATK

SEQ ID NO: 12464 - protein, 6 aa, synthetic construct
  REGION 1..6: note = Synthetic Construct
GKDAYK

SEQ ID NO: 12465 - protein, 6 aa, synthetic construct
  REGION 1..6: note = Synthetic Construct
GKDDAK

SEQ ID NO: 12466 - protein, 6 aa, synthetic construct
  REGION 1..6: note = Synthetic Construct
GKDDDK

SEQ ID NO: 12467 - protein, 6 aa, synthetic construct
  REGION 1..6: note = Synthetic Construct
GKDDEK

SEQ ID NO: 12468 - protein, 6 aa, synthetic construct
  REGION 1..6: note = Synthetic Construct
GKDDFK

SEQ ID NO: 12469 - protein, 6 aa, synthetic construct
  REGION 1..6: note = Synthetic Construct
GKDDGK

SEQ ID NO: 12470 - protein, 6 aa, synthetic construct
  REGION 1..6: note = Synthetic Construct
GKDDHK

SEQ ID NO: 12471 - protein, 6 aa, synthetic construct
  REGION 1..6: note = Synthetic Construct
GKDDIK

SEQ ID NO: 12472 - protein, 6 aa, synthetic construct
  REGION 1..6: note = Synthetic Construct
GKDDLK

SEQ ID NO: 12473 - protein, 6 aa, synthetic construct
  REGION 1..6: note = Synthetic Construct
GKDDNK

SEQ ID NO: 12474 - protein, 6 aa, synthetic construct
  REGION 1..6: note = Synthetic Construct
GKDDQK

SEQ ID NO: 12475 - protein, 6 aa, synthetic construct
  REGION 1..6: note = Synthetic Construct
GKDDRK

SEQ ID NO: 12476 - protein, 6 aa, synthetic construct
  REGION 1..6: note = Synthetic Construct
GKDDSK

SEQ ID NO: 12477 - protein, 6 aa, synthetic construct
  REGION 1..6: note = Synthetic Construct
GKDDTK

SEQ ID NO: 12478 - protein, 6 aa, synthetic construct
  REGION 1..6: note = Synthetic Construct
GKDDYK

SEQ ID NO: 12479 - protein, 6 aa, synthetic construct
  REGION 1..6: note = Synthetic Construct
GKDEAK

SEQ ID NO: 12480 - protein, 6 aa, synthetic construct
  REGION 1..6: note = Synthetic Construct
GKDEDK

SEQ ID NO: 12481 - protein, 6 aa, synthetic construct
  REGION 1..6: note = Synthetic Construct
GKDEEK

SEQ ID NO: 12482 - protein, 6 aa, synthetic construct
  REGION 1..6: note = Synthetic Construct
GKDEFK

SEQ ID NO: 12483 - protein, 6 aa, synthetic construct
  REGION 1..6: note = Synthetic Construct
GKDEGK

SEQ ID NO: 12484 - protein, 6 aa, synthetic construct
  REGION 1..6: note = Synthetic Construct
GKDEHK

SEQ ID NO: 12485 - protein, 6 aa, synthetic construct
  REGION 1..6: note = Synthetic Construct
GKDEIK

SEQ ID NO: 12486 - protein, 6 aa, synthetic construct
  REGION 1..6: note = Synthetic Construct
GKDELK

SEQ ID NO: 12487 - protein, 6 aa, synthetic construct
  REGION 1..6: note = Synthetic Construct
GKDENK

SEQ ID NO: 12488 - protein, 6 aa, synthetic construct
  REGION 1..6: note = Synthetic Construct
GKDEQK

SEQ ID NO: 12489 - protein, 6 aa, synthetic construct
  REGION 1..6: note = Synthetic Construct
GKDERK

SEQ ID NO: 12490 - protein, 6 aa, synthetic construct
  REGION 1..6: note = Synthetic Construct
GKDESK

SEQ ID NO: 12491 - protein, 6 aa, synthetic construct
  REGION 1..6: note = Synthetic Construct
GKDETK

SEQ ID NO: 12492 - protein, 6 aa, synthetic construct
  REGION 1..6: note = Synthetic Construct
GKDEYK

SEQ ID NO: 12493 - protein, 6 aa, synthetic construct
  REGION 1..6: note = Synthetic Construct
GKDFAK

SEQ ID NO: 12494 - protein, 6 aa, synthetic construct
  REGION 1..6: note = Synthetic Construct
GKDFDK

SEQ ID NO: 12495 - protein, 6 aa, synthetic construct
  REGION 1..6: note = Synthetic Construct
GKDFEK

SEQ ID NO: 12496 - protein, 6 aa, synthetic construct
  REGION 1..6: note = Synthetic Construct
GKDFFK

SEQ ID NO: 12497 - protein, 6 aa, synthetic construct
  REGION 1..6: note = Synthetic Construct
GKDFGK

SEQ ID NO: 12498 - protein, 6 aa, synthetic construct
  REGION 1..6: note = Synthetic Construct
GKDFHK

SEQ ID NO: 12499 - protein, 6 aa, synthetic construct
  REGION 1..6: note = Synthetic Construct
GKDFIK

SEQ ID NO: 12500 - protein, 6 aa, synthetic construct
  REGION 1..6: note = Synthetic Construct
GKDFLK

SEQ ID NO: 12501 - protein, 6 aa, synthetic construct
  REGION 1..6: note = Synthetic Construct
GKDFNK

SEQ ID NO: 12502 - protein, 6 aa, synthetic construct
  REGION 1..6: note = Synthetic Construct
GKDFQK

SEQ ID NO: 12503 - protein, 6 aa, synthetic construct
  REGION 1..6: note = Synthetic Construct
GKDFRK

SEQ ID NO: 12504 - protein, 6 aa, synthetic construct
  REGION 1..6: note = Synthetic Construct
GKDFSK

SEQ ID NO: 12505 - protein, 6 aa, synthetic construct
  REGION 1..6: note = Synthetic Construct
GKDFTK

SEQ ID NO: 12506 - protein, 6 aa, synthetic construct
  REGION 1..6: note = Synthetic Construct
GKDFYK

SEQ ID NO: 12507 - protein, 6 aa, synthetic construct
  REGION 1..6: note = Synthetic Construct
GKDGAK

SEQ ID NO: 12508 - protein, 6 aa, synthetic construct
  REGION 1..6: note = Synthetic Construct
GKDGDK

SEQ ID NO: 12509 - protein, 6 aa, synthetic construct
  REGION 1..6: note = Synthetic Construct
GKDGEK

SEQ ID NO: 12510 - protein, 6 aa, synthetic construct
  REGION 1..6: note = Synthetic Construct
GKDGFK

SEQ ID NO: 12511 - protein, 6 aa, synthetic construct
  REGION 1..6: note = Synthetic Construct
GKDGGK

SEQ ID NO: 12512 - protein, 6 aa, synthetic construct
  REGION 1..6: note = Synthetic Construct
GKDGHK

SEQ ID NO: 12513 - protein, 6 aa, synthetic construct
  REGION 1..6: note = Synthetic Construct
GKDGIK

SEQ ID NO: 12514 - protein, 6 aa, synthetic construct
  REGION 1..6: note = Synthetic Construct
GKDGLK

SEQ ID NO: 12515 - protein, 6 aa, synthetic construct
  REGION 1..6: note = Synthetic Construct
GKDGNK

SEQ ID NO: 12516 - protein, 6 aa, synthetic construct
  REGION 1..6: note = Synthetic Construct
GKDGQK

SEQ ID NO: 12517 - protein, 6 aa, synthetic construct
  REGION 1..6: note = Synthetic Construct
GKDGRK

SEQ ID NO: 12518 - protein, 6 aa, synthetic construct
  REGION 1..6: note = Synthetic Construct
GKDGSK

SEQ ID NO: 12519 - protein, 6 aa, synthetic construct
  REGION 1..6: note = Synthetic Construct
GKDGTK

SEQ ID NO: 12520 - protein, 6 aa, synthetic construct
  REGION 1..6: note = Synthetic Construct
GKDGYK

SEQ ID NO: 12521 - protein, 6 aa, synthetic construct
  REGION 1..6: note = Synthetic Construct
GKDHAK

SEQ ID NO: 12522 - protein, 6 aa, synthetic construct
  REGION 1..6: note = Synthetic Construct
GKDHDK

SEQ ID NO: 12523 - protein, 6 aa, synthetic construct
  REGION 1..6: note = Synthetic Construct
GKDHEK

SEQ ID NO: 12524 - protein, 6 aa, synthetic construct
  REGION 1..6: note = Synthetic Construct
GKDHFK

SEQ ID NO: 12525 - protein, 6 aa, synthetic construct
  REGION 1..6: note = Synthetic Construct
GKDHGK

SEQ ID NO: 12526 - protein, 6 aa, synthetic construct
  REGION 1..6: note = Synthetic Construct
GKDHHK

SEQ ID NO: 12527 - protein, 6 aa, synthetic construct
  REGION 1..6: note = Synthetic Construct
GKDHIK

SEQ ID NO: 12528 - protein, 6 aa, synthetic construct
  REGION 1..6: note = Synthetic Construct
GKDHLK

SEQ ID NO: 12529 - protein, 6 aa, synthetic construct
  REGION 1..6: note = Synthetic Construct
GKDHNK

SEQ ID NO: 12530 - protein, 6 aa, synthetic construct
  REGION 1..6: note = Synthetic Construct
GKDHQK

SEQ ID NO: 12531 - protein, 6 aa, synthetic construct
  REGION 1..6: note = Synthetic Construct
GKDHRK

SEQ ID NO: 12532 - protein, 6 aa, synthetic construct
  REGION 1..6: note = Synthetic Construct
GKDHSK

SEQ ID NO: 12533 - protein, 6 aa, synthetic construct
  REGION 1..6: note = Synthetic Construct
GKDHTK

SEQ ID NO: 12534 - protein, 6 aa, synthetic construct
  REGION 1..6: note = Synthetic Construct
GKDHYK

SEQ ID NO: 12535 - protein, 6 aa, synthetic construct
  REGION 1..6: note = Synthetic Construct
GKDIAK

SEQ ID NO: 12536 - protein, 6 aa, synthetic construct
  REGION 1..6: note = Synthetic Construct
GKDIDK

SEQ ID NO: 12537 - protein, 6 aa, synthetic construct
  REGION 1..6: note = Synthetic Construct
GKDIEK

SEQ ID NO: 12538 - protein, 6 aa, synthetic construct
  REGION 1..6: note = Synthetic Construct
GKDIFK

SEQ ID NO: 12539 - protein, 6 aa, synthetic construct
  REGION 1..6: note = Synthetic Construct
GKDIGK

SEQ ID NO: 12540 - protein, 6 aa, synthetic construct
  REGION 1..6: note = Synthetic Construct
GKDIHK

SEQ ID NO: 12541 - protein, 6 aa, synthetic construct
  REGION 1..6: note = Synthetic Construct
GKDIIK

SEQ ID NO: 12542 - protein, 6 aa, synthetic construct
  REGION 1..6: note = Synthetic Construct
GKDILK

SEQ ID NO: 12543 - protein, 6 aa, synthetic construct
  REGION 1..6: note = Synthetic Construct
GKDINK

SEQ ID NO: 12544 - protein, 6 aa, synthetic construct
  REGION 1..6: note = Synthetic Construct
GKDIQK

SEQ ID NO: 12545 - protein, 6 aa, synthetic construct
  REGION 1..6: note = Synthetic Construct
GKDIRK

SEQ ID NO: 12546 - protein, 6 aa, synthetic construct
  REGION 1..6: note = Synthetic Construct
GKDISK

SEQ ID NO: 12547 - protein, 6 aa, synthetic construct
  REGION 1..6: note = Synthetic Construct
GKDITK

SEQ ID NO: 12548 - protein, 6 aa, synthetic construct
  REGION 1..6: note = Synthetic Construct
GKDIYK

SEQ ID NO: 12549 - protein, 6 aa, synthetic construct
  REGION 1..6: note = Synthetic Construct
GKDLAK

SEQ ID NO: 12550 - protein, 6 aa, synthetic construct
  REGION 1..6: note = Synthetic Construct
GKDLDK

SEQ ID NO: 12551 - protein, 6 aa, synthetic construct
  REGION 1..6: note = Synthetic Construct
GKDLEK

SEQ ID NO: 12552 - protein, 6 aa, synthetic construct
  REGION 1..6: note = Synthetic Construct
GKDLFK

SEQ ID NO: 12553 - protein, 6 aa, synthetic construct
  REGION 1..6: note = Synthetic Construct
GKDLGK

SEQ ID NO: 12554 - protein, 6 aa, synthetic construct
  REGION 1..6: note = Synthetic Construct
GKDLHK

SEQ ID NO: 12555 - protein, 6 aa, synthetic construct
  REGION 1..6: note = Synthetic Construct
GKDLIK

SEQ ID NO: 12556 - protein, 6 aa, synthetic construct
  REGION 1..6: note = Synthetic Construct
GKDLLK

SEQ ID NO: 12557 - protein, 6 aa, synthetic construct
  REGION 1..6: note = Synthetic Construct
GKDLNK

SEQ ID NO: 12558 - protein, 6 aa, synthetic construct
  REGION 1..6: note = Synthetic Construct
GKDLQK

SEQ ID NO: 12559 - protein, 6 aa, synthetic construct
  REGION 1..6: note = Synthetic Construct
GKDLRK

SEQ ID NO: 12560 - protein, 6 aa, synthetic construct
  REGION 1..6: note = Synthetic Construct
GKDLSK

SEQ ID NO: 12561 - protein, 6 aa, synthetic construct
  REGION 1..6: note = Synthetic Construct
GKDLTK

SEQ ID NO: 12562 - protein, 6 aa, synthetic construct
  REGION 1..6: note = Synthetic Construct
GKDLYK

SEQ ID NO: 12563 - protein, 6 aa, synthetic construct
  REGION 1..6: note = Synthetic Construct
GKDNAK

SEQ ID NO: 12564 - protein, 6 aa, synthetic construct
  REGION 1..6: note = Synthetic Construct
GKDNDK

SEQ ID NO: 12565 - protein, 6 aa, synthetic construct
  REGION 1..6: note = Synthetic Construct
GKDNEK

SEQ ID NO: 12566 - protein, 6 aa, synthetic construct
  REGION 1..6: note = Synthetic Construct
GKDNFK

SEQ ID NO: 12567 - protein, 6 aa, synthetic construct
  REGION 1..6: note = Synthetic Construct
GKDNGK

SEQ ID NO: 12568 - protein, 6 aa, synthetic construct
  REGION 1..6: note = Synthetic Construct
GKDNHK

SEQ ID NO: 12569 - protein, 6 aa, synthetic construct
  REGION 1..6: note = Synthetic Construct
GKDNIK

SEQ ID NO: 12570 - protein, 6 aa, synthetic construct
  REGION 1..6: note = Synthetic Construct
GKDNLK

SEQ ID NO: 12571 - protein, 6 aa, synthetic construct
  REGION 1..6: note = Synthetic Construct
GKDNNK

SEQ ID NO: 12572 - protein, 6 aa, synthetic construct
  REGION 1..6: note = Synthetic Construct
GKDNQK

SEQ ID NO: 12573 - protein, 6 aa, synthetic construct
  REGION 1..6: note = Synthetic Construct
GKDNRK

SEQ ID NO: 12574 - protein, 6 aa, synthetic construct
  REGION 1..6: note = Synthetic Construct
GKDNSK

SEQ ID NO: 12575 - protein, 6 aa, synthetic construct
  REGION 1..6: note = Synthetic Construct
GKDNTK

SEQ ID NO: 12576 - protein, 6 aa, synthetic construct
  REGION 1..6: note = Synthetic Construct
GKDNYK

SEQ ID NO: 12577 - protein, 6 aa, synthetic construct
  REGION 1..6: note = Synthetic Construct
GKDQAK

SEQ ID NO: 12578 - protein, 6 aa, synthetic construct
  REGION 1..6: note = Synthetic Construct
GKDQDK

SEQ ID NO: 12579 - protein, 6 aa, synthetic construct
  REGION 1..6: note = Synthetic Construct
GKDQEK

SEQ ID NO: 12580 - protein, 6 aa, synthetic construct
  REGION 1..6: note = Synthetic Construct
GKDQFK

SEQ ID NO: 12581 - protein, 6 aa, synthetic construct
  REGION 1..6: note = Synthetic Construct
GKDQGK

SEQ ID NO: 12582 - protein, 6 aa, synthetic construct
  REGION 1..6: note = Synthetic Construct
GKDQHK

SEQ ID NO: 12583 - protein, 6 aa, synthetic construct
  REGION 1..6: note = Synthetic Construct
GKDQIK

SEQ ID NO: 12584 - protein, 6 aa, synthetic construct
  REGION 1..6: note = Synthetic Construct
GKDQLK

SEQ ID NO: 12585 - protein, 6 aa, synthetic construct
  REGION 1..6: note = Synthetic Construct
GKDQNK

SEQ ID NO: 12586 - protein, 6 aa, synthetic construct
  REGION 1..6: note = Synthetic Construct
GKDQQK

SEQ ID NO: 12587 - protein, 6 aa, synthetic construct
  REGION 1..6: note = Synthetic Construct
GKDQRK

SEQ ID NO: 12588 - protein, 6 aa, synthetic construct
  REGION 1..6: note = Synthetic Construct
GKDQSK

SEQ ID NO: 12589 - protein, 6 aa, synthetic construct
  REGION 1..6: note = Synthetic Construct
GKDQTK

SEQ ID NO: 12590 - protein, 6 aa, synthetic construct
  REGION 1..6: note = Synthetic Construct
GKDQYK

SEQ ID NO: 12591 - protein, 6 aa, synthetic construct
  REGION 1..6: note = Synthetic Construct
GKDRAK

SEQ ID NO: 12592 - protein, 6 aa, synthetic construct
  REGION 1..6: note = Synthetic Construct
GKDRDK

SEQ ID NO: 12593 - protein, 6 aa, synthetic construct
  REGION 1..6: note = Synthetic Construct
GKDREK

SEQ ID NO: 12594 - protein, 6 aa, synthetic construct
  REGION 1..6: note = Synthetic Construct
GKDRFK

SEQ ID NO: 12595 - protein, 6 aa, synthetic construct
  REGION 1..6: note = Synthetic Construct
GKDRGK

SEQ ID NO: 12596 - protein, 6 aa, synthetic construct
  REGION 1..6: note = Synthetic Construct
GKDRHK

SEQ ID NO: 12597 - protein, 6 aa, synthetic construct
  REGION 1..6: note = Synthetic Construct
GKDRIK

SEQ ID NO: 12598 - protein, 6 aa, synthetic construct
  REGION 1..6: note = Synthetic Construct
GKDRLK

SEQ ID NO: 12599 - protein, 6 aa, synthetic construct
  REGION 1..6: note = Synthetic Construct
GKDRNK

SEQ ID NO: 12600 - protein, 6 aa, synthetic construct
  REGION 1..6: note = Synthetic Construct
GKDRQK

SEQ ID NO: 12601 - protein, 6 aa, synthetic construct
  REGION 1..6: note = Synthetic Construct
GKDRRK

SEQ ID NO: 12602 - protein, 6 aa, synthetic construct
  REGION 1..6: note = Synthetic Construct
GKDRSK

SEQ ID NO: 12603 - protein, 6 aa, synthetic construct
  REGION 1..6: note = Synthetic Construct
GKDRTK

SEQ ID NO: 12604 - protein, 6 aa, synthetic construct
  REGION 1..6: note = Synthetic Construct
GKDRYK

SEQ ID NO: 12605 - protein, 6 aa, synthetic construct
  REGION 1..6: note = Synthetic Construct
GKDSAK

SEQ ID NO: 12606 - protein, 6 aa, synthetic construct
  REGION 1..6: note = Synthetic Construct
GKDSDK

SEQ ID NO: 12607 - protein, 6 aa, synthetic construct
  REGION 1..6: note = Synthetic Construct
GKDSEK

SEQ ID NO: 12608 - protein, 6 aa, synthetic construct
  REGION 1..6: note = Synthetic Construct
GKDSFK

SEQ ID NO: 12609 - protein, 6 aa, synthetic construct
  REGION 1..6: note = Synthetic Construct
GKDSGK

SEQ ID NO: 12610 - protein, 6 aa, synthetic construct
  REGION 1..6: note = Synthetic Construct
GKDSHK

SEQ ID NO: 12611 - protein, 6 aa, synthetic construct
  REGION 1..6: note = Synthetic Construct
GKDSIK

SEQ ID NO: 12612 - protein, 6 aa, synthetic construct
  REGION 1..6: note = Synthetic Construct
GKDSLK

SEQ ID NO: 12613 - protein, 6 aa, synthetic construct
  REGION 1..6: note = Synthetic Construct
GKDSNK

SEQ ID NO: 12614 - protein, 6 aa, synthetic construct
  REGION 1..6: note = Synthetic Construct
GKDSQK

SEQ ID NO: 12615 - protein, 6 aa, synthetic construct
  REGION 1..6: note = Synthetic Construct
GKDSRK

SEQ ID NO: 12616 - protein, 6 aa, synthetic construct
  REGION 1..6: note = Synthetic Construct
GKDSSK

SEQ ID NO: 12617 - protein, 6 aa, synthetic construct
  REGION 1..6: note = Synthetic Construct
GKDSTK

SEQ ID NO: 12618 - protein, 6 aa, synthetic construct
  REGION 1..6: note = Synthetic Construct
GKDSYK

SEQ ID NO: 12619 - protein, 6 aa, synthetic construct
  REGION 1..6: note = Synthetic Construct
GKDTAK

SEQ ID NO: 12620 - protein, 6 aa, synthetic construct
  REGION 1..6: note = Synthetic Construct
GKDTDK

SEQ ID NO: 12621 - protein, 6 aa, synthetic construct
  REGION 1..6: note = Synthetic Construct
GKDTEK

SEQ ID NO: 12622 - protein, 6 aa, synthetic construct
  REGION 1..6: note = Synthetic Construct
GKDTFK

SEQ ID NO: 12623 - protein, 6 aa, synthetic construct
  REGION 1..6: note = Synthetic Construct
GKDTGK

SEQ ID NO: 12624 - protein, 6 aa, synthetic construct
  REGION 1..6: note = Synthetic Construct
GKDTHK

SEQ ID NO: 12625 - protein, 6 aa, synthetic construct
  REGION 1..6: note = Synthetic Construct
GKDTIK

SEQ ID NO: 12626 - protein, 6 aa, synthetic construct
  REGION 1..6: note = Synthetic Construct
GKDTLK

SEQ ID NO: 12627 - protein, 6 aa, synthetic construct
  REGION 1..6: note = Synthetic Construct
GKDTNK

SEQ ID NO: 12628 - protein, 6 aa, synthetic construct
  REGION 1..6: note = Synthetic Construct
GKDTQK

SEQ ID NO: 12629 - protein, 6 aa, synthetic construct
  REGION 1..6: note = Synthetic Construct
GKDTRK

SEQ ID NO: 12630 - protein, 6 aa, synthetic construct
  REGION 1..6: note = Synthetic Construct
GKDTSK

SEQ ID NO: 12631 - protein, 6 aa, synthetic construct
  REGION 1..6: note = Synthetic Construct
GKDTTK

SEQ ID NO: 12632 - protein, 6 aa, synthetic construct
  REGION 1..6: note = Synthetic Construct
GKDTYK

SEQ ID NO: 12633 - protein, 6 aa, synthetic construct
  REGION 1..6: note = Synthetic Construct
GKDYAK

SEQ ID NO: 12634 - protein, 6 aa, synthetic construct
  REGION 1..6: note = Synthetic Construct
GKDYDK

SEQ ID NO: 12635 - protein, 6 aa, synthetic construct
  REGION 1..6: note = Synthetic Construct
GKDYEK

SEQ ID NO: 12636 - protein, 6 aa, synthetic construct
  REGION 1..6: note = Synthetic Construct
GKDYFK

SEQ ID NO: 12637 - protein, 6 aa, synthetic construct
  REGION 1..6: note = Synthetic Construct
GKDYGK

SEQ ID NO: 12638 - protein, 6 aa, synthetic construct
  REGION 1..6: note = Synthetic Construct
GKDYHK

SEQ ID NO: 12639 - protein, 6 aa, synthetic construct
  REGION 1..6: note = Synthetic Construct
GKDYIK

SEQ ID NO: 12640 - protein, 6 aa, synthetic construct
  REGION 1..6: note = Synthetic Construct
GKDYLK

SEQ ID NO: 12641 - protein, 6 aa, synthetic construct
  REGION 1..6: note = Synthetic Construct
GKDYNK

SEQ ID NO: 12642 - protein, 6 aa, synthetic construct
  REGION 1..6: note = Synthetic Construct
GKDYQK

SEQ ID NO: 12643 - protein, 6 aa, synthetic construct
  REGION 1..6: note = Synthetic Construct
GKDYRK

SEQ ID NO: 12644 - protein, 6 aa, synthetic construct
  REGION 1..6: note = Synthetic Construct
GKDYSK

SEQ ID NO: 12645 - protein, 6 aa, synthetic construct
  REGION 1..6: note = Synthetic Construct
GKDYTK

SEQ ID NO: 12646 - protein, 6 aa, synthetic construct
  REGION 1..6: note = Synthetic Construct
GKDYYK

SEQ ID NO: 12647 - protein, 6 aa, synthetic construct
  REGION 1..6: note = Synthetic Construct
GKEAAK

SEQ ID NO: 12648 - protein, 6 aa, synthetic construct
  REGION 1..6: note = Synthetic Construct
GKEADK

SEQ ID NO: 12649 - protein, 6 aa, synthetic construct
  REGION 1..6: note = Synthetic Construct
GKEAEK

SEQ ID NO: 12650 - protein, 6 aa, synthetic construct
  REGION 1..6: note = Synthetic Construct
GKEAFK

SEQ ID NO: 12651 - protein, 6 aa, synthetic construct
  REGION 1..6: note = Synthetic Construct
GKEAGK

SEQ ID NO: 12652 - protein, 6 aa, synthetic construct
  REGION 1..6: note = Synthetic Construct
GKEAHK

SEQ ID NO: 12653 - protein, 6 aa, synthetic construct
  REGION 1..6: note = Synthetic Construct
GKEAIK

SEQ ID NO: 12654 - protein, 6 aa, synthetic construct
  REGION 1..6: note = Synthetic Construct
GKEALK

SEQ ID NO: 12655 - protein, 6 aa, synthetic construct
  REGION 1..6: note = Synthetic Construct
GKEANK

SEQ ID NO: 12656 - protein, 6 aa, synthetic construct
  REGION 1..6: note = Synthetic Construct
GKEAQK

SEQ ID NO: 12657 - protein, 6 aa, synthetic construct
  REGION 1..6: note = Synthetic Construct
GKEARK

SEQ ID NO: 12658 - protein, 6 aa, synthetic construct
  REGION 1..6: note = Synthetic Construct
GKEASK

SEQ ID NO: 12659 - protein, 6 aa, synthetic construct
  REGION 1..6: note = Synthetic Construct
GKEATK

SEQ ID NO: 12660 - protein, 6 aa, synthetic construct
  REGION 1..6: note = Synthetic Construct
GKEAYK

SEQ ID NO: 12661 - protein, 6 aa, synthetic construct
  REGION 1..6: note = Synthetic Construct
GKEDAK

SEQ ID NO: 12662 - protein, 6 aa, synthetic construct
  REGION 1..6: note = Synthetic Construct
GKEDDK

SEQ ID NO: 12663 - protein, 6 aa, synthetic construct
  REGION 1..6: note = Synthetic Construct
GKEDEK

SEQ ID NO: 12664 - protein, 6 aa, synthetic construct
  REGION 1..6: note = Synthetic Construct
GKEDFK

SEQ ID NO: 12665 - protein, 6 aa, synthetic construct
  REGION 1..6: note = Synthetic Construct
GKEDGK

SEQ ID NO: 12666 - protein, 6 aa, synthetic construct
  REGION 1..6: note = Synthetic Construct
GKEDHK

SEQ ID NO: 12667 - protein, 6 aa, synthetic construct
  REGION 1..6: note = Synthetic Construct
GKEDIK

SEQ ID NO: 12668 - protein, 6 aa, synthetic construct
  REGION 1..6: note = Synthetic Construct
GKEDLK

SEQ ID NO: 12669 - protein, 6 aa, synthetic construct
  REGION 1..6: note = Synthetic Construct
GKEDNK

SEQ ID NO: 12670 - protein, 6 aa, synthetic construct
  REGION 1..6: note = Synthetic Construct
GKEDQK

SEQ ID NO: 12671 - protein, 6 aa, synthetic construct
  REGION 1..6: note = Synthetic Construct
GKEDRK

SEQ ID NO: 12672 - protein, 6 aa, synthetic construct
  REGION 1..6: note = Synthetic Construct
GKEDSK

SEQ ID NO: 12673 - protein, 6 aa, synthetic construct
  REGION 1..6: note = Synthetic Construct
GKEDTK

SEQ ID NO: 12674 - protein, 6 aa, synthetic construct
  REGION 1..6: note = Synthetic Construct
GKEDYK

SEQ ID NO: 12675 - protein, 6 aa, synthetic construct
  REGION 1..6: note = Synthetic Construct
GKEEAK

SEQ ID NO: 12676 - protein, 6 aa, synthetic construct
  REGION 1..6: note = Synthetic Construct
GKEEDK

SEQ ID NO: 12677 - protein, 6 aa, synthetic construct
  REGION 1..6: note = Synthetic Construct
GKEEEK

SEQ ID NO: 12678 - protein, 6 aa, synthetic construct
  REGION 1..6: note = Synthetic Construct
GKEEFK

SEQ ID NO: 12679 - protein, 6 aa, synthetic construct
  REGION 1..6: note = Synthetic Construct
GKEEGK

SEQ ID NO: 12680 - protein, 6 aa, synthetic construct
  REGION 1..6: note = Synthetic Construct
GKEEHK

SEQ ID NO: 12681 - protein, 6 aa, synthetic construct
  REGION 1..6: note = Synthetic Construct
GKEEIK

SEQ ID NO: 12682 - protein, 6 aa, synthetic construct
  REGION 1..6: note = Synthetic Construct
GKEELK

SEQ ID NO: 12683 - protein, 6 aa, synthetic construct
  REGION 1..6: note = Synthetic Construct
GKEENK

SEQ ID NO: 12684 - protein, 6 aa, synthetic construct
  REGION 1..6: note = Synthetic Construct
GKEEQK

SEQ ID NO: 12685 - protein, 6 aa, synthetic construct
  REGION 1..6: note = Synthetic Construct
GKEERK

SEQ ID NO: 12686 - protein, 6 aa, synthetic construct
  REGION 1..6: note = Synthetic Construct
GKEESK

SEQ ID NO: 12687 - protein, 6 aa, synthetic construct
  REGION 1..6: note = Synthetic Construct
GKEETK

SEQ ID NO: 12688 - protein, 6 aa, synthetic construct
  REGION 1..6: note = Synthetic Construct
GKEEYK

SEQ ID NO: 12689 - protein, 6 aa, synthetic construct
  REGION 1..6: note = Synthetic Construct
GKEFAK

SEQ ID NO: 12690 - protein, 6 aa, synthetic construct
  REGION 1..6: note = Synthetic Construct
GKEFDK

SEQ ID NO: 12691 - protein, 6 aa, synthetic construct
  REGION 1..6: note = Synthetic Construct
GKEFEK

SEQ ID NO: 12692 - protein, 6 aa, synthetic construct
  REGION 1..6: note = Synthetic Construct
GKEFFK

SEQ ID NO: 12693 - protein, 6 aa, synthetic construct
  REGION 1..6: note = Synthetic Construct
GKEFGK

SEQ ID NO: 12694 - protein, 6 aa, synthetic construct
  REGION 1..6: note = Synthetic Construct
GKEFHK

SEQ ID NO: 12695 - protein, 6 aa, synthetic construct
  REGION 1..6: note = Synthetic Construct
GKEFIK

SEQ ID NO: 12696 - protein, 6 aa, synthetic construct
  REGION 1..6: note = Synthetic Construct
GKEFLK

SEQ ID NO: 12697 - protein, 6 aa, synthetic construct
  REGION 1..6: note = Synthetic Construct
GKEFNK

SEQ ID NO: 12698 - protein, 6 aa, synthetic construct
  REGION 1..6: note = Synthetic Construct
GKEFQK

SEQ ID NO: 12699 - protein, 6 aa, synthetic construct
  REGION 1..6: note = Synthetic Construct
GKEFRK

SEQ ID NO: 12700 - protein, 6 aa, synthetic construct
  REGION 1..6: note = Synthetic Construct
GKEFSK

SEQ ID NO: 12701 - protein, 6 aa, synthetic construct
  REGION 1..6: note = Synthetic Construct
GKEFTK

SEQ ID NO: 12702 - protein, 6 aa, synthetic construct
  REGION 1..6: note = Synthetic Construct
GKEFYK

SEQ ID NO: 12703 - protein, 6 aa, synthetic construct
  REGION 1..6: note = Synthetic Construct
GKEGAK

SEQ ID NO: 12704 - protein, 6 aa, synthetic construct
  REGION 1..6: note = Synthetic Construct
GKEGDK

SEQ ID NO: 12705 - protein, 6 aa, synthetic construct
  REGION 1..6: note = Synthetic Construct
GKEGEK

SEQ ID NO: 12706 - protein, 6 aa, synthetic construct
  REGION 1..6: note = Synthetic Construct
GKEGFK

SEQ ID NO: 12707 - protein, 6 aa, synthetic construct
  REGION 1..6: note = Synthetic Construct
GKEGGK

SEQ ID NO: 12708 - protein, 6 aa, synthetic construct
  REGION 1..6: note = Synthetic Construct
GKEGHK

SEQ ID NO: 12709 - protein, 6 aa, synthetic construct
  REGION 1..6: note = Synthetic Construct
GKEGIK

SEQ ID NO: 12710 - protein, 6 aa, synthetic construct
  REGION 1..6: note = Synthetic Construct
GKEGLK

SEQ ID NO: 12711 - protein, 6 aa, synthetic construct
  REGION 1..6: note = Synthetic Construct
GKEGNK

SEQ ID NO: 12712 - protein, 6 aa, synthetic construct
  REGION 1..6: note = Synthetic Construct
GKEGQK

SEQ ID NO: 12713 - protein, 6 aa, synthetic construct
  REGION 1..6: note = Synthetic Construct
GKEGRK

SEQ ID NO: 12714 - protein, 6 aa, synthetic construct
  REGION 1..6: note = Synthetic Construct
GKEGSK

SEQ ID NO: 12715 - protein, 6 aa, synthetic construct
  REGION 1..6: note = Synthetic Construct
GKEGTK

SEQ ID NO: 12716 - protein, 6 aa, synthetic construct
  REGION 1..6: note = Synthetic Construct
GKEGYK

SEQ ID NO: 12717 - protein, 6 aa, synthetic construct
  REGION 1..6: note = Synthetic Construct
GKEHAK

SEQ ID NO: 12718 - protein, 6 aa, synthetic construct
  REGION 1..6: note = Synthetic Construct
GKEHDK

SEQ ID NO: 12719 - protein, 6 aa, synthetic construct
  REGION 1..6: note = Synthetic Construct
GKEHEK

SEQ ID NO: 12720 - protein, 6 aa, synthetic construct
  REGION 1..6: note = Synthetic Construct
GKEHFK

SEQ ID NO: 12721 - protein, 6 aa, synthetic construct
  REGION 1..6: note = Synthetic Construct
GKEHGK

SEQ ID NO: 12722 - protein, 6 aa, synthetic construct
  REGION 1..6: note = Synthetic Construct
GKEHHK

SEQ ID NO: 12723 - protein, 6 aa, synthetic construct
  REGION 1..6: note = Synthetic Construct
GKEHIK

SEQ ID NO: 12724 - protein, 6 aa, synthetic construct
  REGION 1..6: note = Synthetic Construct
GKEHLK

SEQ ID NO: 12725 - protein, 6 aa, synthetic construct
  REGION 1..6: note = Synthetic Construct
GKEHNK

SEQ ID NO: 12726 - protein, 6 aa, synthetic construct
  REGION 1..6: note = Synthetic Construct
GKEHQK

SEQ ID NO: 12727 - protein, 6 aa, synthetic construct
  REGION 1..6: note = Synthetic Construct
GKEHRK

SEQ ID NO: 12728 - protein, 6 aa, synthetic construct
  REGION 1..6: note = Synthetic Construct
GKEHSK

SEQ ID NO: 12729 - protein, 6 aa, synthetic construct
  REGION 1..6: note = Synthetic Construct
GKEHTK

SEQ ID NO: 12730 - protein, 6 aa, synthetic construct
  REGION 1..6: note = Synthetic Construct
GKEHYK

SEQ ID NO: 12731 - protein, 6 aa, synthetic construct
  REGION 1..6: note = Synthetic Construct
GKEIAK

SEQ ID NO: 12732 - protein, 6 aa, synthetic construct
  REGION 1..6: note = Synthetic Construct
GKEIDK

SEQ ID NO: 12733 - protein, 6 aa, synthetic construct
  REGION 1..6: note = Synthetic Construct
GKEIEK

SEQ ID NO: 12734 - protein, 6 aa, synthetic construct
  REGION 1..6: note = Synthetic Construct
GKEIFK

SEQ ID NO: 12735 - protein, 6 aa, synthetic construct
  REGION 1..6: note = Synthetic Construct
GKEIGK

SEQ ID NO: 12736 - protein, 6 aa, synthetic construct
  REGION 1..6: note = Synthetic Construct
GKEIHK

SEQ ID NO: 12737 - protein, 6 aa, synthetic construct
  REGION 1..6: note = Synthetic Construct
GKEIIK

SEQ ID NO: 12738 - protein, 6 aa, synthetic construct
  REGION 1..6: note = Synthetic Construct
GKEILK

SEQ ID NO: 12739 - protein, 6 aa, synthetic construct
  REGION 1..6: note = Synthetic Construct
GKEINK

SEQ ID NO: 12740 - protein, 6 aa, synthetic construct
  REGION 1..6: note = Synthetic Construct
GKEIQK

SEQ ID NO: 12741 - protein, 6 aa, synthetic construct
  REGION 1..6: note = Synthetic Construct
GKEIRK

SEQ ID NO: 12742 - protein, 6 aa, synthetic construct
  REGION 1..6: note = Synthetic Construct
GKEISK

SEQ ID NO: 12743 - protein, 6 aa, synthetic construct
  REGION 1..6: note = Synthetic Construct
GKEITK

SEQ ID NO: 12744 - protein, 6 aa, synthetic construct
  REGION 1..6: note = Synthetic Construct
GKEIYK

SEQ ID NO: 12745 - protein, 6 aa, synthetic construct
  REGION 1..6: note = Synthetic Construct
GKELAK

SEQ ID NO: 12746 - protein, 6 aa, synthetic construct
  REGION 1..6: note = Synthetic Construct
GKELDK

SEQ ID NO: 12747 - protein, 6 aa, synthetic construct
  REGION 1..6: note = Synthetic Construct
GKELEK

SEQ ID NO: 12748 - protein, 6 aa, synthetic construct
  REGION 1..6: note = Synthetic Construct
GKELFK

SEQ ID NO: 12749 - protein, 6 aa, synthetic construct
  REGION 1..6: note = Synthetic Construct
GKELGK

SEQ ID NO: 12750 - protein, 6 aa, synthetic construct
  REGION 1..6: note = Synthetic Construct
GKELHK

SEQ ID NO: 12751 - protein, 6 aa, synthetic construct
  REGION 1..6: note = Synthetic Construct
GKELIK

SEQ ID NO: 12752 - protein, 6 aa, synthetic construct
  REGION 1..6: note = Synthetic Construct
GKELLK

SEQ ID NO: 12753 - protein, 6 aa, synthetic construct
  REGION 1..6: note = Synthetic Construct
GKELNK

SEQ ID NO: 12754 - protein, 6 aa, synthetic construct
  REGION 1..6: note = Synthetic Construct
GKELQK

SEQ ID NO: 12755 - protein, 6 aa, synthetic construct
  REGION 1..6: note = Synthetic Construct
GKELRK

SEQ ID NO: 12756 - protein, 6 aa, synthetic construct
  REGION 1..6: note = Synthetic Construct
GKELSK

SEQ ID NO: 12757 - protein, 6 aa, synthetic construct
  REGION 1..6: note = Synthetic Construct
GKELTK

SEQ ID NO: 12758 - protein, 6 aa, synthetic construct
  REGION 1..6: note = Synthetic Construct
GKELYK

SEQ ID NO: 12759 - protein, 6 aa, synthetic construct
  REGION 1..6: note = Synthetic Construct
GKENAK

SEQ ID NO: 12760 - protein, 6 aa, synthetic construct
  REGION 1..6: note = Synthetic Construct
GKENDK

SEQ ID NO: 12761 - protein, 6 aa, synthetic construct
  REGION 1..6: note = Synthetic Construct
GKENEK

SEQ ID NO: 12762 - protein, 6 aa, synthetic construct
  REGION 1..6: note = Synthetic Construct
GKENFK

SEQ ID NO: 12763 - protein, 6 aa, synthetic construct
  REGION 1..6: note = Synthetic Construct
GKENGK

SEQ ID NO: 12764 - protein, 6 aa, synthetic construct
  REGION 1..6: note = Synthetic Construct
GKENHK

SEQ ID NO: 12765 - protein, 6 aa, synthetic construct
  REGION 1..6: note = Synthetic Construct
GKENIK

SEQ ID NO: 12766 - protein, 6 aa, synthetic construct
  REGION 1..6: note = Synthetic Construct
GKENLK

SEQ ID NO: 12767 - protein, 6 aa, synthetic construct
  REGION 1..6: note = Synthetic Construct
GKENNK

SEQ ID NO: 12768 - protein, 6 aa, synthetic construct
  REGION 1..6: note = Synthetic Construct
GKENQK

SEQ ID NO: 12769 - protein, 6 aa, synthetic construct
  REGION 1..6: note = Synthetic Construct
GKENRK

SEQ ID NO: 12770 - protein, 6 aa, synthetic construct
  REGION 1..6: note = Synthetic Construct
GKENSK

SEQ ID NO: 12771 - protein, 6 aa, synthetic construct
  REGION 1..6: note = Synthetic Construct
GKENTK

SEQ ID NO: 12772 - protein, 6 aa, synthetic construct
  REGION 1..6: note = Synthetic Construct
GKENYK

SEQ ID NO: 12773 - protein, 6 aa, synthetic construct
  REGION 1..6: note = Synthetic Construct
GKEQAK

SEQ ID NO: 12774 - protein, 6 aa, synthetic construct
  REGION 1..6: note = Synthetic Construct
GKEQDK

SEQ ID NO: 12775 - protein, 6 aa, synthetic construct
  REGION 1..6: note = Synthetic Construct
GKEQEK

SEQ ID NO: 12776 - protein, 6 aa, synthetic construct
  REGION 1..6: note = Synthetic Construct
GKEQFK

SEQ ID NO: 12777 - protein, 6 aa, synthetic construct
  REGION 1..6: note = Synthetic Construct
GKEQGK

SEQ ID NO: 12778 - protein, 6 aa, synthetic construct
  REGION 1..6: note = Synthetic Construct
GKEQHK

SEQ ID NO: 12779 - protein, 6 aa, synthetic construct
  REGION 1..6: note = Synthetic Construct
GKEQIK

SEQ ID NO: 12780 - protein, 6 aa, synthetic construct
  REGION 1..6: note = Synthetic Construct
GKEQLK

SEQ ID NO: 12781 - protein, 6 aa, synthetic construct
  REGION 1..6: note = Synthetic Construct
GKEQNK

SEQ ID NO: 12782 - protein, 6 aa, synthetic construct
  REGION 1..6: note = Synthetic Construct
GKEQQK

SEQ ID NO: 12783 - protein, 6 aa, synthetic construct
  REGION 1..6: note = Synthetic Construct
GKEQRK

SEQ ID NO: 12784 - protein, 6 aa, synthetic construct
  REGION 1..6: note = Synthetic Construct
GKEQSK

SEQ ID NO: 12785 - protein, 6 aa, synthetic construct
  REGION 1..6: note = Synthetic Construct
GKEQTK

SEQ ID NO: 12786 - protein, 6 aa, synthetic construct
  REGION 1..6: note = Synthetic Construct
GKEQYK

SEQ ID NO: 12787 - protein, 6 aa, synthetic construct
  REGION 1..6: note = Synthetic Construct
GKERAK

SEQ ID NO: 12788 - protein, 6 aa, synthetic construct
  REGION 1..6: note = Synthetic Construct
GKERDK

SEQ ID NO: 12789 - protein, 6 aa, synthetic construct
  REGION 1..6: note = Synthetic Construct
GKEREK

SEQ ID NO: 12790 - protein, 6 aa, synthetic construct
  REGION 1..6: note = Synthetic Construct
GKERFK

SEQ ID NO: 12791 - protein, 6 aa, synthetic construct
  REGION 1..6: note = Synthetic Construct
GKERGK

SEQ ID NO: 12792 - protein, 6 aa, synthetic construct
  REGION 1..6: note = Synthetic Construct
GKERHK

SEQ ID NO: 12793 - protein, 6 aa, synthetic construct
  REGION 1..6: note = Synthetic Construct
GKERIK

SEQ ID NO: 12794 - protein, 6 aa, synthetic construct
  REGION 1..6: note = Synthetic Construct
GKERLK

SEQ ID NO: 12795 - protein, 6 aa, synthetic construct
  REGION 1..6: note = Synthetic Construct
GKERNK

SEQ ID NO: 12796 - protein, 6 aa, synthetic construct
  REGION 1..6: note = Synthetic Construct
GKERQK

SEQ ID NO: 12797 - protein, 6 aa, synthetic construct
  REGION 1..6: note = Synthetic Construct
GKERRK

SEQ ID NO: 12798 - protein, 6 aa, synthetic construct
  REGION 1..6: note = Synthetic Construct
GKERSK

SEQ ID NO: 12799 - protein, 6 aa, synthetic construct
  REGION 1..6: note = Synthetic Construct
GKERTK

SEQ ID NO: 12800 - protein, 6 aa, synthetic construct
  REGION 1..6: note = Synthetic Construct
GKERYK

SEQ ID NO: 12801 - protein, 6 aa, synthetic construct
  REGION 1..6: note = Synthetic Construct
GKESAK

SEQ ID NO: 12802 - protein, 6 aa, synthetic construct
  REGION 1..6: note = Synthetic Construct
GKESDK

SEQ ID NO: 12803 - protein, 6 aa, synthetic construct
  REGION 1..6: note = Synthetic Construct
GKESEK

SEQ ID NO: 12804 - protein, 6 aa, synthetic construct
  REGION 1..6: note = Synthetic Construct
GKESFK

SEQ ID NO: 12805 - protein, 6 aa, synthetic construct
  REGION 1..6: note = Synthetic Construct
GKESGK

SEQ ID NO: 12806 - protein, 6 aa, synthetic construct
  REGION 1..6: note = Synthetic Construct
GKESHK

SEQ ID NO: 12807 - protein, 6 aa, synthetic construct
  REGION 1..6: note = Synthetic Construct
GKESIK

SEQ ID NO: 12808 - protein, 6 aa, synthetic construct
  REGION 1..6: note = Synthetic Construct
GKESLK

SEQ ID NO: 12809 - protein, 6 aa, synthetic construct
  REGION 1..6: note = Synthetic Construct
GKESNK

SEQ ID NO: 12810 - protein, 6 aa, synthetic construct
  REGION 1..6: note = Synthetic Construct
GKESQK

SEQ ID NO: 12811 - protein, 6 aa, synthetic construct
  REGION 1..6: note = Synthetic Construct
GKESRK

SEQ ID NO: 12812 - protein, 6 aa, synthetic construct
  REGION 1..6: note = Synthetic Construct
GKESSK

SEQ ID NO: 12813 - protein, 6 aa, synthetic construct
  REGION 1..6: note = Synthetic Construct
GKESTK

SEQ ID NO: 12814 - protein, 6 aa, synthetic construct
  REGION 1..6: note = Synthetic Construct
GKESYK

SEQ ID NO: 12815 - protein, 6 aa, synthetic construct
  REGION 1..6: note = Synthetic Construct
GKETAK

SEQ ID NO: 12816 - protein, 6 aa, synthetic construct
  REGION 1..6: note = Synthetic Construct
GKETDK

SEQ ID NO: 12817 - protein, 6 aa, synthetic construct
  REGION 1..6: note = Synthetic Construct
GKETEK

SEQ ID NO: 12818 - protein, 6 aa, synthetic construct
  REGION 1..6: note = Synthetic Construct
GKETFK

SEQ ID NO: 12819 - protein, 6 aa, synthetic construct
  REGION 1..6: note = Synthetic Construct
GKETGK

SEQ ID NO: 12820 - protein, 6 aa, synthetic construct
  REGION 1..6: note = Synthetic Construct
GKETHK

SEQ ID NO: 12821 - protein, 6 aa, synthetic construct
  REGION 1..6: note = Synthetic Construct
GKETIK

SEQ ID NO: 12822 - protein, 6 aa, synthetic construct
  REGION 1..6: note = Synthetic Construct
GKETLK

SEQ ID NO: 12823 - protein, 6 aa, synthetic construct
  REGION 1..6: note = Synthetic Construct
GKETNK

SEQ ID NO: 12824 - protein, 6 aa, synthetic construct
  REGION 1..6: note = Synthetic Construct
GKETQK

SEQ ID NO: 12825 - protein, 6 aa, synthetic construct
  REGION 1..6: note = Synthetic Construct
GKETRK

SEQ ID NO: 12826 - protein, 6 aa, synthetic construct
  REGION 1..6: note = Synthetic Construct
GKETSK

SEQ ID NO: 12827 - protein, 6 aa, synthetic construct
  REGION 1..6: note = Synthetic Construct
GKETTK

SEQ ID NO: 12828 - protein, 6 aa, synthetic construct
  REGION 1..6: note = Synthetic Construct
GKETYK

SEQ ID NO: 12829 - protein, 6 aa, synthetic construct
  REGION 1..6: note = Synthetic Construct
GKEYAK

SEQ ID NO: 12830 - protein, 6 aa, synthetic construct
  REGION 1..6: note = Synthetic Construct
GKEYDK

SEQ ID NO: 12831 - protein, 6 aa, synthetic construct
  REGION 1..6: note = Synthetic Construct
GKEYEK

SEQ ID NO: 12832 - protein, 6 aa, synthetic construct
  REGION 1..6: note = Synthetic Construct
GKEYFK

SEQ ID NO: 12833 - protein, 6 aa, synthetic construct
  REGION 1..6: note = Synthetic Construct
GKEYGK

SEQ ID NO: 12834 - protein, 6 aa, synthetic construct
  REGION 1..6: note = Synthetic Construct
GKEYHK

SEQ ID NO: 12835 - protein, 6 aa, synthetic construct
  REGION 1..6: note = Synthetic Construct
GKEYIK

SEQ ID NO: 12836 - protein, 6 aa, synthetic construct
  REGION 1..6: note = Synthetic Construct
GKEYLK

SEQ ID NO: 12837 - protein, 6 aa, synthetic construct
  REGION 1..6: note = Synthetic Construct
GKEYNK

SEQ ID NO: 12838 - protein, 6 aa, synthetic construct
  REGION 1..6: note = Synthetic Construct
GKEYQK

SEQ ID NO: 12839 - protein, 6 aa, synthetic construct
  REGION 1..6: note = Synthetic Construct
GKEYRK

SEQ ID NO: 12840 - protein, 6 aa, synthetic construct
  REGION 1..6: note = Synthetic Construct
GKEYSK

SEQ ID NO: 12841 - protein, 6 aa, synthetic construct
  REGION 1..6: note = Synthetic Construct
GKEYTK

SEQ ID NO: 12842 - protein, 6 aa, synthetic construct
  REGION 1..6: note = Synthetic Construct
GKEYYK

SEQ ID NO: 12843 - protein, 6 aa, synthetic construct
  REGION 1..6: note = Synthetic Construct
GKFAAK

SEQ ID NO: 12844 - protein, 6 aa, synthetic construct
  REGION 1..6: note = Synthetic Construct
GKFADK

SEQ ID NO: 12845 - protein, 6 aa, synthetic construct
  REGION 1..6: note = Synthetic Construct
GKFAEK

SEQ ID NO: 12846 - protein, 6 aa, synthetic construct
  REGION 1..6: note = Synthetic Construct
GKFAFK

SEQ ID NO: 12847 - protein, 6 aa, synthetic construct
  REGION 1..6: note = Synthetic Construct
GKFAGK

SEQ ID NO: 12848 - protein, 6 aa, synthetic construct
  REGION 1..6: note = Synthetic Construct
GKFAHK

SEQ ID NO: 12849 - protein, 6 aa, synthetic construct
  REGION 1..6: note = Synthetic Construct
GKFAIK

SEQ ID NO: 12850 - protein, 6 aa, synthetic construct
  REGION 1..6: note = Synthetic Construct
GKFALK

SEQ ID NO: 12851 - protein, 6 aa, synthetic construct
  REGION 1..6: note = Synthetic Construct
GKFANK

SEQ ID NO: 12852 - protein, 6 aa, synthetic construct
  REGION 1..6: note = Synthetic Construct
GKFAQK

SEQ ID NO: 12853 - protein, 6 aa, synthetic construct
  REGION 1..6: note = Synthetic Construct
GKFARK

SEQ ID NO: 12854 - protein, 6 aa, synthetic construct
  REGION 1..6: note = Synthetic Construct
GKFASK

SEQ ID NO: 12855 - protein, 6 aa, synthetic construct
  REGION 1..6: note = Synthetic Construct
GKFATK

SEQ ID NO: 12856 - protein, 6 aa, synthetic construct
  REGION 1..6: note = Synthetic Construct
GKFAYK

SEQ ID NO: 12857 - protein, 6 aa, synthetic construct
  REGION 1..6: note = Synthetic Construct
GKFDAK

SEQ ID NO: 12858 - protein, 6 aa, synthetic construct
  REGION 1..6: note = Synthetic Construct
GKFDDK

SEQ ID NO: 12859 - protein, 6 aa, synthetic construct
  REGION 1..6: note = Synthetic Construct
GKFDEK

SEQ ID NO: 12860 - protein, 6 aa, synthetic construct
  REGION 1..6: note = Synthetic Construct
GKFDFK

SEQ ID NO: 12861 - protein, 6 aa, synthetic construct
  REGION 1..6: note = Synthetic Construct
GKFDGK

SEQ ID NO: 12862 - protein, 6 aa, synthetic construct
  REGION 1..6: note = Synthetic Construct
GKFDHK

SEQ ID NO: 12863 - protein, 6 aa, synthetic construct
  REGION 1..6: note = Synthetic Construct
GKFDIK

SEQ ID NO: 12864 - protein, 6 aa, synthetic construct
  REGION 1..6: note = Synthetic Construct
GKFDLK

SEQ ID NO: 12865 - protein, 6 aa, synthetic construct
  REGION 1..6: note = Synthetic Construct
GKFDNK

SEQ ID NO: 12866 - protein, 6 aa, synthetic construct
  REGION 1..6: note = Synthetic Construct
GKFDQK

SEQ ID NO: 12867 - protein, 6 aa, synthetic construct
  REGION 1..6: note = Synthetic Construct
GKFDRK

SEQ ID NO: 12868 - protein, 6 aa, synthetic construct
  REGION 1..6: note = Synthetic Construct
GKFDSK

SEQ ID NO: 12869 - protein, 6 aa, synthetic construct
  REGION 1..6: note = Synthetic Construct
GKFDTK

SEQ ID NO: 12870 - protein, 6 aa, synthetic construct
  REGION 1..6: note = Synthetic Construct
GKFDYK

SEQ ID NO: 12871 - protein, 6 aa, synthetic construct
  REGION 1..6: note = Synthetic Construct
GKFEAK

SEQ ID NO: 12872 - protein, 6 aa, synthetic construct
  REGION 1..6: note = Synthetic Construct
GKFEDK

SEQ ID NO: 12873 - protein, 6 aa, synthetic construct
  REGION 1..6: note = Synthetic Construct
GKFEEK

SEQ ID NO: 12874 - protein, 6 aa, synthetic construct
  REGION 1..6: note = Synthetic Construct
GKFEFK

SEQ ID NO: 12875 - protein, 6 aa, synthetic construct
  REGION 1..6: note = Synthetic Construct
GKFEGK

SEQ ID NO: 12876 - protein, 6 aa, synthetic construct
  REGION 1..6: note = Synthetic Construct
GKFEHK

SEQ ID NO: 12877 - protein, 6 aa, synthetic construct
  REGION 1..6: note = Synthetic Construct
GKFEIK

SEQ ID NO: 12878 - protein, 6 aa, synthetic construct
  REGION 1..6: note = Synthetic Construct
GKFELK

SEQ ID NO: 12879 - protein, 6 aa, synthetic construct
  REGION 1..6: note = Synthetic Construct
GKFENK

SEQ ID NO: 12880 - protein, 6 aa, synthetic construct
  REGION 1..6: note = Synthetic Construct
GKFEQK

SEQ ID NO: 12881 - protein, 6 aa, synthetic construct
  REGION 1..6: note = Synthetic Construct
GKFERK

SEQ ID NO: 12882 - protein, 6 aa, synthetic construct
  REGION 1..6: note = Synthetic Construct
GKFESK

SEQ ID NO: 12883 - protein, 6 aa, synthetic construct
  REGION 1..6: note = Synthetic Construct
GKFETK

SEQ ID NO: 12884 - protein, 6 aa, synthetic construct
  REGION 1..6: note = Synthetic Construct
GKFEYK

SEQ ID NO: 12885 - protein, 6 aa, synthetic construct
  REGION 1..6: note = Synthetic Construct
GKFFAK

SEQ ID NO: 12886 - protein, 6 aa, synthetic construct
  REGION 1..6: note = Synthetic Construct
GKFFDK

SEQ ID NO: 12887 - protein, 6 aa, synthetic construct
  REGION 1..6: note = Synthetic Construct
GKFFEK

SEQ ID NO: 12888 - protein, 6 aa, synthetic construct
  REGION 1..6: note = Synthetic Construct
GKFFFK

SEQ ID NO: 12889 - protein, 6 aa, synthetic construct
  REGION 1..6: note = Synthetic Construct
GKFFGK

SEQ ID NO: 12890 - protein, 6 aa, synthetic construct
  REGION 1..6: note = Synthetic Construct
GKFFHK

SEQ ID NO: 12891 - protein, 6 aa, synthetic construct
  REGION 1..6: note = Synthetic Construct
GKFFIK

SEQ ID NO: 12892 - protein, 6 aa, synthetic construct
  REGION 1..6: note = Synthetic Construct
GKFFLK

SEQ ID NO: 12893 - protein, 6 aa, synthetic construct
  REGION 1..6: note = Synthetic Construct
GKFFNK

SEQ ID NO: 12894 - protein, 6 aa, synthetic construct
  REGION 1..6: note = Synthetic Construct
GKFFQK

SEQ ID NO: 12895 - protein, 6 aa, synthetic construct
  REGION 1..6: note = Synthetic Construct
GKFFRK

SEQ ID NO: 12896 - protein, 6 aa, synthetic construct
  REGION 1..6: note = Synthetic Construct
GKFFSK

SEQ ID NO: 12897 - protein, 6 aa, synthetic construct
  REGION 1..6: note = Synthetic Construct
GKFFTK

SEQ ID NO: 12898 - protein, 6 aa, synthetic construct
  REGION 1..6: note = Synthetic Construct
GKFFYK

SEQ ID NO: 12899 - protein, 6 aa, synthetic construct
  REGION 1..6: note = Synthetic Construct
GKFGAK

SEQ ID NO: 12900 - protein, 6 aa, synthetic construct
  REGION 1..6: note = Synthetic Construct
GKFGDK

SEQ ID NO: 12901 - protein, 6 aa, synthetic construct
  REGION 1..6: note = Synthetic Construct
GKFGEK

SEQ ID NO: 12902 - protein, 6 aa, synthetic construct
  REGION 1..6: note = Synthetic Construct
GKFGFK

SEQ ID NO: 12903 - protein, 6 aa, synthetic construct
  REGION 1..6: note = Synthetic Construct
GKFGGK

SEQ ID NO: 12904 - protein, 6 aa, synthetic construct
  REGION 1..6: note = Synthetic Construct
GKFGHK

SEQ ID NO: 12905 - protein, 6 aa, synthetic construct
  REGION 1..6: note = Synthetic Construct
GKFGIK

SEQ ID NO: 12906 - protein, 6 aa, synthetic construct
  REGION 1..6: note = Synthetic Construct
GKFGLK

SEQ ID NO: 12907 - protein, 6 aa, synthetic construct
  REGION 1..6: note = Synthetic Construct
GKFGNK

SEQ ID NO: 12908 - protein, 6 aa, synthetic construct
  REGION 1..6: note = Synthetic Construct
GKFGQK

SEQ ID NO: 12909 - protein, 6 aa, synthetic construct
  REGION 1..6: note = Synthetic Construct
GKFGRK

SEQ ID NO: 12910 - protein, 6 aa, synthetic construct
  REGION 1..6: note = Synthetic Construct
GKFGSK

SEQ ID NO: 12911 - protein, 6 aa, synthetic construct
  REGION 1..6: note = Synthetic Construct
GKFGTK

SEQ ID NO: 12912 - protein, 6 aa, synthetic construct
  REGION 1..6: note = Synthetic Construct
GKFGYK

SEQ ID NO: 12913 - protein, 6 aa, synthetic construct
  REGION 1..6: note = Synthetic Construct
GKFHAK

SEQ ID NO: 12914 - protein, 6 aa, synthetic construct
  REGION 1..6: note = Synthetic Construct
GKFHDK

SEQ ID NO: 12915 - protein, 6 aa, synthetic construct
  REGION 1..6: note = Synthetic Construct
GKFHEK

SEQ ID NO: 12916 - protein, 6 aa, synthetic construct
  REGION 1..6: note = Synthetic Construct
GKFHFK

SEQ ID NO: 12917 - protein, 6 aa, synthetic construct
  REGION 1..6: note = Synthetic Construct
GKFHGK

SEQ ID NO: 12918 - protein, 6 aa, synthetic construct
  REGION 1..6: note = Synthetic Construct
GKFHHK

SEQ ID NO: 12919 - protein, 6 aa, synthetic construct
  REGION 1..6: note = Synthetic Construct
GKFHIK

SEQ ID NO: 12920 - protein, 6 aa, synthetic construct
  REGION 1..6: note = Synthetic Construct
GKFHLK

SEQ ID NO: 12921 - protein, 6 aa, synthetic construct
  REGION 1..6: note = Synthetic Construct
GKFHNK

SEQ ID NO: 12922 - protein, 6 aa, synthetic construct
  REGION 1..6: note = Synthetic Construct
GKFHQK

SEQ ID NO: 12923 - protein, 6 aa, synthetic construct
  REGION 1..6: note = Synthetic Construct
GKFHRK

SEQ ID NO: 12924 - protein, 6 aa, synthetic construct
  REGION 1..6: note = Synthetic Construct
GKFHSK

SEQ ID NO: 12925 - protein, 6 aa, synthetic construct
  REGION 1..6: note = Synthetic Construct
GKFHTK

SEQ ID NO: 12926 - protein, 6 aa, synthetic construct
  REGION 1..6: note = Synthetic Construct
GKFHYK

SEQ ID NO: 12927 - protein, 6 aa, synthetic construct
  REGION 1..6: note = Synthetic Construct
GKFIAK

SEQ ID NO: 12928 - protein, 6 aa, synthetic construct
  REGION 1..6: note = Synthetic Construct
GKFIDK

SEQ ID NO: 12929 - protein, 6 aa, synthetic construct
  REGION 1..6: note = Synthetic Construct
GKFIEK

SEQ ID NO: 12930 - protein, 6 aa, synthetic construct
  REGION 1..6: note = Synthetic Construct
GKFIFK

SEQ ID NO: 12931 - protein, 6 aa, synthetic construct
  REGION 1..6: note = Synthetic Construct
GKFIGK

SEQ ID NO: 12932 - protein, 6 aa, synthetic construct
  REGION 1..6: note = Synthetic Construct
GKFIHK

SEQ ID NO: 12933 - protein, 6 aa, synthetic construct
  REGION 1..6: note = Synthetic Construct
GKFIIK

SEQ ID NO: 12934 - protein, 6 aa, synthetic construct
  REGION 1..6: note = Synthetic Construct
GKFILK

SEQ ID NO: 12935 - protein, 6 aa, synthetic construct
  REGION 1..6: note = Synthetic Construct
GKFINK

SEQ ID NO: 12936 - protein, 6 aa, synthetic construct
  REGION 1..6: note = Synthetic Construct
GKFIQK

SEQ ID NO: 12937 - protein, 6 aa, synthetic construct
  REGION 1..6: note = Synthetic Construct
GKFIRK

SEQ ID NO: 12938 - protein, 6 aa, synthetic construct
  REGION 1..6: note = Synthetic Construct
GKFISK

SEQ ID NO: 12939 - protein, 6 aa, synthetic construct
  REGION 1..6: note = Synthetic Construct
GKFITK

SEQ ID NO: 12940 - protein, 6 aa, synthetic construct
  REGION 1..6: note = Synthetic Construct
GKFIYK

SEQ ID NO: 12941 - protein, 6 aa, synthetic construct
  REGION 1..6: note = Synthetic Construct
GKFLAK

SEQ ID NO: 12942 - protein, 6 aa, synthetic construct
  REGION 1..6: note = Synthetic Construct
GKFLDK

SEQ ID NO: 12943 - protein, 6 aa, synthetic construct
  REGION 1..6: note = Synthetic Construct
GKFLEK

SEQ ID NO: 12944 - protein, 6 aa, synthetic construct
  REGION 1..6: note = Synthetic Construct
GKFLFK

SEQ ID NO: 12945 - protein, 6 aa, synthetic construct
  REGION 1..6: note = Synthetic Construct
GKFLGK

SEQ ID NO: 12946 - protein, 6 aa, synthetic construct
  REGION 1..6: note = Synthetic Construct
GKFLHK

SEQ ID NO: 12947 - protein, 6 aa, synthetic construct
  REGION 1..6: note = Synthetic Construct
GKFLIK

SEQ ID NO: 12948 - protein, 6 aa, synthetic construct
  REGION 1..6: note = Synthetic Construct
GKFLLK

SEQ ID NO: 12949 - protein, 6 aa, synthetic construct
  REGION 1..6: note = Synthetic Construct
GKFLNK

SEQ ID NO: 12950 - protein, 6 aa, synthetic construct
  REGION 1..6: note = Synthetic Construct
GKFLQK

SEQ ID NO: 12951 - protein, 6 aa, synthetic construct
  REGION 1..6: note = Synthetic Construct
GKFLRK

SEQ ID NO: 12952 - protein, 6 aa, synthetic construct
  REGION 1..6: note = Synthetic Construct
GKFLSK

SEQ ID NO: 12953 - protein, 6 aa, synthetic construct
  REGION 1..6: note = Synthetic Construct
GKFLTK

SEQ ID NO: 12954 - protein, 6 aa, synthetic construct
  REGION 1..6: note = Synthetic Construct
GKFLYK

SEQ ID NO: 12955 - protein, 6 aa, synthetic construct
  REGION 1..6: note = Synthetic Construct
GKFNAK

SEQ ID NO: 12956 - protein, 6 aa, synthetic construct
  REGION 1..6: note = Synthetic Construct
GKFNDK

SEQ ID NO: 12957 - protein, 6 aa, synthetic construct
  REGION 1..6: note = Synthetic Construct
GKFNEK

SEQ ID NO: 12958 - protein, 6 aa, synthetic construct
  REGION 1..6: note = Synthetic Construct
GKFNFK

SEQ ID NO: 12959 - protein, 6 aa, synthetic construct
  REGION 1..6: note = Synthetic Construct
GKFNGK

SEQ ID NO: 12960 - protein, 6 aa, synthetic construct
  REGION 1..6: note = Synthetic Construct
GKFNHK

SEQ ID NO: 12961 - protein, 6 aa, synthetic construct
  REGION 1..6: note = Synthetic Construct
GKFNIK

SEQ ID NO: 12962 - protein, 6 aa, synthetic construct
  REGION 1..6: note = Synthetic Construct
GKFNLK

SEQ ID NO: 12963 - protein, 6 aa, synthetic construct
  REGION 1..6: note = Synthetic Construct
GKFNNK

SEQ ID NO: 12964 - protein, 6 aa, synthetic construct
  REGION 1..6: note = Synthetic Construct
GKFNQK

SEQ ID NO: 12965 - protein, 6 aa, synthetic construct
  REGION 1..6: note = Synthetic Construct
GKFNRK

SEQ ID NO: 12966 - protein, 6 aa, synthetic construct
  REGION 1..6: note = Synthetic Construct
GKFNSK

SEQ ID NO: 12967 - protein, 6 aa, synthetic construct
  REGION 1..6: note = Synthetic Construct
GKFNTK

SEQ ID NO: 12968 - protein, 6 aa, synthetic construct
  REGION 1..6: note = Synthetic Construct
GKFNYK

SEQ ID NO: 12969 - protein, 6 aa, synthetic construct
  REGION 1..6: note = Synthetic Construct
GKFQAK

SEQ ID NO: 12970 - protein, 6 aa, synthetic construct
  REGION 1..6: note = Synthetic Construct
GKFQDK

SEQ ID NO: 12971 - protein, 6 aa, synthetic construct
  REGION 1..6: note = Synthetic Construct
GKFQEK

SEQ ID NO: 12972 - protein, 6 aa, synthetic construct
  REGION 1..6: note = Synthetic Construct
GKFQFK

SEQ ID NO: 12973 - protein, 6 aa, synthetic construct
  REGION 1..6: note = Synthetic Construct
GKFQGK

SEQ ID NO: 12974 - protein, 6 aa, synthetic construct
  REGION 1..6: note = Synthetic Construct
GKFQHK

SEQ ID NO: 12975 - protein, 6 aa, synthetic construct
  REGION 1..6: note = Synthetic Construct
GKFQIK

SEQ ID NO: 12976 - protein, 6 aa, synthetic construct
  REGION 1..6: note = Synthetic Construct
GKFQLK

SEQ ID NO: 12977 - protein, 6 aa, synthetic construct
  REGION 1..6: note = Synthetic Construct
GKFQNK

SEQ ID NO: 12978 - protein, 6 aa, synthetic construct
  REGION 1..6: note = Synthetic Construct
GKFQQK

SEQ ID NO: 12979 - protein, 6 aa, synthetic construct
  REGION 1..6: note = Synthetic Construct
GKFQRK

SEQ ID NO: 12980 - protein, 6 aa, synthetic construct
  REGION 1..6: note = Synthetic Construct
GKFQSK

SEQ ID NO: 12981 - protein, 6 aa, synthetic construct
  REGION 1..6: note = Synthetic Construct
GKFQTK

SEQ ID NO: 12982 - protein, 6 aa, synthetic construct
  REGION 1..6: note = Synthetic Construct
GKFQYK

SEQ ID NO: 12983 - protein, 6 aa, synthetic construct
  REGION 1..6: note = Synthetic Construct
GKFRAK

SEQ ID NO: 12984 - protein, 6 aa, synthetic construct
  REGION 1..6: note = Synthetic Construct
GKFRDK

SEQ ID NO: 12985 - protein, 6 aa, synthetic construct
  REGION 1..6: note = Synthetic Construct
GKFREK

SEQ ID NO: 12986 - protein, 6 aa, synthetic construct
  REGION 1..6: note = Synthetic Construct
GKFRFK

SEQ ID NO: 12987 - protein, 6 aa, synthetic construct
  REGION 1..6: note = Synthetic Construct
GKFRGK

SEQ ID NO: 12988 - protein, 6 aa, synthetic construct
  REGION 1..6: note = Synthetic Construct
GKFRHK

SEQ ID NO: 12989 - protein, 6 aa, synthetic construct
  REGION 1..6: note = Synthetic Construct
GKFRIK

SEQ ID NO: 12990 - protein, 6 aa, synthetic construct
  REGION 1..6: note = Synthetic Construct
GKFRLK

SEQ ID NO: 12991 - protein, 6 aa, synthetic construct
  REGION 1..6: note = Synthetic Construct
GKFRNK

SEQ ID NO: 12992 - protein, 6 aa, synthetic construct
  REGION 1..6: note = Synthetic Construct
GKFRQK

SEQ ID NO: 12993 - protein, 6 aa, synthetic construct
  REGION 1..6: note = Synthetic Construct
GKFRRK

SEQ ID NO: 12994 - protein, 6 aa, synthetic construct
  REGION 1..6: note = Synthetic Construct
GKFRSK

SEQ ID NO: 12995 - protein, 6 aa, synthetic construct
  REGION 1..6: note = Synthetic Construct
GKFRTK

SEQ ID NO: 12996 - protein, 6 aa, synthetic construct
  REGION 1..6: note = Synthetic Construct
GKFRYK

SEQ ID NO: 12997 - protein, 6 aa, synthetic construct
  REGION 1..6: note = Synthetic Construct
GKFSAK

SEQ ID NO: 12998 - protein, 6 aa, synthetic construct
  REGION 1..6: note = Synthetic Construct
GKFSDK

SEQ ID NO: 12999 - protein, 6 aa, synthetic construct
  REGION 1..6: note = Synthetic Construct
GKFSEK

SEQ ID NO: 13000 - protein, 6 aa, synthetic construct
  REGION 1..6: note = Synthetic Construct
GKFSFK

SEQ ID NO: 13001 - protein, 6 aa, synthetic construct
  REGION 1..6: note = Synthetic Construct
GKFSGK

SEQ ID NO: 13002 - protein, 6 aa, synthetic construct
  REGION 1..6: note = Synthetic Construct
GKFSHK

SEQ ID NO: 13003 - protein, 6 aa, synthetic construct
  REGION 1..6: note = Synthetic Construct
GKFSIK

SEQ ID NO: 13004 - protein, 6 aa, synthetic construct
  REGION 1..6: note = Synthetic Construct
GKFSLK

SEQ ID NO: 13005 - protein, 6 aa, synthetic construct
  REGION 1..6: note = Synthetic Construct
GKFSNK

SEQ ID NO: 13006 - protein, 6 aa, synthetic construct
  REGION 1..6: note = Synthetic Construct
GKFSQK

SEQ ID NO: 13007 - protein, 6 aa, synthetic construct
  REGION 1..6: note = Synthetic Construct
GKFSRK

SEQ ID NO: 13008 - protein, 6 aa, synthetic construct
  REGION 1..6: note = Synthetic Construct
GKFSSK

SEQ ID NO: 13009 - protein, 6 aa, synthetic construct
  REGION 1..6: note = Synthetic Construct
GKFSTK

SEQ ID NO: 13010 - protein, 6 aa, synthetic construct
  REGION 1..6: note = Synthetic Construct
GKFSYK

SEQ ID NO: 13011 - protein, 6 aa, synthetic construct
  REGION 1..6: note = Synthetic Construct
GKFTAK

SEQ ID NO: 13012 - protein, 6 aa, synthetic construct
  REGION 1..6: note = Synthetic Construct
GKFTDK

SEQ ID NO: 13013 - protein, 6 aa, synthetic construct
  REGION 1..6: note = Synthetic Construct
GKFTEK

SEQ ID NO: 13014 - protein, 6 aa, synthetic construct
  REGION 1..6: note = Synthetic Construct
GKFTFK

SEQ ID NO: 13015 - protein, 6 aa, synthetic construct
  REGION 1..6: note = Synthetic Construct
GKFTGK

SEQ ID NO: 13016 - protein, 6 aa, synthetic construct
  REGION 1..6: note = Synthetic Construct
GKFTHK

SEQ ID NO: 13017 - protein, 6 aa, synthetic construct
  REGION 1..6: note = Synthetic Construct
GKFTIK

SEQ ID NO: 13018 - protein, 6 aa, synthetic construct
  REGION 1..6: note = Synthetic Construct
GKFTLK

SEQ ID NO: 13019 - protein, 6 aa, synthetic construct
  REGION 1..6: note = Synthetic Construct
GKFTNK

SEQ ID NO: 13020 - protein, 6 aa, synthetic construct
  REGION 1..6: note = Synthetic Construct
GKFTQK

SEQ ID NO: 13021 - protein, 6 aa, synthetic construct
  REGION 1..6: note = Synthetic Construct
GKFTRK

SEQ ID NO: 13022 - protein, 6 aa, synthetic construct
  REGION 1..6: note = Synthetic Construct
GKFTSK

SEQ ID NO: 13023 - protein, 6 aa, synthetic construct
  REGION 1..6: note = Synthetic Construct
GKFTTK

SEQ ID NO: 13024 - protein, 6 aa, synthetic construct
  REGION 1..6: note = Synthetic Construct
GKFTYK

SEQ ID NO: 13025 - protein, 6 aa, synthetic construct
  REGION 1..6: note = Synthetic Construct
GKFYAK

SEQ ID NO: 13026 - protein, 6 aa, synthetic construct
  REGION 1..6: note = Synthetic Construct
GKFYDK

SEQ ID NO: 13027 - protein, 6 aa, synthetic construct
  REGION 1..6: note = Synthetic Construct
GKFYEK

SEQ ID NO: 13028 - protein, 6 aa, synthetic construct
  REGION 1..6: note = Synthetic Construct
GKFYFK

SEQ ID NO: 13029 - protein, 6 aa, synthetic construct
  REGION 1..6: note = Synthetic Construct
GKFYGK

SEQ ID NO: 13030 - protein, 6 aa, synthetic construct
  REGION 1..6: note = Synthetic Construct
GKFYHK

SEQ ID NO: 13031 - protein, 6 aa, synthetic construct
  REGION 1..6: note = Synthetic Construct
GKFYIK

SEQ ID NO: 13032 - protein, 6 aa, synthetic construct
  REGION 1..6: note = Synthetic Construct
GKFYLK

SEQ ID NO: 13033 - protein, 6 aa, synthetic construct
  REGION 1..6: note = Synthetic Construct
GKFYNK

SEQ ID NO: 13034 - protein, 6 aa, synthetic construct
  REGION 1..6: note = Synthetic Construct
GKFYQK

SEQ ID NO: 13035 - protein, 6 aa, synthetic construct
  REGION 1..6: note = Synthetic Construct
GKFYRK

SEQ ID NO: 13036 - protein, 6 aa, synthetic construct
  REGION 1..6: note = Synthetic Construct
GKFYSK

SEQ ID NO: 13037 - protein, 6 aa, synthetic construct
  REGION 1..6: note = Synthetic Construct
GKFYTK

SEQ ID NO: 13038 - protein, 6 aa, synthetic construct
  REGION 1..6: note = Synthetic Construct
GKFYYK

SEQ ID NO: 13039 - protein, 6 aa, synthetic construct
  REGION 1..6: note = Synthetic Construct
GKGAAK

SEQ ID NO: 13040 - protein, 6 aa, synthetic construct
  REGION 1..6: note = Synthetic Construct
GKGADK

SEQ ID NO: 13041 - protein, 6 aa, synthetic construct
  REGION 1..6: note = Synthetic Construct
GKGAEK

SEQ ID NO: 13042 - protein, 6 aa, synthetic construct
  REGION 1..6: note = Synthetic Construct
GKGAFK

SEQ ID NO: 13043 - protein, 6 aa, synthetic construct
  REGION 1..6: note = Synthetic Construct
GKGAGK

SEQ ID NO: 13044 - protein, 6 aa, synthetic construct
  REGION 1..6: note = Synthetic Construct
GKGAHK

SEQ ID NO: 13045 - protein, 6 aa, synthetic construct
  REGION 1..6: note = Synthetic Construct
GKGAIK

SEQ ID NO: 13046 - protein, 6 aa, synthetic construct
  REGION 1..6: note = Synthetic Construct
GKGALK

SEQ ID NO: 13047 - protein, 6 aa, synthetic construct
  REGION 1..6: note = Synthetic Construct
GKGANK

SEQ ID NO: 13048 - protein, 6 aa, synthetic construct
  REGION 1..6: note = Synthetic Construct
GKGAQK

SEQ ID NO: 13049 - protein, 6 aa, synthetic construct
  REGION 1..6: note = Synthetic Construct
GKGARK

SEQ ID NO: 13050 - protein, 6 aa, synthetic construct
  REGION 1..6: note = Synthetic Construct
GKGASK

SEQ ID NO: 13051 - protein, 6 aa, synthetic construct
  REGION 1..6: note = Synthetic Construct
GKGATK

SEQ ID NO: 13052 - protein, 6 aa, synthetic construct
  REGION 1..6: note = Synthetic Construct
GKGAYK

SEQ ID NO: 13053 - protein, 6 aa, synthetic construct
  REGION 1..6: note = Synthetic Construct
GKGDAK

SEQ ID NO: 13054 - protein, 6 aa, synthetic construct
  REGION 1..6: note = Synthetic Construct
GKGDDK

SEQ ID NO: 13055 - protein, 6 aa, synthetic construct
  REGION 1..6: note = Synthetic Construct
GKGDEK

SEQ ID NO: 13056 - protein, 6 aa, synthetic construct
  REGION 1..6: note = Synthetic Construct
GKGDFK

SEQ ID NO: 13057 - protein, 6 aa, synthetic construct
  REGION 1..6: note = Synthetic Construct
GKGDGK

SEQ ID NO: 13058 - protein, 6 aa, synthetic construct
  REGION 1..6: note = Synthetic Construct
GKGDHK

SEQ ID NO: 13059 - protein, 6 aa, synthetic construct
  REGION 1..6: note = Synthetic Construct
GKGDIK

SEQ ID NO: 13060 - protein, 6 aa, synthetic construct
  REGION 1..6: note = Synthetic Construct
GKGDLK

SEQ ID NO: 13061 - protein, 6 aa, synthetic construct
  REGION 1..6: note = Synthetic Construct
GKGDNK

SEQ ID NO: 13062 - protein, 6 aa, synthetic construct
  REGION 1..6: note = Synthetic Construct
GKGDQK

SEQ ID NO: 13063 - protein, 6 aa, synthetic construct
  REGION 1..6: note = Synthetic Construct
GKGDRK

SEQ ID NO: 13064 - protein, 6 aa, synthetic construct
  REGION 1..6: note = Synthetic Construct
GKGDSK

SEQ ID NO: 13065 - protein, 6 aa, synthetic construct
  REGION 1..6: note = Synthetic Construct
GKGDTK

SEQ ID NO: 13066 - protein, 6 aa, synthetic construct
  REGION 1..6: note = Synthetic Construct
GKGDYK

SEQ ID NO: 13067 - protein, 6 aa, synthetic construct
  REGION 1..6: note = Synthetic Construct
GKGEAK

SEQ ID NO: 13068 - protein, 6 aa, synthetic construct
  REGION 1..6: note = Synthetic Construct
GKGEDK

SEQ ID NO: 13069 - protein, 6 aa, synthetic construct
  REGION 1..6: note = Synthetic Construct
GKGEEK

SEQ ID NO: 13070 - protein, 6 aa, synthetic construct
  REGION 1..6: note = Synthetic Construct
GKGEFK

SEQ ID NO: 13071 - protein, 6 aa, synthetic construct
  REGION 1..6: note = Synthetic Construct
GKGEGK

SEQ ID NO: 13072 - protein, 6 aa, synthetic construct
  REGION 1..6: note = Synthetic Construct
GKGEHK

SEQ ID NO: 13073 - protein, 6 aa, synthetic construct
  REGION 1..6: note = Synthetic Construct
GKGEIK

SEQ ID NO: 13074 - protein, 6 aa, synthetic construct
  REGION 1..6: note = Synthetic Construct
GKGELK

SEQ ID NO: 13075 - protein, 6 aa, synthetic construct
  REGION 1..6: note = Synthetic Construct
GKGENK

SEQ ID NO: 13076 - protein, 6 aa, synthetic construct
  REGION 1..6: note = Synthetic Construct
GKGEQK

SEQ ID NO: 13077 - protein, 6 aa, synthetic construct
  REGION 1..6: note = Synthetic Construct
GKGERK

SEQ ID NO: 13078 - protein, 6 aa, synthetic construct
  REGION 1..6: note = Synthetic Construct
GKGESK

SEQ ID NO: 13079 - protein, 6 aa, synthetic construct
  REGION 1..6: note = Synthetic Construct
GKGETK

SEQ ID NO: 13080 - protein, 6 aa, synthetic construct
  REGION 1..6: note = Synthetic Construct
GKGEYK

SEQ ID NO: 13081 - protein, 6 aa, synthetic construct
  REGION 1..6: note = Synthetic Construct
GKGFAK

SEQ ID NO: 13082 - protein, 6 aa, synthetic construct
  REGION 1..6: note = Synthetic Construct
GKGFDK

SEQ ID NO: 13083 - protein, 6 aa, synthetic construct
  REGION 1..6: note = Synthetic Construct
GKGFEK

SEQ ID NO: 13084 - protein, 6 aa, synthetic construct
  REGION 1..6: note = Synthetic Construct
GKGFFK

SEQ ID NO: 13085 - protein, 6 aa, synthetic construct
  REGION 1..6: note = Synthetic Construct
GKGFGK

SEQ ID NO: 13086 - protein, 6 aa, synthetic construct
  REGION 1..6: note = Synthetic Construct
GKGFHK

SEQ ID NO: 13087 - protein, 6 aa, synthetic construct
  REGION 1..6: note = Synthetic Construct
GKGFIK

SEQ ID NO: 13088 - protein, 6 aa, synthetic construct
  REGION 1..6: note = Synthetic Construct
GKGFLK

SEQ ID NO: 13089 - protein, 6 aa, synthetic construct
  REGION 1..6: note = Synthetic Construct
GKGFNK

SEQ ID NO: 13090 - protein, 6 aa, synthetic construct
  REGION 1..6: note = Synthetic Construct
GKGFQK

SEQ ID NO: 13091 - protein, 6 aa, synthetic construct
  REGION 1..6: note = Synthetic Construct
GKGFRK

SEQ ID NO: 13092 - protein, 6 aa, synthetic construct
  REGION 1..6: note = Synthetic Construct
GKGFSK

SEQ ID NO: 13093 - protein, 6 aa, synthetic construct
  REGION 1..6: note = Synthetic Construct
GKGFTK

SEQ ID NO: 13094 - protein, 6 aa, synthetic construct
  REGION 1..6: note = Synthetic Construct
GKGFYK

SEQ ID NO: 13095 - protein, 6 aa, synthetic construct
  REGION 1..6: note = Synthetic Construct
GKGGAK

SEQ ID NO: 13096 - protein, 6 aa, synthetic construct
  REGION 1..6: note = Synthetic Construct
GKGGDK

SEQ ID NO: 13097 - protein, 6 aa, synthetic construct
  REGION 1..6: note = Synthetic Construct
GKGGEK

SEQ ID NO: 13098 - protein, 6 aa, synthetic construct
  REGION 1..6: note = Synthetic Construct
GKGGFK

SEQ ID NO: 13099 - protein, 6 aa, synthetic construct
  REGION 1..6: note = Synthetic Construct
GKGGGK

SEQ ID NO: 13100 - protein, 6 aa, synthetic construct
  REGION 1..6: note = Synthetic Construct
GKGGHK

SEQ ID NO: 13101 - protein, 6 aa, synthetic construct
  REGION 1..6: note = Synthetic Construct
GKGGIK

SEQ ID NO: 13102 - protein, 6 aa, synthetic construct
  REGION 1..6: note = Synthetic Construct
GKGGLK

SEQ ID NO: 13103 - protein, 6 aa, synthetic construct
  REGION 1..6: note = Synthetic Construct
GKGGNK

SEQ ID NO: 13104 - protein, 6 aa, synthetic construct
  REGION 1..6: note = Synthetic Construct
GKGGQK

SEQ ID NO: 13105 - protein, 6 aa, synthetic construct
  REGION 1..6: note = Synthetic Construct
GKGGRK

SEQ ID NO: 13106 - protein, 6 aa, synthetic construct
  REGION 1..6: note = Synthetic Construct
GKGGSK

SEQ ID NO: 13107 - protein, 6 aa, synthetic construct
  REGION 1..6: note = Synthetic Construct
GKGGTK

SEQ ID NO: 13108 - protein, 6 aa, synthetic construct
  REGION 1..6: note = Synthetic Construct
GKGGYK

SEQ ID NO: 13109 - protein, 6 aa, synthetic construct
  REGION 1..6: note = Synthetic Construct
GKGHAK

SEQ ID NO: 13110 - protein, 6 aa, synthetic construct
  REGION 1..6: note = Synthetic Construct
GKGHDK

SEQ ID NO: 13111 - protein, 6 aa, synthetic construct
  REGION 1..6: note = Synthetic Construct
GKGHEK

SEQ ID NO: 13112 - protein, 6 aa, synthetic construct
  REGION 1..6: note = Synthetic Construct
GKGHFK

SEQ ID NO: 13113 - protein, 6 aa, synthetic construct
  REGION 1..6: note = Synthetic Construct
GKGHGK

SEQ ID NO: 13114 - protein, 6 aa, synthetic construct
  REGION 1..6: note = Synthetic Construct
GKGHHK

SEQ ID NO: 13115 - protein, 6 aa, synthetic construct
  REGION 1..6: note = Synthetic Construct
GKGHIK

SEQ ID NO: 13116 - protein, 6 aa, synthetic construct
  REGION 1..6: note = Synthetic Construct
GKGHLK

SEQ ID NO: 13117 - protein, 6 aa, synthetic construct
  REGION 1..6: note = Synthetic Construct
GKGHNK

SEQ ID NO: 13118 - protein, 6 aa, synthetic construct
  REGION 1..6: note = Synthetic Construct
GKGHQK

SEQ ID NO: 13119 - protein, 6 aa, synthetic construct
  REGION 1..6: note = Synthetic Construct
GKGHRK

SEQ ID NO: 13120 - protein, 6 aa, synthetic construct
  REGION 1..6: note = Synthetic Construct
GKGHSK

SEQ ID NO: 13121 - protein, 6 aa, synthetic construct
  REGION 1..6: note = Synthetic Construct
GKGHTK

SEQ ID NO: 13122 - protein, 6 aa, synthetic construct
  REGION 1..6: note = Synthetic Construct
GKGHYK

SEQ ID NO: 13123 - protein, 6 aa, synthetic construct
  REGION 1..6: note = Synthetic Construct
GKGIAK

SEQ ID NO: 13124 - protein, 6 aa, synthetic construct
  REGION 1..6: note = Synthetic Construct
GKGIDK

SEQ ID NO: 13125 - protein, 6 aa, synthetic construct
  REGION 1..6: note = Synthetic Construct
GKGIEK

SEQ ID NO: 13126 - protein, 6 aa, synthetic construct
  REGION 1..6: note = Synthetic Construct
GKGIFK

SEQ ID NO: 13127 - protein, 6 aa, synthetic construct
  REGION 1..6: note = Synthetic Construct
GKGIGK

SEQ ID NO: 13128 - protein, 6 aa, synthetic construct
  REGION 1..6: note = Synthetic Construct
GKGIHK

SEQ ID NO: 13129 - protein, 6 aa, synthetic construct
  REGION 1..6: note = Synthetic Construct
GKGIIK

SEQ ID NO: 13130 - protein, 6 aa, synthetic construct
  REGION 1..6: note = Synthetic Construct
GKGILK

SEQ ID NO: 13131 - protein, 6 aa, synthetic construct
  REGION 1..6: note = Synthetic Construct
GKGINK

SEQ ID NO: 13132 - protein, 6 aa, synthetic construct
  REGION 1..6: note = Synthetic Construct
GKGIQK

SEQ ID NO: 13133 - protein, 6 aa, synthetic construct
  REGION 1..6: note = Synthetic Construct
GKGIRK

SEQ ID NO: 13134 - protein, 6 aa, synthetic construct
  REGION 1..6: note = Synthetic Construct
GKGISK

SEQ ID NO: 13135 - protein, 6 aa, synthetic construct
  REGION 1..6: note = Synthetic Construct
GKGITK

SEQ ID NO: 13136 - protein, 6 aa, synthetic construct
  REGION 1..6: note = Synthetic Construct
GKGIYK

SEQ ID NO: 13137 - protein, 6 aa, synthetic construct
  REGION 1..6: note = Synthetic Construct
GKGLAK

SEQ ID NO: 13138 - protein, 6 aa, synthetic construct
  REGION 1..6: note = Synthetic Construct
GKGLDK

SEQ ID NO: 13139 - protein, 6 aa, synthetic construct
  REGION 1..6: note = Synthetic Construct
GKGLEK

SEQ ID NO: 13140 - protein, 6 aa, synthetic construct
  REGION 1..6: note = Synthetic Construct
GKGLFK

SEQ ID NO: 13141 - protein, 6 aa, synthetic construct
  REGION 1..6: note = Synthetic Construct
GKGLGK

SEQ ID NO: 13142 - protein, 6 aa, synthetic construct
  REGION 1..6: note = Synthetic Construct
GKGLHK

SEQ ID NO: 13143 - protein, 6 aa, synthetic construct
  REGION 1..6: note = Synthetic Construct
GKGLIK

SEQ ID NO: 13144 - protein, 6 aa, synthetic construct
  REGION 1..6: note = Synthetic Construct
GKGLLK

SEQ ID NO: 13145 - protein, 6 aa, synthetic construct
  REGION 1..6: note = Synthetic Construct
GKGLNK

SEQ ID NO: 13146 - protein, 6 aa, synthetic construct
  REGION 1..6: note = Synthetic Construct
GKGLQK

SEQ ID NO: 13147 - protein, 6 aa, synthetic construct
  REGION 1..6: note = Synthetic Construct
GKGLRK

SEQ ID NO: 13148 - protein, 6 aa, synthetic construct
  REGION 1..6: note = Synthetic Construct
GKGLSK

SEQ ID NO: 13149 - protein, 6 aa, synthetic construct
  REGION 1..6: note = Synthetic Construct
GKGLTK

SEQ ID NO: 13150 - protein, 6 aa, synthetic construct
  REGION 1..6: note = Synthetic Construct
GKGLYK

SEQ ID NO: 13151 - protein, 6 aa, synthetic construct
  REGION 1..6: note = Synthetic Construct
GKGNAK

SEQ ID NO: 13152 - protein, 6 aa, synthetic construct
  REGION 1..6: note = Synthetic Construct
GKGNDK

SEQ ID NO: 13153 - protein, 6 aa, synthetic construct
  REGION 1..6: note = Synthetic Construct
GKGNEK

SEQ ID NO: 13154 - protein, 6 aa, synthetic construct
  REGION 1..6: note = Synthetic Construct
GKGNFK

SEQ ID NO: 13155 - protein, 6 aa, synthetic construct
  REGION 1..6: note = Synthetic Construct
GKGNGK

SEQ ID NO: 13156 - protein, 6 aa, synthetic construct
  REGION 1..6: note = Synthetic Construct
GKGNHK

SEQ ID NO: 13157 - protein, 6 aa, synthetic construct
  REGION 1..6: note = Synthetic Construct
GKGNIK

SEQ ID NO: 13158 - protein, 6 aa, synthetic construct
  REGION 1..6: note = Synthetic Construct
GKGNLK

SEQ ID NO: 13159 - protein, 6 aa, synthetic construct
  REGION 1..6: note = Synthetic Construct
GKGNNK

SEQ ID NO: 13160 - protein, 6 aa, synthetic construct
  REGION 1..6: note = Synthetic Construct
GKGNQK

SEQ ID NO: 13161 - protein, 6 aa, synthetic construct
  REGION 1..6: note = Synthetic Construct
GKGNRK

SEQ ID NO: 13162 - protein, 6 aa, synthetic construct
  REGION 1..6: note = Synthetic Construct
GKGNSK

SEQ ID NO: 13163 - protein, 6 aa, synthetic construct
  REGION 1..6: note = Synthetic Construct
GKGNTK

SEQ ID NO: 13164 - protein, 6 aa, synthetic construct
  REGION 1..6: note = Synthetic Construct
GKGNYK

SEQ ID NO: 13165 - protein, 6 aa, synthetic construct
  REGION 1..6: note = Synthetic Construct
GKGQAK

SEQ ID NO: 13166 - protein, 6 aa, synthetic construct
  REGION 1..6: note = Synthetic Construct
GKGQDK

SEQ ID NO: 13167 - protein, 6 aa, synthetic construct
  REGION 1..6: note = Synthetic Construct
GKGQEK

SEQ ID NO: 13168 - protein, 6 aa, synthetic construct
  REGION 1..6: note = Synthetic Construct
GKGQFK

SEQ ID NO: 13169 - protein, 6 aa, synthetic construct
  REGION 1..6: note = Synthetic Construct
GKGQGK

SEQ ID NO: 13170 - protein, 6 aa, synthetic construct
  REGION 1..6: note = Synthetic Construct
GKGQHK

SEQ ID NO: 13171 - protein, 6 aa, synthetic construct
  REGION 1..6: note = Synthetic Construct
GKGQIK

SEQ ID NO: 13172 - protein, 6 aa, synthetic construct
  REGION 1..6: note = Synthetic Construct
GKGQLK

SEQ ID NO: 13173 - protein, 6 aa, synthetic construct
  REGION 1..6: note = Synthetic Construct
GKGQNK

SEQ ID NO: 13174 - protein, 6 aa, synthetic construct
  REGION 1..6: note = Synthetic Construct
GKGQQK

SEQ ID NO: 13175 - protein, 6 aa, synthetic construct
  REGION 1..6: note = Synthetic Construct
GKGQRK

SEQ ID NO: 13176 - protein, 6 aa, synthetic construct
  REGION 1..6: note = Synthetic Construct
GKGQSK

SEQ ID NO: 13177 - protein, 6 aa, synthetic construct
  REGION 1..6: note = Synthetic Construct
GKGQTK

SEQ ID NO: 13178 - protein, 6 aa, synthetic construct
  REGION 1..6: note = Synthetic Construct
GKGQYK

SEQ ID NO: 13179 - protein, 6 aa, synthetic construct
  REGION 1..6: note = Synthetic Construct
GKGRAK

SEQ ID NO: 13180 - protein, 6 aa, synthetic construct
  REGION 1..6: note = Synthetic Construct
GKGRDK

SEQ ID NO: 13181 - protein, 6 aa, synthetic construct
  REGION 1..6: note = Synthetic Construct
GKGREK

SEQ ID NO: 13182 - protein, 6 aa, synthetic construct
  REGION 1..6: note = Synthetic Construct
GKGRFK

SEQ ID NO: 13183 - protein, 6 aa, synthetic construct
  REGION 1..6: note = Synthetic Construct
GKGRGK

SEQ ID NO: 13184 - protein, 6 aa, synthetic construct
  REGION 1..6: note = Synthetic Construct
GKGRHK

SEQ ID NO: 13185 - protein, 6 aa, synthetic construct
  REGION 1..6: note = Synthetic Construct
GKGRIK

SEQ ID NO: 13186 - protein, 6 aa, synthetic construct
  REGION 1..6: note = Synthetic Construct
GKGRLK

SEQ ID NO: 13187 - protein, 6 aa, synthetic construct
  REGION 1..6: note = Synthetic Construct
GKGRNK

SEQ ID NO: 13188 - protein, 6 aa, synthetic construct
  REGION 1..6: note = Synthetic Construct
GKGRQK

SEQ ID NO: 13189 - protein, 6 aa, synthetic construct
  REGION 1..6: note = Synthetic Construct
GKGRRK

SEQ ID NO: 13190 - protein, 6 aa, synthetic construct
  REGION 1..6: note = Synthetic Construct
GKGRSK

SEQ ID NO: 13191 - protein, 6 aa, synthetic construct
  REGION 1..6: note = Synthetic Construct
GKGRTK

SEQ ID NO: 13192 - protein, 6 aa, synthetic construct
  REGION 1..6: note = Synthetic Construct
GKGRYK

SEQ ID NO: 13193 - protein, 6 aa, synthetic construct
  REGION 1..6: note = Synthetic Construct
GKGSAK

SEQ ID NO: 13194 - protein, 6 aa, synthetic construct
  REGION 1..6: note = Synthetic Construct
GKGSDK

SEQ ID NO: 13195 - protein, 6 aa, synthetic construct
  REGION 1..6: note = Synthetic Construct
GKGSEK

SEQ ID NO: 13196 - protein, 6 aa, synthetic construct
  REGION 1..6: note = Synthetic Construct
GKGSFK

SEQ ID NO: 13197 - protein, 6 aa, synthetic construct
  REGION 1..6: note = Synthetic Construct
GKGSGK

SEQ ID NO: 13198 - protein, 6 aa, synthetic construct
  REGION 1..6: note = Synthetic Construct
GKGSHK

SEQ ID NO: 13199 - protein, 6 aa, synthetic construct
  REGION 1..6: note = Synthetic Construct
GKGSIK

SEQ ID NO: 13200 - protein, 6 aa, synthetic construct
  REGION 1..6: note = Synthetic Construct
GKGSLK

SEQ ID NO: 13201 - protein, 6 aa, synthetic construct
  REGION 1..6: note = Synthetic Construct
GKGSNK

SEQ ID NO: 13202 - protein, 6 aa, synthetic construct
  REGION 1..6: note = Synthetic Construct
GKGSQK

SEQ ID NO: 13203 - protein, 6 aa, synthetic construct
  REGION 1..6: note = Synthetic Construct
GKGSRK

SEQ ID NO: 13204 - protein, 6 aa, synthetic construct
  REGION 1..6: note = Synthetic Construct
GKGSSK

SEQ ID NO: 13205 - protein, 6 aa, synthetic construct
  REGION 1..6: note = Synthetic Construct
GKGSTK

SEQ ID NO: 13206 - protein, 6 aa, synthetic construct
  REGION 1..6: note = Synthetic Construct
GKGSYK

SEQ ID NO: 13207 - protein, 6 aa, synthetic construct
  REGION 1..6: note = Synthetic Construct
GKGTAK

SEQ ID NO: 13208 - protein, 6 aa, synthetic construct
  REGION 1..6: note = Synthetic Construct
GKGTDK

SEQ ID NO: 13209 - protein, 6 aa, synthetic construct
  REGION 1..6: note = Synthetic Construct
GKGTEK

SEQ ID NO: 13210 - protein, 6 aa, synthetic construct
  REGION 1..6: note = Synthetic Construct
GKGTFK

SEQ ID NO: 13211 - protein, 6 aa, synthetic construct
  REGION 1..6: note = Synthetic Construct
GKGTGK

SEQ ID NO: 13212 - protein, 6 aa, synthetic construct
  REGION 1..6: note = Synthetic Construct
GKGTHK

SEQ ID NO: 13213 - protein, 6 aa, synthetic construct
  REGION 1..6: note = Synthetic Construct
GKGTIK

SEQ ID NO: 13214 - protein, 6 aa, synthetic construct
  REGION 1..6: note = Synthetic Construct
GKGTLK

SEQ ID NO: 13215 - protein, 6 aa, synthetic construct
  REGION 1..6: note = Synthetic Construct
GKGTNK

SEQ ID NO: 13216 - protein, 6 aa, synthetic construct
  REGION 1..6: note = Synthetic Construct
GKGTQK

SEQ ID NO: 13217 - protein, 6 aa, synthetic construct
  REGION 1..6: note = Synthetic Construct
GKGTRK

SEQ ID NO: 13218 - protein, 6 aa, synthetic construct
  REGION 1..6: note = Synthetic Construct
GKGTSK

SEQ ID NO: 13219 - protein, 6 aa, synthetic construct
  REGION 1..6: note = Synthetic Construct
GKGTTK

SEQ ID NO: 13220 - protein, 6 aa, synthetic construct
  REGION 1..6: note = Synthetic Construct
GKGTYK

SEQ ID NO: 13221 - protein, 6 aa, synthetic construct
  REGION 1..6: note = Synthetic Construct
GKGYAK

SEQ ID NO: 13222 - protein, 6 aa, synthetic construct
  REGION 1..6: note = Synthetic Construct
GKGYDK

SEQ ID NO: 13223 - protein, 6 aa, synthetic construct
  REGION 1..6: note = Synthetic Construct
GKGYEK

SEQ ID NO: 13224 - protein, 6 aa, synthetic construct
  REGION 1..6: note = Synthetic Construct
GKGYFK

SEQ ID NO: 13225 - protein, 6 aa, synthetic construct
  REGION 1..6: note = Synthetic Construct
GKGYGK

SEQ ID NO: 13226 - protein, 6 aa, synthetic construct
  REGION 1..6: note = Synthetic Construct
GKGYHK

SEQ ID NO: 13227 - protein, 6 aa, synthetic construct
  REGION 1..6: note = Synthetic Construct
GKGYIK

SEQ ID NO: 13228 - protein, 6 aa, synthetic construct
  REGION 1..6: note = Synthetic Construct
GKGYLK

SEQ ID NO: 13229 - protein, 6 aa, synthetic construct
  REGION 1..6: note = Synthetic Construct
GKGYNK

SEQ ID NO: 13230 - protein, 6 aa, synthetic construct
  REGION 1..6: note = Synthetic Construct
GKGYQK

SEQ ID NO: 13231 - protein, 6 aa, synthetic construct
  REGION 1..6: note = Synthetic Construct
GKGYRK

SEQ ID NO: 13232 - protein, 6 aa, synthetic construct
  REGION 1..6: note = Synthetic Construct
GKGYSK

SEQ ID NO: 13233 - protein, 6 aa, synthetic construct
  REGION 1..6: note = Synthetic Construct
GKGYTK

SEQ ID NO: 13234 - protein, 6 aa, synthetic construct
  REGION 1..6: note = Synthetic Construct
GKGYYK

SEQ ID NO: 13235 - protein, 6 aa, synthetic construct
  REGION 1..6: note = Synthetic Construct
GKHAAK

SEQ ID NO: 13236 - protein, 6 aa, synthetic construct
  REGION 1..6: note = Synthetic Construct
GKHADK

SEQ ID NO: 13237 - protein, 6 aa, synthetic construct
  REGION 1..6: note = Synthetic Construct
GKHAEK

SEQ ID NO: 13238 - protein, 6 aa, synthetic construct
  REGION 1..6: note = Synthetic Construct
GKHAFK

SEQ ID NO: 13239 - protein, 6 aa, synthetic construct
  REGION 1..6: note = Synthetic Construct
GKHAGK

SEQ ID NO: 13240 - protein, 6 aa, synthetic construct
  REGION 1..6: note = Synthetic Construct
GKHAHK

SEQ ID NO: 13241 - protein, 6 aa, synthetic construct
  REGION 1..6: note = Synthetic Construct
GKHAIK

SEQ ID NO: 13242 - protein, 6 aa, synthetic construct
  REGION 1..6: note = Synthetic Construct
GKHALK

SEQ ID NO: 13243 - protein, 6 aa, synthetic construct
  REGION 1..6: note = Synthetic Construct
GKHANK

SEQ ID NO: 13244 - protein, 6 aa, synthetic construct
  REGION 1..6: note = Synthetic Construct
GKHAQK

SEQ ID NO: 13245 - protein, 6 aa, synthetic construct
  REGION 1..6: note = Synthetic Construct
GKHARK

SEQ ID NO: 13246 - protein, 6 aa, synthetic construct
  REGION 1..6: note = Synthetic Construct
GKHASK

SEQ ID NO: 13247 - protein, 6 aa, synthetic construct
  REGION 1..6: note = Synthetic Construct
GKHATK

SEQ ID NO: 13248 - protein, 6 aa, synthetic construct
  REGION 1..6: note = Synthetic Construct
GKHAYK

SEQ ID NO: 13249 - protein, 6 aa, synthetic construct
  REGION 1..6: note = Synthetic Construct
GKHDAK

SEQ ID NO: 13250 - protein, 6 aa, synthetic construct
  REGION 1..6: note = Synthetic Construct
GKHDDK

SEQ ID NO: 13251 - protein, 6 aa, synthetic construct
  REGION 1..6: note = Synthetic Construct
GKHDEK

SEQ ID NO: 13252 - protein, 6 aa, synthetic construct
  REGION 1..6: note = Synthetic Construct
GKHDFK

SEQ ID NO: 13253 - protein, 6 aa, synthetic construct
  REGION 1..6: note = Synthetic Construct
GKHDGK

SEQ ID NO: 13254 - protein, 6 aa, synthetic construct
  REGION 1..6: note = Synthetic Construct
GKHDHK

SEQ ID NO: 13255 - protein, 6 aa, synthetic construct
  REGION 1..6: note = Synthetic Construct
GKHDIK

SEQ ID NO: 13256 - protein, 6 aa, synthetic construct
  REGION 1..6: note = Synthetic Construct
GKHDLK

SEQ ID NO: 13257 - protein, 6 aa, synthetic construct
  REGION 1..6: note = Synthetic Construct
GKHDNK

SEQ ID NO: 13258 - protein, 6 aa, synthetic construct
  REGION 1..6: note = Synthetic Construct
GKHDQK

SEQ ID NO: 13259 - protein, 6 aa, synthetic construct
  REGION 1..6: note = Synthetic Construct
GKHDRK

SEQ ID NO: 13260 - protein, 6 aa, synthetic construct
  REGION 1..6: note = Synthetic Construct
GKHDSK

SEQ ID NO: 13261 - protein, 6 aa, synthetic construct
  REGION 1..6: note = Synthetic Construct
GKHDTK

SEQ ID NO: 13262 - protein, 6 aa, synthetic construct
  REGION 1..6: note = Synthetic Construct
GKHDYK

SEQ ID NO: 13263 - protein, 6 aa, synthetic construct
  REGION 1..6: note = Synthetic Construct
GKHEAK

SEQ ID NO: 13264 - protein, 6 aa, synthetic construct
  REGION 1..6: note = Synthetic Construct
GKHEDK

SEQ ID NO: 13265 - protein, 6 aa, synthetic construct
  REGION 1..6: note = Synthetic Construct
GKHEEK

SEQ ID NO: 13266 - protein, 6 aa, synthetic construct
  REGION 1..6: note = Synthetic Construct
GKHEFK

SEQ ID NO: 13267 - protein, 6 aa, synthetic construct
  REGION 1..6: note = Synthetic Construct
GKHEGK

SEQ ID NO: 13268 - protein, 6 aa, synthetic construct
  REGION 1..6: note = Synthetic Construct
GKHEHK

SEQ ID NO: 13269 - protein, 6 aa, synthetic construct
  REGION 1..6: note = Synthetic Construct
GKHEIK

SEQ ID NO: 13270 - protein, 6 aa, synthetic construct
  REGION 1..6: note = Synthetic Construct
GKHELK

SEQ ID NO: 13271 - protein, 6 aa, synthetic construct
  REGION 1..6: note = Synthetic Construct
GKHENK

SEQ ID NO: 13272 - protein, 6 aa, synthetic construct
  REGION 1..6: note = Synthetic Construct
GKHEQK

SEQ ID NO: 13273 - protein, 6 aa, synthetic construct
  REGION 1..6: note = Synthetic Construct
GKHERK

SEQ ID NO: 13274 - protein, 6 aa, synthetic construct
  REGION 1..6: note = Synthetic Construct
GKHESK

SEQ ID NO: 13275 - protein, 6 aa, synthetic construct
  REGION 1..6: note = Synthetic Construct
GKHETK

SEQ ID NO: 13276 - protein, 6 aa, synthetic construct
  REGION 1..6: note = Synthetic Construct
GKHEYK

SEQ ID NO: 13277 - protein, 6 aa, synthetic construct
  REGION 1..6: note = Synthetic Construct
GKHFAK

SEQ ID NO: 13278 - protein, 6 aa, synthetic construct
  REGION 1..6: note = Synthetic Construct
GKHFDK

SEQ ID NO: 13279 - protein, 6 aa, synthetic construct
  REGION 1..6: note = Synthetic Construct
GKHFEK

SEQ ID NO: 13280 - protein, 6 aa, synthetic construct
  REGION 1..6: note = Synthetic Construct
GKHFFK

SEQ ID NO: 13281 - protein, 6 aa, synthetic construct
  REGION 1..6: note = Synthetic Construct
GKHFGK

SEQ ID NO: 13282 - protein, 6 aa, synthetic construct
  REGION 1..6: note = Synthetic Construct
GKHFHK

SEQ ID NO: 13283 - protein, 6 aa, synthetic construct
  REGION 1..6: note = Synthetic Construct
GKHFIK

SEQ ID NO: 13284 - protein, 6 aa, synthetic construct
  REGION 1..6: note = Synthetic Construct
GKHFLK

SEQ ID NO: 13285 - protein, 6 aa, synthetic construct
  REGION 1..6: note = Synthetic Construct
GKHFNK

SEQ ID NO: 13286 - protein, 6 aa, synthetic construct
  REGION 1..6: note = Synthetic Construct
GKHFQK

SEQ ID NO: 13287 - protein, 6 aa, synthetic construct
  REGION 1..6: note = Synthetic Construct
GKHFRK

SEQ ID NO: 13288 - protein, 6 aa, synthetic construct
  REGION 1..6: note = Synthetic Construct
GKHFSK

SEQ ID NO: 13289 - protein, 6 aa, synthetic construct
  REGION 1..6: note = Synthetic Construct
GKHFTK

SEQ ID NO: 13290 - protein, 6 aa, synthetic construct
  REGION 1..6: note = Synthetic Construct
GKHFYK

SEQ ID NO: 13291 - protein, 6 aa, synthetic construct
  REGION 1..6: note = Synthetic Construct
GKHGAK

SEQ ID NO: 13292 - protein, 6 aa, synthetic construct
  REGION 1..6: note = Synthetic Construct
GKHGDK

SEQ ID NO: 13293 - protein, 6 aa, synthetic construct
  REGION 1..6: note = Synthetic Construct
GKHGEK

SEQ ID NO: 13294 - protein, 6 aa, synthetic construct
  REGION 1..6: note = Synthetic Construct
GKHGFK

SEQ ID NO: 13295 - protein, 6 aa, synthetic construct
  REGION 1..6: note = Synthetic Construct
GKHGGK

SEQ ID NO: 13296 - protein, 6 aa, synthetic construct
  REGION 1..6: note = Synthetic Construct
GKHGHK

SEQ ID NO: 13297 - protein, 6 aa, synthetic construct
  REGION 1..6: note = Synthetic Construct
GKHGIK

SEQ ID NO: 13298 - protein, 6 aa, synthetic construct
  REGION 1..6: note = Synthetic Construct
GKHGLK

SEQ ID NO: 13299 - protein, 6 aa, synthetic construct
  REGION 1..6: note = Synthetic Construct
GKHGNK

SEQ ID NO: 13300 - protein, 6 aa, synthetic construct
  REGION 1..6: note = Synthetic Construct
GKHGQK

SEQ ID NO: 13301 - protein, 6 aa, synthetic construct
  REGION 1..6: note = Synthetic Construct
GKHGRK

SEQ ID NO: 13302 - protein, 6 aa, synthetic construct
  REGION 1..6: note = Synthetic Construct
GKHGSK

SEQ ID NO: 13303 - protein, 6 aa, synthetic construct
  REGION 1..6: note = Synthetic Construct
GKHGTK

SEQ ID NO: 13304 - protein, 6 aa, synthetic construct
  REGION 1..6: note = Synthetic Construct
GKHGYK

SEQ ID NO: 13305 - protein, 6 aa, synthetic construct
  REGION 1..6: note = Synthetic Construct
GKHHAK

SEQ ID NO: 13306 - protein, 6 aa, synthetic construct
  REGION 1..6: note = Synthetic Construct
GKHHDK

SEQ ID NO: 13307 - protein, 6 aa, synthetic construct
  REGION 1..6: note = Synthetic Construct
GKHHEK

SEQ ID NO: 13308 - protein, 6 aa, synthetic construct
  REGION 1..6: note = Synthetic Construct
GKHHFK

SEQ ID NO: 13309 - protein, 6 aa, synthetic construct
  REGION 1..6: note = Synthetic Construct
GKHHGK

SEQ ID NO: 13310 - protein, 6 aa, synthetic construct
  REGION 1..6: note = Synthetic Construct
GKHHHK

SEQ ID NO: 13311 - protein, 6 aa, synthetic construct
  REGION 1..6: note = Synthetic Construct
GKHHIK

SEQ ID NO: 13312 - protein, 6 aa, synthetic construct
  REGION 1..6: note = Synthetic Construct
GKHHLK

SEQ ID NO: 13313 - protein, 6 aa, synthetic construct
  REGION 1..6: note = Synthetic Construct
GKHHNK

SEQ ID NO: 13314 - protein, 6 aa, synthetic construct
  REGION 1..6: note = Synthetic Construct
GKHHQK

SEQ ID NO: 13315 - protein, 6 aa, synthetic construct
  REGION 1..6: note = Synthetic Construct
GKHHRK

SEQ ID NO: 13316 - protein, 6 aa, synthetic construct
  REGION 1..6: note = Synthetic Construct
GKHHSK

SEQ ID NO: 13317 - protein, 6 aa, synthetic construct
  REGION 1..6: note = Synthetic Construct
GKHHTK

SEQ ID NO: 13318 - protein, 6 aa, synthetic construct
  REGION 1..6: note = Synthetic Construct
GKHHYK

SEQ ID NO: 13319 - protein, 6 aa, synthetic construct
  REGION 1..6: note = Synthetic Construct
GKHIAK

SEQ ID NO: 13320 - protein, 6 aa, synthetic construct
  REGION 1..6: note = Synthetic Construct
GKHIDK

SEQ ID NO: 13321 - protein, 6 aa, synthetic construct
  REGION 1..6: note = Synthetic Construct
GKHIEK

SEQ ID NO: 13322 - protein, 6 aa, synthetic construct
  REGION 1..6: note = Synthetic Construct
GKHIFK

SEQ ID NO: 13323 - protein, 6 aa, synthetic construct
  REGION 1..6: note = Synthetic Construct
GKHIGK

SEQ ID NO: 13324 - protein, 6 aa, synthetic construct
  REGION 1..6: note = Synthetic Construct
GKHIHK

SEQ ID NO: 13325 - protein, 6 aa, synthetic construct
  REGION 1..6: note = Synthetic Construct
GKHIIK

SEQ ID NO: 13326 - protein, 6 aa, synthetic construct
  REGION 1..6: note = Synthetic Construct
GKHILK

SEQ ID NO: 13327 - protein, 6 aa, synthetic construct
  REGION 1..6: note = Synthetic Construct
GKHINK

SEQ ID NO: 13328 - protein, 6 aa, synthetic construct
  REGION 1..6: note = Synthetic Construct
GKHIQK

SEQ ID NO: 13329 - protein, 6 aa, synthetic construct
  REGION 1..6: note = Synthetic Construct
GKHIRK

SEQ ID NO: 13330 - protein, 6 aa, synthetic construct
  REGION 1..6: note = Synthetic Construct
GKHISK

SEQ ID NO: 13331 - protein, 6 aa, synthetic construct
  REGION 1..6: note = Synthetic Construct
GKHITK

SEQ ID NO: 13332 - protein, 6 aa, synthetic construct
  REGION 1..6: note = Synthetic Construct
GKHIYK

SEQ ID NO: 13333 - protein, 6 aa, synthetic construct
  REGION 1..6: note = Synthetic Construct
GKHLAK

SEQ ID NO: 13334 - protein, 6 aa, synthetic construct
  REGION 1..6: note = Synthetic Construct
GKHLDK

SEQ ID NO: 13335 - protein, 6 aa, synthetic construct
  REGION 1..6: note = Synthetic Construct
GKHLEK

SEQ ID NO: 13336 - protein, 6 aa, synthetic construct
  REGION 1..6: note = Synthetic Construct
GKHLFK

SEQ ID NO: 13337 - protein, 6 aa, synthetic construct
  REGION 1..6: note = Synthetic Construct
GKHLGK

SEQ ID NO: 13338 - protein, 6 aa, synthetic construct
  REGION 1..6: note = Synthetic Construct
GKHLHK

SEQ ID NO: 13339 - protein, 6 aa, synthetic construct
  REGION 1..6: note = Synthetic Construct
GKHLIK

SEQ ID NO: 13340 - protein, 6 aa, synthetic construct
  REGION 1..6: note = Synthetic Construct
GKHLLK

SEQ ID NO: 13341 - protein, 6 aa, synthetic construct
  REGION 1..6: note = Synthetic Construct
GKHLNK

SEQ ID NO: 13342 - protein, 6 aa, synthetic construct
  REGION 1..6: note = Synthetic Construct
GKHLQK

SEQ ID NO: 13343 - protein, 6 aa, synthetic construct
  REGION 1..6: note = Synthetic Construct
GKHLRK

SEQ ID NO: 13344 - protein, 6 aa, synthetic construct
  REGION 1..6: note = Synthetic Construct
GKHLSK

SEQ ID NO: 13345 - protein, 6 aa, synthetic construct
  REGION 1..6: note = Synthetic Construct
GKHLTK

SEQ ID NO: 13346 - protein, 6 aa, synthetic construct
  REGION 1..6: note = Synthetic Construct
GKHLYK

SEQ ID NO: 13347 - protein, 6 aa, synthetic construct
  REGION 1..6: note = Synthetic Construct
GKHNAK

SEQ ID NO: 13348 - protein, 6 aa, synthetic construct
  REGION 1..6: note = Synthetic Construct
GKHNDK

SEQ ID NO: 13349 - protein, 6 aa, synthetic construct
  REGION 1..6: note = Synthetic Construct
GKHNEK

SEQ ID NO: 13350 - protein, 6 aa, synthetic construct
  REGION 1..6: note = Synthetic Construct
GKHNFK

SEQ ID NO: 13351 - protein, 6 aa, synthetic construct
  REGION 1..6: note = Synthetic Construct
GKHNGK

SEQ ID NO: 13352 - protein, 6 aa, synthetic construct
  REGION 1..6: note = Synthetic Construct
GKHNHK

SEQ ID NO: 13353 - protein, 6 aa, synthetic construct
  REGION 1..6: note = Synthetic Construct
GKHNIK

SEQ ID NO: 13354 - protein, 6 aa, synthetic construct
  REGION 1..6: note = Synthetic Construct
GKHNLK

SEQ ID NO: 13355 - protein, 6 aa, synthetic construct
  REGION 1..6: note = Synthetic Construct
GKHNNK

SEQ ID NO: 13356 - protein, 6 aa, synthetic construct
  REGION 1..6: note = Synthetic Construct
GKHNQK

SEQ ID NO: 13357 - protein, 6 aa, synthetic construct
  REGION 1..6: note = Synthetic Construct
GKHNRK

SEQ ID NO: 13358 - protein, 6 aa, synthetic construct
  REGION 1..6: note = Synthetic Construct
GKHNSK

SEQ ID NO: 13359 - protein, 6 aa, synthetic construct
  REGION 1..6: note = Synthetic Construct
GKHNTK

SEQ ID NO: 13360 - protein, 6 aa, synthetic construct
  REGION 1..6: note = Synthetic Construct
GKHNYK

SEQ ID NO: 13361 - protein, 6 aa, synthetic construct
  REGION 1..6: note = Synthetic Construct
GKHQAK

SEQ ID NO: 13362 - protein, 6 aa, synthetic construct
  REGION 1..6: note = Synthetic Construct
GKHQDK

SEQ ID NO: 13363 - protein, 6 aa, synthetic construct
  REGION 1..6: note = Synthetic Construct
GKHQEK

SEQ ID NO: 13364 - protein, 6 aa, synthetic construct
  REGION 1..6: note = Synthetic Construct
GKHQFK

SEQ ID NO: 13365 - protein, 6 aa, synthetic construct
  REGION 1..6: note = Synthetic Construct
GKHQGK

SEQ ID NO: 13366 - protein, 6 aa, synthetic construct
  REGION 1..6: note = Synthetic Construct
GKHQHK

SEQ ID NO: 13367 - protein, 6 aa, synthetic construct
  REGION 1..6: note = Synthetic Construct
GKHQIK

SEQ ID NO: 13368 - protein, 6 aa, synthetic construct
  REGION 1..6: note = Synthetic Construct
GKHQLK

SEQ ID NO: 13369 - protein, 6 aa, synthetic construct
  REGION 1..6: note = Synthetic Construct
GKHQNK

SEQ ID NO: 13370 - protein, 6 aa, synthetic construct
  REGION 1..6: note = Synthetic Construct
GKHQQK

SEQ ID NO: 13371 - protein, 6 aa, synthetic construct
  REGION 1..6: note = Synthetic Construct
GKHQRK

SEQ ID NO: 13372 - protein, 6 aa, synthetic construct
  REGION 1..6: note = Synthetic Construct
GKHQSK

SEQ ID NO: 13373 - protein, 6 aa, synthetic construct
  REGION 1..6: note = Synthetic Construct
GKHQTK

SEQ ID NO: 13374 - protein, 6 aa, synthetic construct
  REGION 1..6: note = Synthetic Construct
GKHQYK

SEQ ID NO: 13375 - protein, 6 aa, synthetic construct
  REGION 1..6: note = Synthetic Construct
GKHRAK

SEQ ID NO: 13376 - protein, 6 aa, synthetic construct
  REGION 1..6: note = Synthetic Construct
GKHRDK

SEQ ID NO: 13377 - protein, 6 aa, synthetic construct
  REGION 1..6: note = Synthetic Construct
GKHREK

SEQ ID NO: 13378 - protein, 6 aa, synthetic construct
  REGION 1..6: note = Synthetic Construct
GKHRFK

SEQ ID NO: 13379 - protein, 6 aa, synthetic construct
  REGION 1..6: note = Synthetic Construct
GKHRGK

SEQ ID NO: 13380 - protein, 6 aa, synthetic construct
  REGION 1..6: note = Synthetic Construct
GKHRHK

SEQ ID NO: 13381 - protein, 6 aa, synthetic construct
  REGION 1..6: note = Synthetic Construct
GKHRIK

SEQ ID NO: 13382 - protein, 6 aa, synthetic construct
  REGION 1..6: note = Synthetic Construct
GKHRLK

SEQ ID NO: 13383 - protein, 6 aa, synthetic construct
  REGION 1..6: note = Synthetic Construct
GKHRNK

SEQ ID NO: 13384 - protein, 6 aa, synthetic construct
  REGION 1..6: note = Synthetic Construct
GKHRQK

SEQ ID NO: 13385 - protein, 6 aa, synthetic construct
  REGION 1..6: note = Synthetic Construct
GKHRRK

SEQ ID NO: 13386 - protein, 6 aa, synthetic construct
  REGION 1..6: note = Synthetic Construct
GKHRSK

SEQ ID NO: 13387 - protein, 6 aa, synthetic construct
  REGION 1..6: note = Synthetic Construct
GKHRTK

SEQ ID NO: 13388 - protein, 6 aa, synthetic construct
  REGION 1..6: note = Synthetic Construct
GKHRYK

SEQ ID NO: 13389 - protein, 6 aa, synthetic construct
  REGION 1..6: note = Synthetic Construct
GKHSAK

SEQ ID NO: 13390 - protein, 6 aa, synthetic construct
  REGION 1..6: note = Synthetic Construct
GKHSDK

SEQ ID NO: 13391 - protein, 6 aa, synthetic construct
  REGION 1..6: note = Synthetic Construct
GKHSEK

SEQ ID NO: 13392 - protein, 6 aa, synthetic construct
  REGION 1..6: note = Synthetic Construct
GKHSFK

SEQ ID NO: 13393 - protein, 6 aa, synthetic construct
  REGION 1..6: note = Synthetic Construct
GKHSGK

SEQ ID NO: 13394 - protein, 6 aa, synthetic construct
  REGION 1..6: note = Synthetic Construct
GKHSHK

SEQ ID NO: 13395 - protein, 6 aa, synthetic construct
  REGION 1..6: note = Synthetic Construct
GKHSIK

SEQ ID NO: 13396 - protein, 6 aa, synthetic construct
  REGION 1..6: note = Synthetic Construct
GKHSLK

SEQ ID NO: 13397 - protein, 6 aa, synthetic construct
  REGION 1..6: note = Synthetic Construct
GKHSNK

SEQ ID NO: 13398 - protein, 6 aa, synthetic construct
  REGION 1..6: note = Synthetic Construct
GKHSQK

SEQ ID NO: 13399 - protein, 6 aa, synthetic construct
  REGION 1..6: note = Synthetic Construct
GKHSRK

SEQ ID NO: 13400 - protein, 6 aa, synthetic construct
  REGION 1..6: note = Synthetic Construct
GKHSSK

SEQ ID NO: 13401 - protein, 6 aa, synthetic construct
  REGION 1..6: note = Synthetic Construct
GKHSTK

SEQ ID NO: 13402 - protein, 6 aa, synthetic construct
  REGION 1..6: note = Synthetic Construct
GKHSYK

SEQ ID NO: 13403 - protein, 6 aa, synthetic construct
  REGION 1..6: note = Synthetic Construct
GKHTAK

SEQ ID NO: 13404 - protein, 6 aa, synthetic construct
  REGION 1..6: note = Synthetic Construct
GKHTDK

SEQ ID NO: 13405 - protein, 6 aa, synthetic construct
  REGION 1..6: note = Synthetic Construct
GKHTEK

SEQ ID NO: 13406 - protein, 6 aa, synthetic construct
  REGION 1..6: note = Synthetic Construct
GKHTFK

SEQ ID NO: 13407 - protein, 6 aa, synthetic construct
  REGION 1..6: note = Synthetic Construct
GKHTGK

SEQ ID NO: 13408 - protein, 6 aa, synthetic construct
  REGION 1..6: note = Synthetic Construct
GKHTHK

SEQ ID NO: 13409 - protein, 6 aa, synthetic construct
  REGION 1..6: note = Synthetic Construct
GKHTIK

SEQ ID NO: 13410 - protein, 6 aa, synthetic construct
  REGION 1..6: note = Synthetic Construct
GKHTLK

SEQ ID NO: 13411 - protein, 6 aa, synthetic construct
  REGION 1..6: note = Synthetic Construct
GKHTNK

SEQ ID NO: 13412 - protein, 6 aa, synthetic construct
  REGION 1..6: note = Synthetic Construct
GKHTQK

SEQ ID NO: 13413 - protein, 6 aa, synthetic construct
  REGION 1..6: note = Synthetic Construct
GKHTRK

SEQ ID NO: 13414 - protein, 6 aa, synthetic construct
  REGION 1..6: note = Synthetic Construct
GKHTSK

SEQ ID NO: 13415 - protein, 6 aa, synthetic construct
  REGION 1..6: note = Synthetic Construct
GKHTTK

SEQ ID NO: 13416 - protein, 6 aa, synthetic construct
  REGION 1..6: note = Synthetic Construct
GKHTYK

SEQ ID NO: 13417 - protein, 6 aa, synthetic construct
  REGION 1..6: note = Synthetic Construct
GKHYAK

SEQ ID NO: 13418 - protein, 6 aa, synthetic construct
  REGION 1..6: note = Synthetic Construct
GKHYDK

SEQ ID NO: 13419 - protein, 6 aa, synthetic construct
  REGION 1..6: note = Synthetic Construct
GKHYEK

SEQ ID NO: 13420 - protein, 6 aa, synthetic construct
  REGION 1..6: note = Synthetic Construct
GKHYFK

SEQ ID NO: 13421 - protein, 6 aa, synthetic construct
  REGION 1..6: note = Synthetic Construct
GKHYGK

SEQ ID NO: 13422 - protein, 6 aa, synthetic construct
  REGION 1..6: note = Synthetic Construct
GKHYHK

SEQ ID NO: 13423 - protein, 6 aa, synthetic construct
  REGION 1..6: note = Synthetic Construct
GKHYIK

SEQ ID NO: 13424 - protein, 6 aa, synthetic construct
  REGION 1..6: note = Synthetic Construct
GKHYLK

SEQ ID NO: 13425 - protein, 6 aa, synthetic construct
  REGION 1..6: note = Synthetic Construct
GKHYNK

SEQ ID NO: 13426 - protein, 6 aa, synthetic construct
  REGION 1..6: note = Synthetic Construct
GKHYQK

SEQ ID NO: 13427 - protein, 6 aa, synthetic construct
  REGION 1..6: note = Synthetic Construct
GKHYRK

SEQ ID NO: 13428 - protein, 6 aa, synthetic construct
  REGION 1..6: note = Synthetic Construct
GKHYSK

SEQ ID NO: 13429 - protein, 6 aa, synthetic construct
  REGION 1..6: note = Synthetic Construct
GKHYTK

SEQ ID NO: 13430 - protein, 6 aa, synthetic construct
  REGION 1..6: note = Synthetic Construct
GKHYYK

SEQ ID NO: 13431 - protein, 6 aa, synthetic construct
  REGION 1..6: note = Synthetic Construct
GKIAAK

SEQ ID NO: 13432 - protein, 6 aa, synthetic construct
  REGION 1..6: note = Synthetic Construct
GKIADK

SEQ ID NO: 13433 - protein, 6 aa, synthetic construct
  REGION 1..6: note = Synthetic Construct
GKIAEK

SEQ ID NO: 13434 - protein, 6 aa, synthetic construct
  REGION 1..6: note = Synthetic Construct
GKIAFK

SEQ ID NO: 13435 - protein, 6 aa, synthetic construct
  REGION 1..6: note = Synthetic Construct
GKIAGK

SEQ ID NO: 13436 - protein, 6 aa, synthetic construct
  REGION 1..6: note = Synthetic Construct
GKIAHK

SEQ ID NO: 13437 - protein, 6 aa, synthetic construct
  REGION 1..6: note = Synthetic Construct
GKIAIK

SEQ ID NO: 13438 - protein, 6 aa, synthetic construct
  REGION 1..6: note = Synthetic Construct
GKIALK

SEQ ID NO: 13439 - protein, 6 aa, synthetic construct
  REGION 1..6: note = Synthetic Construct
GKIANK

SEQ ID NO: 13440 - protein, 6 aa, synthetic construct
  REGION 1..6: note = Synthetic Construct
GKIAQK

SEQ ID NO: 13441 - protein, 6 aa, synthetic construct
  REGION 1..6: note = Synthetic Construct
GKIARK

SEQ ID NO: 13442 - protein, 6 aa, synthetic construct
  REGION 1..6: note = Synthetic Construct
GKIASK

SEQ ID NO: 13443 - protein, 6 aa, synthetic construct
  REGION 1..6: note = Synthetic Construct
GKIATK

SEQ ID NO: 13444 - protein, 6 aa, synthetic construct
  REGION 1..6: note = Synthetic Construct
GKIAYK

SEQ ID NO: 13445 - protein, 6 aa, synthetic construct
  REGION 1..6: note = Synthetic Construct
GKIDAK

SEQ ID NO: 13446 - protein, 6 aa, synthetic construct
  REGION 1..6: note = Synthetic Construct
GKIDDK

SEQ ID NO: 13447 - protein, 6 aa, synthetic construct
  REGION 1..6: note = Synthetic Construct
GKIDEK

SEQ ID NO: 13448 - protein, 6 aa, synthetic construct
  REGION 1..6: note = Synthetic Construct
GKIDFK

SEQ ID NO: 13449 - protein, 6 aa, synthetic construct
  REGION 1..6: note = Synthetic Construct
GKIDGK

SEQ ID NO: 13450 - protein, 6 aa, synthetic construct
  REGION 1..6: note = Synthetic Construct
GKIDHK

SEQ ID NO: 13451 - protein, 6 aa, synthetic construct
  REGION 1..6: note = Synthetic Construct
GKIDIK

SEQ ID NO: 13452 - protein, 6 aa, synthetic construct
  REGION 1..6: note = Synthetic Construct
GKIDLK

SEQ ID NO: 13453 - protein, 6 aa, synthetic construct
  REGION 1..6: note = Synthetic Construct
GKIDNK

SEQ ID NO: 13454 - protein, 6 aa, synthetic construct
  REGION 1..6: note = Synthetic Construct
GKIDQK

SEQ ID NO: 13455 - protein, 6 aa, synthetic construct
  REGION 1..6: note = Synthetic Construct
GKIDRK

SEQ ID NO: 13456 - protein, 6 aa, synthetic construct
  REGION 1..6: note = Synthetic Construct
GKIDSK

SEQ ID NO: 13457 - protein, 6 aa, synthetic construct
  REGION 1..6: note = Synthetic Construct
GKIDTK

SEQ ID NO: 13458 - protein, 6 aa, synthetic construct
  REGION 1..6: note = Synthetic Construct
GKIDYK

SEQ ID NO: 13459 - protein, 6 aa, synthetic construct
  REGION 1..6: note = Synthetic Construct
GKIEAK

SEQ ID NO: 13460 - protein, 6 aa, synthetic construct
  REGION 1..6: note = Synthetic Construct
GKIEDK

SEQ ID NO: 13461 - protein, 6 aa, synthetic construct
  REGION 1..6: note = Synthetic Construct
GKIEEK

SEQ ID NO: 13462 - protein, 6 aa, synthetic construct
  REGION 1..6: note = Synthetic Construct
GKIEFK

SEQ ID NO: 13463 - protein, 6 aa, synthetic construct
  REGION 1..6: note = Synthetic Construct
GKIEGK

SEQ ID NO: 13464 - protein, 6 aa, synthetic construct
  REGION 1..6: note = Synthetic Construct
GKIEHK

SEQ ID NO: 13465 - protein, 6 aa, synthetic construct
  REGION 1..6: note = Synthetic Construct
GKIEIK

SEQ ID NO: 13466 - protein, 6 aa, synthetic construct
  REGION 1..6: note = Synthetic Construct
GKIELK

SEQ ID NO: 13467 - protein, 6 aa, synthetic construct
  REGION 1..6: note = Synthetic Construct
GKIENK

SEQ ID NO: 13468 - protein, 6 aa, synthetic construct
  REGION 1..6: note = Synthetic Construct
GKIEQK

SEQ ID NO: 13469 - protein, 6 aa, synthetic construct
  REGION 1..6: note = Synthetic Construct
GKIERK

SEQ ID NO: 13470 - protein, 6 aa, synthetic construct
  REGION 1..6: note = Synthetic Construct
GKIESK

SEQ ID NO: 13471 - protein, 6 aa, synthetic construct
  REGION 1..6: note = Synthetic Construct
GKIETK

SEQ ID NO: 13472 - protein, 6 aa, synthetic construct
  REGION 1..6: note = Synthetic Construct
GKIEYK

SEQ ID NO: 13473 - protein, 6 aa, synthetic construct
  REGION 1..6: note = Synthetic Construct
GKIFAK

SEQ ID NO: 13474 - protein, 6 aa, synthetic construct
  REGION 1..6: note = Synthetic Construct
GKIFDK

SEQ ID NO: 13475 - protein, 6 aa, synthetic construct
  REGION 1..6: note = Synthetic Construct
GKIFEK

SEQ ID NO: 13476 - protein, 6 aa, synthetic construct
  REGION 1..6: note = Synthetic Construct
GKIFFK

SEQ ID NO: 13477 - protein, 6 aa, synthetic construct
  REGION 1..6: note = Synthetic Construct
GKIFGK

SEQ ID NO: 13478 - protein, 6 aa, synthetic construct
  REGION 1..6: note = Synthetic Construct
GKIFHK

SEQ ID NO: 13479 - protein, 6 aa, synthetic construct
  REGION 1..6: note = Synthetic Construct
GKIFIK

SEQ ID NO: 13480 - protein, 6 aa, synthetic construct
  REGION 1..6: note = Synthetic Construct
GKIFLK

SEQ ID NO: 13481 - protein, 6 aa, synthetic construct
  REGION 1..6: note = Synthetic Construct
GKIFNK

SEQ ID NO: 13482 - protein, 6 aa, synthetic construct
  REGION 1..6: note = Synthetic Construct
GKIFQK

SEQ ID NO: 13483 - protein, 6 aa, synthetic construct
  REGION 1..6: note = Synthetic Construct
GKIFRK

SEQ ID NO: 13484 - protein, 6 aa, synthetic construct
  REGION 1..6: note = Synthetic Construct
GKIFSK

SEQ ID NO: 13485 - protein, 6 aa, synthetic construct
  REGION 1..6: note = Synthetic Construct
GKIFTK

SEQ ID NO: 13486 - protein, 6 aa, synthetic construct
  REGION 1..6: note = Synthetic Construct
GKIFYK

SEQ ID NO: 13487 - protein, 6 aa, synthetic construct
  REGION 1..6: note = Synthetic Construct
GKIGAK

SEQ ID NO: 13488 - protein, 6 aa, synthetic construct
  REGION 1..6: note = Synthetic Construct
GKIGDK

SEQ ID NO: 13489 - protein, 6 aa, synthetic construct
  REGION 1..6: note = Synthetic Construct
GKIGEK

SEQ ID NO: 13490 - protein, 6 aa, synthetic construct
  REGION 1..6: note = Synthetic Construct
GKIGFK

SEQ ID NO: 13491 - protein, 6 aa, synthetic construct
  REGION 1..6: note = Synthetic Construct
GKIGGK

SEQ ID NO: 13492 - protein, 6 aa, synthetic construct
  REGION 1..6: note = Synthetic Construct
GKIGHK

SEQ ID NO: 13493 - protein, 6 aa, synthetic construct
  REGION 1..6: note = Synthetic Construct
GKIGIK

SEQ ID NO: 13494 - protein, 6 aa, synthetic construct
  REGION 1..6: note = Synthetic Construct
GKIGLK

SEQ ID NO: 13495 - protein, 6 aa, synthetic construct
  REGION 1..6: note = Synthetic Construct
GKIGNK

SEQ ID NO: 13496 - protein, 6 aa, synthetic construct
  REGION 1..6: note = Synthetic Construct
GKIGQK

SEQ ID NO: 13497 - protein, 6 aa, synthetic construct
  REGION 1..6: note = Synthetic Construct
GKIGRK

SEQ ID NO: 13498 - protein, 6 aa, synthetic construct
  REGION 1..6: note = Synthetic Construct
GKIGSK

SEQ ID NO: 13499 - protein, 6 aa, synthetic construct
  REGION 1..6: note = Synthetic Construct
GKIGTK

SEQ ID NO: 13500 - protein, 6 aa, synthetic construct
  REGION 1..6: note = Synthetic Construct
GKIGYK

SEQ ID NO: 13501 - protein, 6 aa, synthetic construct
  REGION 1..6: note = Synthetic Construct
GKIHAK

SEQ ID NO: 13502 - protein, 6 aa, synthetic construct
  REGION 1..6: note = Synthetic Construct
GKIHDK

SEQ ID NO: 13503 - protein, 6 aa, synthetic construct
  REGION 1..6: note = Synthetic Construct
GKIHEK

SEQ ID NO: 13504 - protein, 6 aa, synthetic construct
  REGION 1..6: note = Synthetic Construct
GKIHFK

SEQ ID NO: 13505 - protein, 6 aa, synthetic construct
  REGION 1..6: note = Synthetic Construct
GKIHGK

SEQ ID NO: 13506 - protein, 6 aa, synthetic construct
  REGION 1..6: note = Synthetic Construct
GKIHHK

SEQ ID NO: 13507 - protein, 6 aa, synthetic construct
  REGION 1..6: note = Synthetic Construct
GKIHIK

SEQ ID NO: 13508 - protein, 6 aa, synthetic construct
  REGION 1..6: note = Synthetic Construct
GKIHLK

SEQ ID NO: 13509 - protein, 6 aa, synthetic construct
  REGION 1..6: note = Synthetic Construct
GKIHNK

SEQ ID NO: 13510 - protein, 6 aa, synthetic construct
  REGION 1..6: note = Synthetic Construct
GKIHQK

SEQ ID NO: 13511 - protein, 6 aa, synthetic construct
  REGION 1..6: note = Synthetic Construct
GKIHRK

SEQ ID NO: 13512 - protein, 6 aa, synthetic construct
  REGION 1..6: note = Synthetic Construct
GKIHSK

SEQ ID NO: 13513 - protein, 6 aa, synthetic construct
  REGION 1..6: note = Synthetic Construct
GKIHTK

SEQ ID NO: 13514 - protein, 6 aa, synthetic construct
  REGION 1..6: note = Synthetic Construct
GKIHYK

SEQ ID NO: 13515 - protein, 6 aa, synthetic construct
  REGION 1..6: note = Synthetic Construct
GKIIAK

SEQ ID NO: 13516 - protein, 6 aa, synthetic construct
  REGION 1..6: note = Synthetic Construct
GKIIDK

SEQ ID NO: 13517 - protein, 6 aa, synthetic construct
  REGION 1..6: note = Synthetic Construct
GKIIEK

SEQ ID NO: 13518 - protein, 6 aa, synthetic construct
  REGION 1..6: note = Synthetic Construct
GKIIFK

SEQ ID NO: 13519 - protein, 6 aa, synthetic construct
  REGION 1..6: note = Synthetic Construct
GKIIGK

SEQ ID NO: 13520 - protein, 6 aa, synthetic construct
  REGION 1..6: note = Synthetic Construct
GKIIHK

SEQ ID NO: 13521 - protein, 6 aa, synthetic construct
  REGION 1..6: note = Synthetic Construct
GKIIIK

SEQ ID NO: 13522 - protein, 6 aa, synthetic construct
  REGION 1..6: note = Synthetic Construct
GKIILK

SEQ ID NO: 13523 - protein, 6 aa, synthetic construct
  REGION 1..6: note = Synthetic Construct
GKIINK

SEQ ID NO: 13524 - protein, 6 aa, synthetic construct
  REGION 1..6: note = Synthetic Construct
GKIIQK

SEQ ID NO: 13525 - protein, 6 aa, synthetic construct
  REGION 1..6: note = Synthetic Construct
GKIIRK

SEQ ID NO: 13526 - protein, 6 aa, synthetic construct
  REGION 1..6: note = Synthetic Construct
GKIISK

SEQ ID NO: 13527 - protein, 6 aa, synthetic construct
  REGION 1..6: note = Synthetic Construct
GKIITK

SEQ ID NO: 13528 - protein, 6 aa, synthetic construct
  REGION 1..6: note = Synthetic Construct
GKIIYK

SEQ ID NO: 13529 - protein, 6 aa, synthetic construct
  REGION 1..6: note = Synthetic Construct
GKILAK

SEQ ID NO: 13530 - protein, 6 aa, synthetic construct
  REGION 1..6: note = Synthetic Construct
GKILDK

SEQ ID NO: 13531 - protein, 6 aa, synthetic construct
  REGION 1..6: note = Synthetic Construct
GKILEK

SEQ ID NO: 13532 - protein, 6 aa, synthetic construct
  REGION 1..6: note = Synthetic Construct
GKILFK

SEQ ID NO: 13533 - protein, 6 aa, synthetic construct
  REGION 1..6: note = Synthetic Construct
GKILGK

SEQ ID NO: 13534 - protein, 6 aa, synthetic construct
  REGION 1..6: note = Synthetic Construct
GKILHK

SEQ ID NO: 13535 - protein, 6 aa, synthetic construct
  REGION 1..6: note = Synthetic Construct
GKILIK

SEQ ID NO: 13536 - protein, 6 aa, synthetic construct
  REGION 1..6: note = Synthetic Construct
GKILLK

SEQ ID NO: 13537 - protein, 6 aa, synthetic construct
  REGION 1..6: note = Synthetic Construct
GKILNK

SEQ ID NO: 13538 - protein, 6 aa, synthetic construct
  REGION 1..6: note = Synthetic Construct
GKILQK

SEQ ID NO: 13539 - protein, 6 aa, synthetic construct
  REGION 1..6: note = Synthetic Construct
GKILRK

SEQ ID NO: 13540 - protein, 6 aa, synthetic construct
  REGION 1..6: note = Synthetic Construct
GKILSK

SEQ ID NO: 13541 - protein, 6 aa, synthetic construct
  REGION 1..6: note = Synthetic Construct
GKILTK

SEQ ID NO: 13542 - protein, 6 aa, synthetic construct
  REGION 1..6: note = Synthetic Construct
GKILYK

SEQ ID NO: 13543 - protein, 6 aa, synthetic construct
  REGION 1..6: note = Synthetic Construct
GKINAK

SEQ ID NO: 13544 - protein, 6 aa, synthetic construct
  REGION 1..6: note = Synthetic Construct
GKINDK

SEQ ID NO: 13545 - protein, 6 aa, synthetic construct
  REGION 1..6: note = Synthetic Construct
GKINEK

SEQ ID NO: 13546 - protein, 6 aa, synthetic construct
  REGION 1..6: note = Synthetic Construct
GKINFK

SEQ ID NO: 13547 - protein, 6 aa, synthetic construct
  REGION 1..6: note = Synthetic Construct
GKINGK

SEQ ID NO: 13548 - protein, 6 aa, synthetic construct
  REGION 1..6: note = Synthetic Construct
GKINHK

SEQ ID NO: 13549 - protein, 6 aa, synthetic construct
  REGION 1..6: note = Synthetic Construct
GKINIK

SEQ ID NO: 13550 - protein, 6 aa, synthetic construct
  REGION 1..6: note = Synthetic Construct
GKINLK

SEQ ID NO: 13551 - protein, 6 aa, synthetic construct
  REGION 1..6: note = Synthetic Construct
GKINNK

SEQ ID NO: 13552 - protein, 6 aa, synthetic construct
  REGION 1..6: note = Synthetic Construct
GKINQK

SEQ ID NO: 13553 - protein, 6 aa, synthetic construct
  REGION 1..6: note = Synthetic Construct
GKINRK

SEQ ID NO: 13554 - protein, 6 aa, synthetic construct
  REGION 1..6: note = Synthetic Construct
GKINSK

SEQ ID NO: 13555 - protein, 6 aa, synthetic construct
  REGION 1..6: note = Synthetic Construct
GKINTK

SEQ ID NO: 13556 - protein, 6 aa, synthetic construct
  REGION 1..6: note = Synthetic Construct
GKINYK

SEQ ID NO: 13557 - protein, 6 aa, synthetic construct
  REGION 1..6: note = Synthetic Construct
GKIQAK

SEQ ID NO: 13558 - protein, 6 aa, synthetic construct
  REGION 1..6: note = Synthetic Construct
GKIQDK

SEQ ID NO: 13559 - protein, 6 aa, synthetic construct
  REGION 1..6: note = Synthetic Construct
GKIQEK

SEQ ID NO: 13560 - protein, 6 aa, synthetic construct
  REGION 1..6: note = Synthetic Construct
GKIQFK

SEQ ID NO: 13561 - protein, 6 aa, synthetic construct
  REGION 1..6: note = Synthetic Construct
GKIQGK

SEQ ID NO: 13562 - protein, 6 aa, synthetic construct
  REGION 1..6: note = Synthetic Construct
GKIQHK

SEQ ID NO: 13563 - protein, 6 aa, synthetic construct
  REGION 1..6: note = Synthetic Construct
GKIQIK

SEQ ID NO: 13564 - protein, 6 aa, synthetic construct
  REGION 1..6: note = Synthetic Construct
GKIQLK

SEQ ID NO: 13565 - protein, 6 aa, synthetic construct
  REGION 1..6: note = Synthetic Construct
GKIQNK

SEQ ID NO: 13566 - protein, 6 aa, synthetic construct
  REGION 1..6: note = Synthetic Construct
GKIQQK

SEQ ID NO: 13567 - protein, 6 aa, synthetic construct
  REGION 1..6: note = Synthetic Construct
GKIQRK

SEQ ID NO: 13568 - protein, 6 aa, synthetic construct
  REGION 1..6: note = Synthetic Construct
GKIQSK

SEQ ID NO: 13569 - protein, 6 aa, synthetic construct
  REGION 1..6: note = Synthetic Construct
GKIQTK

SEQ ID NO: 13570 - protein, 6 aa, synthetic construct
  REGION 1..6: note = Synthetic Construct
GKIQYK

SEQ ID NO: 13571 - protein, 6 aa, synthetic construct
  REGION 1..6: note = Synthetic Construct
GKIRAK

SEQ ID NO: 13572 - protein, 6 aa, synthetic construct
  REGION 1..6: note = Synthetic Construct
GKIRDK

SEQ ID NO: 13573 - protein, 6 aa, synthetic construct
  REGION 1..6: note = Synthetic Construct
GKIREK

SEQ ID NO: 13574 - protein, 6 aa, synthetic construct
  REGION 1..6: note = Synthetic Construct
GKIRFK

SEQ ID NO: 13575 - protein, 6 aa, synthetic construct
  REGION 1..6: note = Synthetic Construct
GKIRGK

SEQ ID NO: 13576 - protein, 6 aa, synthetic construct
  REGION 1..6: note = Synthetic Construct
GKIRHK

SEQ ID NO: 13577 - protein, 6 aa, synthetic construct
  REGION 1..6: note = Synthetic Construct
GKIRIK

SEQ ID NO: 13578 - protein, 6 aa, synthetic construct
  REGION 1..6: note = Synthetic Construct
GKIRLK

SEQ ID NO: 13579 - protein, 6 aa, synthetic construct
  REGION 1..6: note = Synthetic Construct
GKIRNK

SEQ ID NO: 13580 - protein, 6 aa, synthetic construct
  REGION 1..6: note = Synthetic Construct
GKIRQK

SEQ ID NO: 13581 - protein, 6 aa, synthetic construct
  REGION 1..6: note = Synthetic Construct
GKIRRK

SEQ ID NO: 13582 - protein, 6 aa, synthetic construct
  REGION 1..6: note = Synthetic Construct
GKIRSK

SEQ ID NO: 13583 - protein, 6 aa, synthetic construct
  REGION 1..6: note = Synthetic Construct
GKIRTK

SEQ ID NO: 13584 - protein, 6 aa, synthetic construct
  REGION 1..6: note = Synthetic Construct
GKIRYK

SEQ ID NO: 13585 - protein, 6 aa, synthetic construct
  REGION 1..6: note = Synthetic Construct
GKISAK

SEQ ID NO: 13586 - protein, 6 aa, synthetic construct
  REGION 1..6: note = Synthetic Construct
GKISDK

SEQ ID NO: 13587 - protein, 6 aa, synthetic construct
  REGION 1..6: note = Synthetic Construct
GKISEK

SEQ ID NO: 13588 - protein, 6 aa, synthetic construct
  REGION 1..6: note = Synthetic Construct
GKISFK

SEQ ID NO: 13589 - protein, 6 aa, synthetic construct
  REGION 1..6: note = Synthetic Construct
GKISGK

SEQ ID NO: 13590 - protein, 6 aa, synthetic construct
  REGION 1..6: note = Synthetic Construct
GKISHK

SEQ ID NO: 13591 - protein, 6 aa, synthetic construct
  REGION 1..6: note = Synthetic Construct
GKISIK

SEQ ID NO: 13592 - protein, 6 aa, synthetic construct
  REGION 1..6: note = Synthetic Construct
GKISLK

SEQ ID NO: 13593 - protein, 6 aa, synthetic construct
  REGION 1..6: note = Synthetic Construct
GKISNK

SEQ ID NO: 13594 - protein, 6 aa, synthetic construct
  REGION 1..6: note = Synthetic Construct
GKISQK

SEQ ID NO: 13595 - protein, 6 aa, synthetic construct
  REGION 1..6: note = Synthetic Construct
GKISRK

SEQ ID NO: 13596 - protein, 6 aa, synthetic construct
  REGION 1..6: note = Synthetic Construct
GKISSK

SEQ ID NO: 13597 - protein, 6 aa, synthetic construct
  REGION 1..6: note = Synthetic Construct
GKISTK

SEQ ID NO: 13598 - protein, 6 aa, synthetic construct
  REGION 1..6: note = Synthetic Construct
GKISYK

SEQ ID NO: 13599 - protein, 6 aa, synthetic construct
  REGION 1..6: note = Synthetic Construct
GKITAK

SEQ ID NO: 13600 - protein, 6 aa, synthetic construct
  REGION 1..6: note = Synthetic Construct
GKITDK

SEQ ID NO: 13601 - protein, 6 aa, synthetic construct
  REGION 1..6: note = Synthetic Construct
GKITEK

SEQ ID NO: 13602 - protein, 6 aa, synthetic construct
  REGION 1..6: note = Synthetic Construct
GKITFK

SEQ ID NO: 13603 - protein, 6 aa, synthetic construct
  REGION 1..6: note = Synthetic Construct
GKITGK

SEQ ID NO: 13604 - protein, 6 aa, synthetic construct
  REGION 1..6: note = Synthetic Construct
GKITHK

SEQ ID NO: 13605 - protein, 6 aa, synthetic construct
  REGION 1..6: note = Synthetic Construct
GKITIK

SEQ ID NO: 13606 - protein, 6 aa, synthetic construct
  REGION 1..6: note = Synthetic Construct
GKITLK

SEQ ID NO: 13607 - protein, 6 aa, synthetic construct
  REGION 1..6: note = Synthetic Construct
GKITNK

SEQ ID NO: 13608 - protein, 6 aa, synthetic construct
  REGION 1..6: note = Synthetic Construct
GKITQK

SEQ ID NO: 13609 - protein, 6 aa, synthetic construct
  REGION 1..6: note = Synthetic Construct
GKITRK

SEQ ID NO: 13610 - protein, 6 aa, synthetic construct
  REGION 1..6: note = Synthetic Construct
GKITSK

SEQ ID NO: 13611 - protein, 6 aa, synthetic construct
  REGION 1..6: note = Synthetic Construct
GKITTK

SEQ ID NO: 13612 - protein, 6 aa, synthetic construct
  REGION 1..6: note = Synthetic Construct
GKITYK

SEQ ID NO: 13613 - protein, 6 aa, synthetic construct
  REGION 1..6: note = Synthetic Construct
GKIYAK

SEQ ID NO: 13614 - protein, 6 aa, synthetic construct
  REGION 1..6: note = Synthetic Construct
GKIYDK

SEQ ID NO: 13615 - protein, 6 aa, synthetic construct
  REGION 1..6: note = Synthetic Construct
GKIYEK

SEQ ID NO: 13616 - protein, 6 aa, synthetic construct
  REGION 1..6: note = Synthetic Construct
GKIYFK

SEQ ID NO: 13617 - protein, 6 aa, synthetic construct
  REGION 1..6: note = Synthetic Construct
GKIYGK

SEQ ID NO: 13618 - protein, 6 aa, synthetic construct
  REGION 1..6: note = Synthetic Construct
GKIYHK

SEQ ID NO: 13619 - protein, 6 aa, synthetic construct
  REGION 1..6: note = Synthetic Construct
GKIYIK

SEQ ID NO: 13620 - protein, 6 aa, synthetic construct
  REGION 1..6: note = Synthetic Construct
GKIYLK

SEQ ID NO: 13621 - protein, 6 aa, synthetic construct
  REGION 1..6: note = Synthetic Construct
GKIYNK

SEQ ID NO: 13622 - protein, 6 aa, synthetic construct
  REGION 1..6: note = Synthetic Construct
GKIYQK

SEQ ID NO: 13623 - protein, 6 aa, synthetic construct
  REGION 1..6: note = Synthetic Construct
GKIYRK

SEQ ID NO: 13624 - protein, 6 aa, synthetic construct
  REGION 1..6: note = Synthetic Construct
GKIYSK

SEQ ID NO: 13625 - protein, 6 aa, synthetic construct
  REGION 1..6: note = Synthetic Construct
GKIYTK

SEQ ID NO: 13626 - protein, 6 aa, synthetic construct
  REGION 1..6: note = Synthetic Construct
GKIYYK

SEQ ID NO: 13627 - protein, 6 aa, synthetic construct
  REGION 1..6: note = Synthetic Construct
GKLAAK

SEQ ID NO: 13628 - protein, 6 aa, synthetic construct
  REGION 1..6: note = Synthetic Construct
GKLADK

SEQ ID NO: 13629 - protein, 6 aa, synthetic construct
  REGION 1..6: note = Synthetic Construct
GKLAEK

SEQ ID NO: 13630 - protein, 6 aa, synthetic construct
  REGION 1..6: note = Synthetic Construct
GKLAFK

SEQ ID NO: 13631 - protein, 6 aa, synthetic construct
  REGION 1..6: note = Synthetic Construct
GKLAGK

SEQ ID NO: 13632 - protein, 6 aa, synthetic construct
  REGION 1..6: note = Synthetic Construct
GKLAHK

SEQ ID NO: 13633 - protein, 6 aa, synthetic construct
  REGION 1..6: note = Synthetic Construct
GKLAIK

SEQ ID NO: 13634 - protein, 6 aa, synthetic construct
  REGION 1..6: note = Synthetic Construct
GKLALK

SEQ ID NO: 13635 - protein, 6 aa, synthetic construct
  REGION 1..6: note = Synthetic Construct
GKLANK

SEQ ID NO: 13636 - protein, 6 aa, synthetic construct
  REGION 1..6: note = Synthetic Construct
GKLAQK

SEQ ID NO: 13637 - protein, 6 aa, synthetic construct
  REGION 1..6: note = Synthetic Construct
GKLARK

SEQ ID NO: 13638 - protein, 6 aa, synthetic construct
  REGION 1..6: note = Synthetic Construct
GKLASK

SEQ ID NO: 13639 - protein, 6 aa, synthetic construct
  REGION 1..6: note = Synthetic Construct
GKLATK

SEQ ID NO: 13640 - protein, 6 aa, synthetic construct
  REGION 1..6: note = Synthetic Construct
GKLAYK

SEQ ID NO: 13641 - protein, 6 aa, synthetic construct
  REGION 1..6: note = Synthetic Construct
GKLDAK

SEQ ID NO: 13642 - protein, 6 aa, synthetic construct
  REGION 1..6: note = Synthetic Construct
GKLDDK

SEQ ID NO: 13643 - protein, 6 aa, synthetic construct
  REGION 1..6: note = Synthetic Construct
GKLDEK

SEQ ID NO: 13644 - protein, 6 aa, synthetic construct
  REGION 1..6: note = Synthetic Construct
GKLDFK

SEQ ID NO: 13645 - protein, 6 aa, synthetic construct
  REGION 1..6: note = Synthetic Construct
GKLDGK

SEQ ID NO: 13646 - protein, 6 aa, synthetic construct
  REGION 1..6: note = Synthetic Construct
GKLDHK

SEQ ID NO: 13647 - protein, 6 aa, synthetic construct
  REGION 1..6: note = Synthetic Construct
GKLDIK

SEQ ID NO: 13648 - protein, 6 aa, synthetic construct
  REGION 1..6: note = Synthetic Construct
GKLDLK

SEQ ID NO: 13649 - protein, 6 aa, synthetic construct
  REGION 1..6: note = Synthetic Construct
GKLDNK

SEQ ID NO: 13650 - protein, 6 aa, synthetic construct
  REGION 1..6: note = Synthetic Construct
GKLDQK

SEQ ID NO: 13651 - protein, 6 aa, synthetic construct
  REGION 1..6: note = Synthetic Construct
GKLDRK

SEQ ID NO: 13652 - protein, 6 aa, synthetic construct
  REGION 1..6: note = Synthetic Construct
GKLDSK

SEQ ID NO: 13653 - protein, 6 aa, synthetic construct
  REGION 1..6: note = Synthetic Construct
GKLDTK

SEQ ID NO: 13654 - protein, 6 aa, synthetic construct
  REGION 1..6: note = Synthetic Construct
GKLDYK

SEQ ID NO: 13655 - protein, 6 aa, synthetic construct
  REGION 1..6: note = Synthetic Construct
GKLEAK

SEQ ID NO: 13656 - protein, 6 aa, synthetic construct
  REGION 1..6: note = Synthetic Construct
GKLEDK

SEQ ID NO: 13657 - protein, 6 aa, synthetic construct
  REGION 1..6: note = Synthetic Construct
GKLEEK

SEQ ID NO: 13658 - protein, 6 aa, synthetic construct
  REGION 1..6: note = Synthetic Construct
GKLEFK

SEQ ID NO: 13659 - protein, 6 aa, synthetic construct
  REGION 1..6: note = Synthetic Construct
GKLEGK

SEQ ID NO: 13660 - protein, 6 aa, synthetic construct
  REGION 1..6: note = Synthetic Construct
GKLEHK

SEQ ID NO: 13661 - protein, 6 aa, synthetic construct
  REGION 1..6: note = Synthetic Construct
GKLEIK

SEQ ID NO: 13662 - protein, 6 aa, synthetic construct
  REGION 1..6: note = Synthetic Construct
GKLELK

SEQ ID NO: 13663 - protein, 6 aa, synthetic construct
  REGION 1..6: note = Synthetic Construct
GKLENK

SEQ ID NO: 13664 - protein, 6 aa, synthetic construct
  REGION 1..6: note = Synthetic Construct
GKLEQK

SEQ ID NO: 13665 - protein, 6 aa, synthetic construct
  REGION 1..6: note = Synthetic Construct
GKLERK

SEQ ID NO: 13666 - protein, 6 aa, synthetic construct
  REGION 1..6: note = Synthetic Construct
GKLESK

SEQ ID NO: 13667 - protein, 6 aa, synthetic construct
  REGION 1..6: note = Synthetic Construct
GKLETK

SEQ ID NO: 13668 - protein, 6 aa, synthetic construct
  REGION 1..6: note = Synthetic Construct
GKLEYK

SEQ ID NO: 13669 - protein, 6 aa, synthetic construct
  REGION 1..6: note = Synthetic Construct
GKLFAK

SEQ ID NO: 13670 - protein, 6 aa, synthetic construct
  REGION 1..6: note = Synthetic Construct
GKLFDK

SEQ ID NO: 13671 - protein, 6 aa, synthetic construct
  REGION 1..6: note = Synthetic Construct
GKLFEK

SEQ ID NO: 13672 - protein, 6 aa, synthetic construct
  REGION 1..6: note = Synthetic Construct
GKLFFK

SEQ ID NO: 13673 - protein, 6 aa, synthetic construct
  REGION 1..6: note = Synthetic Construct
GKLFGK

SEQ ID NO: 13674 - protein, 6 aa, synthetic construct
  REGION 1..6: note = Synthetic Construct
GKLFHK

SEQ ID NO: 13675 - protein, 6 aa, synthetic construct
  REGION 1..6: note = Synthetic Construct
GKLFIK

SEQ ID NO: 13676 - protein, 6 aa, synthetic construct
  REGION 1..6: note = Synthetic Construct
GKLFLK

SEQ ID NO: 13677 - protein, 6 aa, synthetic construct
  REGION 1..6: note = Synthetic Construct
GKLFNK

SEQ ID NO: 13678 - protein, 6 aa, synthetic construct
  REGION 1..6: note = Synthetic Construct
GKLFQK

SEQ ID NO: 13679 - protein, 6 aa, synthetic construct
  REGION 1..6: note = Synthetic Construct
GKLFRK

SEQ ID NO: 13680 - protein, 6 aa, synthetic construct
  REGION 1..6: note = Synthetic Construct
GKLFSK

SEQ ID NO: 13681 - protein, 6 aa, synthetic construct
  REGION 1..6: note = Synthetic Construct
GKLFTK

SEQ ID NO: 13682 - protein, 6 aa, synthetic construct
  REGION 1..6: note = Synthetic Construct
GKLFYK

SEQ ID NO: 13683 - protein, 6 aa, synthetic construct
  REGION 1..6: note = Synthetic Construct
GKLGAK

SEQ ID NO: 13684 - protein, 6 aa, synthetic construct
  REGION 1..6: note = Synthetic Construct
GKLGDK

SEQ ID NO: 13685 - protein, 6 aa, synthetic construct
  REGION 1..6: note = Synthetic Construct
GKLGEK

SEQ ID NO: 13686 - protein, 6 aa, synthetic construct
  REGION 1..6: note = Synthetic Construct
GKLGFK

SEQ ID NO: 13687 - protein, 6 aa, synthetic construct
  REGION 1..6: note = Synthetic Construct
GKLGGK

SEQ ID NO: 13688 - protein, 6 aa, synthetic construct
  REGION 1..6: note = Synthetic Construct
GKLGHK

SEQ ID NO: 13689 - protein, 6 aa, synthetic construct
  REGION 1..6: note = Synthetic Construct
GKLGIK

SEQ ID NO: 13690 - protein, 6 aa, synthetic construct
  REGION 1..6: note = Synthetic Construct
GKLGLK

SEQ ID NO: 13691 - protein, 6 aa, synthetic construct
  REGION 1..6: note = Synthetic Construct
GKLGNK

SEQ ID NO: 13692 - protein, 6 aa, synthetic construct
  REGION 1..6: note = Synthetic Construct
GKLGQK

SEQ ID NO: 13693 - protein, 6 aa, synthetic construct
  REGION 1..6: note = Synthetic Construct
GKLGRK

SEQ ID NO: 13694 - protein, 6 aa, synthetic construct
  REGION 1..6: note = Synthetic Construct
GKLGSK

SEQ ID NO: 13695 - protein, 6 aa, synthetic construct
  REGION 1..6: note = Synthetic Construct
GKLGTK

SEQ ID NO: 13696 - protein, 6 aa, synthetic construct
  REGION 1..6: note = Synthetic Construct
GKLGYK

SEQ ID NO: 13697 - protein, 6 aa, synthetic construct
  REGION 1..6: note = Synthetic Construct
GKLHAK

SEQ ID NO: 13698 - protein, 6 aa, synthetic construct
  REGION 1..6: note = Synthetic Construct
GKLHDK

SEQ ID NO: 13699 - protein, 6 aa, synthetic construct
  REGION 1..6: note = Synthetic Construct
GKLHEK

SEQ ID NO: 13700 - protein, 6 aa, synthetic construct
  REGION 1..6: note = Synthetic Construct
GKLHFK

SEQ ID NO: 13701 - protein, 6 aa, synthetic construct
  REGION 1..6: note = Synthetic Construct
GKLHGK

SEQ ID NO: 13702 - protein, 6 aa, synthetic construct
  REGION 1..6: note = Synthetic Construct
GKLHHK

SEQ ID NO: 13703 - protein, 6 aa, synthetic construct
  REGION 1..6: note = Synthetic Construct
GKLHIK

SEQ ID NO: 13704 - protein, 6 aa, synthetic construct
  REGION 1..6: note = Synthetic Construct
GKLHLK

SEQ ID NO: 13705 - protein, 6 aa, synthetic construct
  REGION 1..6: note = Synthetic Construct
GKLHNK

SEQ ID NO: 13706 - protein, 6 aa, synthetic construct
  REGION 1..6: note = Synthetic Construct
GKLHQK

SEQ ID NO: 13707 - protein, 6 aa, synthetic construct
  REGION 1..6: note = Synthetic Construct
GKLHRK

SEQ ID NO: 13708 - protein, 6 aa, synthetic construct
  REGION 1..6: note = Synthetic Construct
GKLHSK

SEQ ID NO: 13709 - protein, 6 aa, synthetic construct
  REGION 1..6: note = Synthetic Construct
GKLHTK

SEQ ID NO: 13710 - protein, 6 aa, synthetic construct
  REGION 1..6: note = Synthetic Construct
GKLHYK

SEQ ID NO: 13711 - protein, 6 aa, synthetic construct
  REGION 1..6: note = Synthetic Construct
GKLIAK

SEQ ID NO: 13712 - protein, 6 aa, synthetic construct
  REGION 1..6: note = Synthetic Construct
GKLIDK

SEQ ID NO: 13713 - protein, 6 aa, synthetic construct
  REGION 1..6: note = Synthetic Construct
GKLIEK

SEQ ID NO: 13714 - protein, 6 aa, synthetic construct
  REGION 1..6: note = Synthetic Construct
GKLIFK

SEQ ID NO: 13715 - protein, 6 aa, synthetic construct
  REGION 1..6: note = Synthetic Construct
GKLIGK

SEQ ID NO: 13716 - protein, 6 aa, synthetic construct
  REGION 1..6: note = Synthetic Construct
GKLIHK

SEQ ID NO: 13717 - protein, 6 aa, synthetic construct
  REGION 1..6: note = Synthetic Construct
GKLIIK

SEQ ID NO: 13718 - protein, 6 aa, synthetic construct
  REGION 1..6: note = Synthetic Construct
GKLILK

SEQ ID NO: 13719 - protein, 6 aa, synthetic construct
  REGION 1..6: note = Synthetic Construct
GKLINK

SEQ ID NO: 13720 - protein, 6 aa, synthetic construct
  REGION 1..6: note = Synthetic Construct
GKLIQK

SEQ ID NO: 13721 - protein, 6 aa, synthetic construct
  REGION 1..6: note = Synthetic Construct
GKLIRK

SEQ ID NO: 13722 - protein, 6 aa, synthetic construct
  REGION 1..6: note = Synthetic Construct
GKLISK

SEQ ID NO: 13723 - protein, 6 aa, synthetic construct
  REGION 1..6: note = Synthetic Construct
GKLITK

SEQ ID NO: 13724 - protein, 6 aa, synthetic construct
  REGION 1..6: note = Synthetic Construct
GKLIYK

SEQ ID NO: 13725 - protein, 6 aa, synthetic construct
  REGION 1..6: note = Synthetic Construct
GKLLAK

SEQ ID NO: 13726 - protein, 6 aa, synthetic construct
  REGION 1..6: note = Synthetic Construct
GKLLDK

SEQ ID NO: 13727 - protein, 6 aa, synthetic construct
  REGION 1..6: note = Synthetic Construct
GKLLEK

SEQ ID NO: 13728 - protein, 6 aa, synthetic construct
  REGION 1..6: note = Synthetic Construct
GKLLFK

SEQ ID NO: 13729 - protein, 6 aa, synthetic construct
  REGION 1..6: note = Synthetic Construct
GKLLGK

SEQ ID NO: 13730 - protein, 6 aa, synthetic construct
  REGION 1..6: note = Synthetic Construct
GKLLHK

SEQ ID NO: 13731 - protein, 6 aa, synthetic construct
  REGION 1..6: note = Synthetic Construct
GKLLIK

SEQ ID NO: 13732 - protein, 6 aa, synthetic construct
  REGION 1..6: note = Synthetic Construct
GKLLLK

SEQ ID NO: 13733 - protein, 6 aa, synthetic construct
  REGION 1..6: note = Synthetic Construct
GKLLNK

SEQ ID NO: 13734 - protein, 6 aa, synthetic construct
  REGION 1..6: note = Synthetic Construct
GKLLQK

SEQ ID NO: 13735 - protein, 6 aa, synthetic construct
  REGION 1..6: note = Synthetic Construct
GKLLRK

SEQ ID NO: 13736 - protein, 6 aa, synthetic construct
  REGION 1..6: note = Synthetic Construct
GKLLSK

SEQ ID NO: 13737 - protein, 6 aa, synthetic construct
  REGION 1..6: note = Synthetic Construct
GKLLTK

SEQ ID NO: 13738 - protein, 6 aa, synthetic construct
  REGION 1..6: note = Synthetic Construct
GKLLYK

SEQ ID NO: 13739 - protein, 6 aa, synthetic construct
  REGION 1..6: note = Synthetic Construct
GKLNAK

SEQ ID NO: 13740 - protein, 6 aa, synthetic construct
  REGION 1..6: note = Synthetic Construct
GKLNDK

SEQ ID NO: 13741 - protein, 6 aa, synthetic construct
  REGION 1..6: note = Synthetic Construct
GKLNEK

SEQ ID NO: 13742 - protein, 6 aa, synthetic construct
  REGION 1..6: note = Synthetic Construct
GKLNFK

SEQ ID NO: 13743 - protein, 6 aa, synthetic construct
  REGION 1..6: note = Synthetic Construct
GKLNGK

SEQ ID NO: 13744 - protein, 6 aa, synthetic construct
  REGION 1..6: note = Synthetic Construct
GKLNHK

SEQ ID NO: 13745 - protein, 6 aa, synthetic construct
  REGION 1..6: note = Synthetic Construct
GKLNIK

SEQ ID NO: 13746 - protein, 6 aa, synthetic construct
  REGION 1..6: note = Synthetic Construct
GKLNLK

SEQ ID NO: 13747 - protein, 6 aa, synthetic construct
  REGION 1..6: note = Synthetic Construct
GKLNNK

SEQ ID NO: 13748 - protein, 6 aa, synthetic construct
  REGION 1..6: note = Synthetic Construct
GKLNQK

SEQ ID NO: 13749 - protein, 6 aa, synthetic construct
  REGION 1..6: note = Synthetic Construct
GKLNRK

SEQ ID NO: 13750 - protein, 6 aa, synthetic construct
  REGION 1..6: note = Synthetic Construct
GKLNSK

SEQ ID NO: 13751 - protein, 6 aa, synthetic construct
  REGION 1..6: note = Synthetic Construct
GKLNTK

SEQ ID NO: 13752 - protein, 6 aa, synthetic construct
  REGION 1..6: note = Synthetic Construct
GKLNYK

SEQ ID NO: 13753 - protein, 6 aa, synthetic construct
  REGION 1..6: note = Synthetic Construct
GKLQAK

SEQ ID NO: 13754 - protein, 6 aa, synthetic construct
  REGION 1..6: note = Synthetic Construct
GKLQDK

SEQ ID NO: 13755 - protein, 6 aa, synthetic construct
  REGION 1..6: note = Synthetic Construct
GKLQEK

SEQ ID NO: 13756 - protein, 6 aa, synthetic construct
  REGION 1..6: note = Synthetic Construct
GKLQFK

SEQ ID NO: 13757 - protein, 6 aa, synthetic construct
  REGION 1..6: note = Synthetic Construct
GKLQGK

SEQ ID NO: 13758 - protein, 6 aa, synthetic construct
  REGION 1..6: note = Synthetic Construct
GKLQHK

SEQ ID NO: 13759 - protein, 6 aa, synthetic construct
  REGION 1..6: note = Synthetic Construct
GKLQIK

SEQ ID NO: 13760 - protein, 6 aa, synthetic construct
  REGION 1..6: note = Synthetic Construct
GKLQLK

SEQ ID NO: 13761 - protein, 6 aa, synthetic construct
  REGION 1..6: note = Synthetic Construct
GKLQNK

SEQ ID NO: 13762 - protein, 6 aa, synthetic construct
  REGION 1..6: note = Synthetic Construct
GKLQQK

SEQ ID NO: 13763 - protein, 6 aa, synthetic construct
  REGION 1..6: note = Synthetic Construct
GKLQRK

SEQ ID NO: 13764 - protein, 6 aa, synthetic construct
  REGION 1..6: note = Synthetic Construct
GKLQSK

SEQ ID NO: 13765 - protein, 6 aa, synthetic construct
  REGION 1..6: note = Synthetic Construct
GKLQTK

SEQ ID NO: 13766 - protein, 6 aa, synthetic construct
  REGION 1..6: note = Synthetic Construct
GKLQYK

SEQ ID NO: 13767 - protein, 6 aa, synthetic construct
  REGION 1..6: note = Synthetic Construct
GKLRAK

SEQ ID NO: 13768 - protein, 6 aa, synthetic construct
  REGION 1..6: note = Synthetic Construct
GKLRDK

SEQ ID NO: 13769 - protein, 6 aa, synthetic construct
  REGION 1..6: note = Synthetic Construct
GKLREK

SEQ ID NO: 13770 - protein, 6 aa, synthetic construct
  REGION 1..6: note = Synthetic Construct
GKLRFK

SEQ ID NO: 13771 - protein, 6 aa, synthetic construct
  REGION 1..6: note = Synthetic Construct
GKLRGK

SEQ ID NO: 13772 - protein, 6 aa, synthetic construct
  REGION 1..6: note = Synthetic Construct
GKLRHK

SEQ ID NO: 13773 - protein, 6 aa, synthetic construct
  REGION 1..6: note = Synthetic Construct
GKLRIK

SEQ ID NO: 13774 - protein, 6 aa, synthetic construct
  REGION 1..6: note = Synthetic Construct
GKLRLK

SEQ ID NO: 13775 - protein, 6 aa, synthetic construct
  REGION 1..6: note = Synthetic Construct
GKLRNK

SEQ ID NO: 13776 - protein, 6 aa, synthetic construct
  REGION 1..6: note = Synthetic Construct
GKLRQK

SEQ ID NO: 13777 - protein, 6 aa, synthetic construct
  REGION 1..6: note = Synthetic Construct
GKLRRK

SEQ ID NO: 13778 - protein, 6 aa, synthetic construct
  REGION 1..6: note = Synthetic Construct
GKLRSK

SEQ ID NO: 13779 - protein, 6 aa, synthetic construct
  REGION 1..6: note = Synthetic Construct
GKLRTK

SEQ ID NO: 13780 - protein, 6 aa, synthetic construct
  REGION 1..6: note = Synthetic Construct
GKLRYK

SEQ ID NO: 13781 - protein, 6 aa, synthetic construct
  REGION 1..6: note = Synthetic Construct
GKLSAK

SEQ ID NO: 13782 - protein, 6 aa, synthetic construct
  REGION 1..6: note = Synthetic Construct
GKLSDK

SEQ ID NO: 13783 - protein, 6 aa, synthetic construct
  REGION 1..6: note = Synthetic Construct
GKLSEK

SEQ ID NO: 13784 - protein, 6 aa, synthetic construct
  REGION 1..6: note = Synthetic Construct
GKLSFK

SEQ ID NO: 13785 - protein, 6 aa, synthetic construct
  REGION 1..6: note = Synthetic Construct
GKLSGK

SEQ ID NO: 13786 - protein, 6 aa, synthetic construct
  REGION 1..6: note = Synthetic Construct
GKLSHK

SEQ ID NO: 13787 - protein, 6 aa, synthetic construct
  REGION 1..6: note = Synthetic Construct
GKLSIK

SEQ ID NO: 13788 - protein, 6 aa, synthetic construct
  REGION 1..6: note = Synthetic Construct
GKLSLK

SEQ ID NO: 13789 - protein, 6 aa, synthetic construct
  REGION 1..6: note = Synthetic Construct
GKLSNK

SEQ ID NO: 13790 - protein, 6 aa, synthetic construct
  REGION 1..6: note = Synthetic Construct
GKLSQK

SEQ ID NO: 13791 - protein, 6 aa, synthetic construct
  REGION 1..6: note = Synthetic Construct
GKLSRK

SEQ ID NO: 13792 - protein, 6 aa, synthetic construct
  REGION 1..6: note = Synthetic Construct
GKLSSK

SEQ ID NO: 13793 - protein, 6 aa, synthetic construct
  REGION 1..6: note = Synthetic Construct
GKLSTK

SEQ ID NO: 13794 - protein, 6 aa, synthetic construct
  REGION 1..6: note = Synthetic Construct
GKLSYK

SEQ ID NO: 13795 - protein, 6 aa, synthetic construct
  REGION 1..6: note = Synthetic Construct
GKLTAK

SEQ ID NO: 13796 - protein, 6 aa, synthetic construct
  REGION 1..6: note = Synthetic Construct
GKLTDK

SEQ ID NO: 13797 - protein, 6 aa, synthetic construct
  REGION 1..6: note = Synthetic Construct
GKLTEK

SEQ ID NO: 13798 - protein, 6 aa, synthetic construct
  REGION 1..6: note = Synthetic Construct
GKLTFK

SEQ ID NO: 13799 - protein, 6 aa, synthetic construct
  REGION 1..6: note = Synthetic Construct
GKLTGK

SEQ ID NO: 13800 - protein, 6 aa, synthetic construct
  REGION 1..6: note = Synthetic Construct
GKLTHK

SEQ ID NO: 13801 - protein, 6 aa, synthetic construct
  REGION 1..6: note = Synthetic Construct
GKLTIK

SEQ ID NO: 13802 - protein, 6 aa, synthetic construct
  REGION 1..6: note = Synthetic Construct
GKLTLK

SEQ ID NO: 13803 - protein, 6 aa, synthetic construct
  REGION 1..6: note = Synthetic Construct
GKLTNK

SEQ ID NO: 13804 - protein, 6 aa, synthetic construct
  REGION 1..6: note = Synthetic Construct
GKLTQK

SEQ ID NO: 13805 - protein, 6 aa, synthetic construct
  REGION 1..6: note = Synthetic Construct
GKLTRK

SEQ ID NO: 13806 - protein, 6 aa, synthetic construct
  REGION 1..6: note = Synthetic Construct
GKLTSK

SEQ ID NO: 13807 - protein, 6 aa, synthetic construct
  REGION 1..6: note = Synthetic Construct
GKLTTK

SEQ ID NO: 13808 - protein, 6 aa, synthetic construct
  REGION 1..6: note = Synthetic Construct
GKLTYK

SEQ ID NO: 13809 - protein, 6 aa, synthetic construct
  REGION 1..6: note = Synthetic Construct
GKLYAK

SEQ ID NO: 13810 - protein, 6 aa, synthetic construct
  REGION 1..6: note = Synthetic Construct
GKLYDK

SEQ ID NO: 13811 - protein, 6 aa, synthetic construct
  REGION 1..6: note = Synthetic Construct
GKLYEK

SEQ ID NO: 13812 - protein, 6 aa, synthetic construct
  REGION 1..6: note = Synthetic Construct
GKLYFK

SEQ ID NO: 13813 - protein, 6 aa, synthetic construct
  REGION 1..6: note = Synthetic Construct
GKLYGK

SEQ ID NO: 13814 - protein, 6 aa, synthetic construct
  REGION 1..6: note = Synthetic Construct
GKLYHK

SEQ ID NO: 13815 - protein, 6 aa, synthetic construct
  REGION 1..6: note = Synthetic Construct
GKLYIK

SEQ ID NO: 13816 - protein, 6 aa, synthetic construct
  REGION 1..6: note = Synthetic Construct
GKLYLK

SEQ ID NO: 13817 - protein, 6 aa, synthetic construct
  REGION 1..6: note = Synthetic Construct
GKLYNK

SEQ ID NO: 13818 - protein, 6 aa, synthetic construct
  REGION 1..6: note = Synthetic Construct
GKLYQK

SEQ ID NO: 13819 - protein, 6 aa, synthetic construct
  REGION 1..6: note = Synthetic Construct
GKLYRK

SEQ ID NO: 13820 - protein, 6 aa, synthetic construct
  REGION 1..6: note = Synthetic Construct
GKLYSK

SEQ ID NO: 13821 - protein, 6 aa, synthetic construct
  REGION 1..6: note = Synthetic Construct
GKLYTK

SEQ ID NO: 13822 - protein, 6 aa, synthetic construct
  REGION 1..6: note = Synthetic Construct
GKLYYK

SEQ ID NO: 13823 - protein, 6 aa, synthetic construct
  REGION 1..6: note = Synthetic Construct
GKNAAK

SEQ ID NO: 13824 - protein, 6 aa, synthetic construct
  REGION 1..6: note = Synthetic Construct
GKNADK

SEQ ID NO: 13825 - protein, 6 aa, synthetic construct
  REGION 1..6: note = Synthetic Construct
GKNAEK

SEQ ID NO: 13826 - protein, 6 aa, synthetic construct
  REGION 1..6: note = Synthetic Construct
GKNAFK

SEQ ID NO: 13827 - protein, 6 aa, synthetic construct
  REGION 1..6: note = Synthetic Construct
GKNAGK

SEQ ID NO: 13828 - protein, 6 aa, synthetic construct
  REGION 1..6: note = Synthetic Construct
GKNAHK

SEQ ID NO: 13829 - protein, 6 aa, synthetic construct
  REGION 1..6: note = Synthetic Construct
GKNAIK

SEQ ID NO: 13830 - protein, 6 aa, synthetic construct
  REGION 1..6: note = Synthetic Construct
GKNALK

SEQ ID NO: 13831 - protein, 6 aa, synthetic construct
  REGION 1..6: note = Synthetic Construct
GKNANK

SEQ ID NO: 13832 - protein, 6 aa, synthetic construct
  REGION 1..6: note = Synthetic Construct
GKNAQK

SEQ ID NO: 13833 - protein, 6 aa, synthetic construct
  REGION 1..6: note = Synthetic Construct
GKNARK

SEQ ID NO: 13834 - protein, 6 aa, synthetic construct
  REGION 1..6: note = Synthetic Construct
GKNASK

SEQ ID NO: 13835 - protein, 6 aa, synthetic construct
  REGION 1..6: note = Synthetic Construct
GKNATK

SEQ ID NO: 13836 - protein, 6 aa, synthetic construct
  REGION 1..6: note = Synthetic Construct
GKNAYK

SEQ ID NO: 13837 - protein, 6 aa, synthetic construct
  REGION 1..6: note = Synthetic Construct
GKNDAK

SEQ ID NO: 13838 - protein, 6 aa, synthetic construct
  REGION 1..6: note = Synthetic Construct
GKNDDK

SEQ ID NO: 13839 - protein, 6 aa, synthetic construct
  REGION 1..6: note = Synthetic Construct
GKNDEK

SEQ ID NO: 13840 - protein, 6 aa, synthetic construct
  REGION 1..6: note = Synthetic Construct
GKNDFK

SEQ ID NO: 13841 - protein, 6 aa, synthetic construct
  REGION 1..6: note = Synthetic Construct
GKNDGK

SEQ ID NO: 13842 - protein, 6 aa, synthetic construct
  REGION 1..6: note = Synthetic Construct
GKNDHK

SEQ ID NO: 13843 - protein, 6 aa, synthetic construct
  REGION 1..6: note = Synthetic Construct
GKNDIK

SEQ ID NO: 13844 - protein, 6 aa, synthetic construct
  REGION 1..6: note = Synthetic Construct
GKNDLK

SEQ ID NO: 13845 - protein, 6 aa, synthetic construct
  REGION 1..6: note = Synthetic Construct
GKNDNK

SEQ ID NO: 13846 - protein, 6 aa, synthetic construct
  REGION 1..6: note = Synthetic Construct
GKNDQK

SEQ ID NO: 13847 - protein, 6 aa, synthetic construct
  REGION 1..6: note = Synthetic Construct
GKNDRK

SEQ ID NO: 13848 - protein, 6 aa, synthetic construct
  REGION 1..6: note = Synthetic Construct
GKNDSK

SEQ ID NO: 13849 - protein, 6 aa, synthetic construct
  REGION 1..6: note = Synthetic Construct
GKNDTK

SEQ ID NO: 13850 - protein, 6 aa, synthetic construct
  REGION 1..6: note = Synthetic Construct
GKNDYK

SEQ ID NO: 13851 - protein, 6 aa, synthetic construct
  REGION 1..6: note = Synthetic Construct
GKNEAK

SEQ ID NO: 13852 - protein, 6 aa, synthetic construct
  REGION 1..6: note = Synthetic Construct
GKNEDK

SEQ ID NO: 13853 - protein, 6 aa, synthetic construct
  REGION 1..6: note = Synthetic Construct
GKNEEK

SEQ ID NO: 13854 - protein, 6 aa, synthetic construct
  REGION 1..6: note = Synthetic Construct
GKNEFK

SEQ ID NO: 13855 - protein, 6 aa, synthetic construct
  REGION 1..6: note = Synthetic Construct
GKNEGK

SEQ ID NO: 13856 - protein, 6 aa, synthetic construct
  REGION 1..6: note = Synthetic Construct
GKNEHK

SEQ ID NO: 13857 - protein, 6 aa, synthetic construct
  REGION 1..6: note = Synthetic Construct
GKNEIK

SEQ ID NO: 13858 - protein, 6 aa, synthetic construct
  REGION 1..6: note = Synthetic Construct
GKNELK

SEQ ID NO: 13859 - protein, 6 aa, synthetic construct
  REGION 1..6: note = Synthetic Construct
GKNENK

SEQ ID NO: 13860 - protein, 6 aa, synthetic construct
  REGION 1..6: note = Synthetic Construct
GKNEQK

SEQ ID NO: 13861 - protein, 6 aa, synthetic construct
  REGION 1..6: note = Synthetic Construct
GKNERK

SEQ ID NO: 13862 - protein, 6 aa, synthetic construct
  REGION 1..6: note = Synthetic Construct
GKNESK

SEQ ID NO: 13863 - protein, 6 aa, synthetic construct
  REGION 1..6: note = Synthetic Construct
GKNETK

SEQ ID NO: 13864 - protein, 6 aa, synthetic construct
  REGION 1..6: note = Synthetic Construct
GKNEYK

SEQ ID NO: 13865 - protein, 6 aa, synthetic construct
  REGION 1..6: note = Synthetic Construct
GKNFAK

SEQ ID NO: 13866 - protein, 6 aa, synthetic construct
  REGION 1..6: note = Synthetic Construct
GKNFDK

SEQ ID NO: 13867 - protein, 6 aa, synthetic construct
  REGION 1..6: note = Synthetic Construct
GKNFEK

SEQ ID NO: 13868 - protein, 6 aa, synthetic construct
  REGION 1..6: note = Synthetic Construct
GKNFFK

SEQ ID NO: 13869 - protein, 6 aa, synthetic construct
  REGION 1..6: note = Synthetic Construct
GKNFGK

SEQ ID NO: 13870 - protein, 6 aa, synthetic construct
  REGION 1..6: note = Synthetic Construct
GKNFHK

SEQ ID NO: 13871 - protein, 6 aa, synthetic construct
  REGION 1..6: note = Synthetic Construct
GKNFIK

SEQ ID NO: 13872 - protein, 6 aa, synthetic construct
  REGION 1..6: note = Synthetic Construct
GKNFLK

SEQ ID NO: 13873 - protein, 6 aa, synthetic construct
  REGION 1..6: note = Synthetic Construct
GKNFNK

SEQ ID NO: 13874 - protein, 6 aa, synthetic construct
  REGION 1..6: note = Synthetic Construct
GKNFQK

SEQ ID NO: 13875 - protein, 6 aa, synthetic construct
  REGION 1..6: note = Synthetic Construct
GKNFRK

SEQ ID NO: 13876 - protein, 6 aa, synthetic construct
  REGION 1..6: note = Synthetic Construct
GKNFSK

SEQ ID NO: 13877 - protein, 6 aa, synthetic construct
  REGION 1..6: note = Synthetic Construct
GKNFTK

SEQ ID NO: 13878 - protein, 6 aa, synthetic construct
  REGION 1..6: note = Synthetic Construct
GKNFYK

SEQ ID NO: 13879 - protein, 6 aa, synthetic construct
  REGION 1..6: note = Synthetic Construct
GKNGAK

SEQ ID NO: 13880 - protein, 6 aa, synthetic construct
  REGION 1..6: note = Synthetic Construct
GKNGDK

SEQ ID NO: 13881 - protein, 6 aa, synthetic construct
  REGION 1..6: note = Synthetic Construct
GKNGEK

SEQ ID NO: 13882 - protein, 6 aa, synthetic construct
  REGION 1..6: note = Synthetic Construct
GKNGFK

SEQ ID NO: 13883 - protein, 6 aa, synthetic construct
  REGION 1..6: note = Synthetic Construct
GKNGGK

SEQ ID NO: 13884 - protein, 6 aa, synthetic construct
  REGION 1..6: note = Synthetic Construct
GKNGHK

SEQ ID NO: 13885 - protein, 6 aa, synthetic construct
  REGION 1..6: note = Synthetic Construct
GKNGIK

SEQ ID NO: 13886 - protein, 6 aa, synthetic construct
  REGION 1..6: note = Synthetic Construct
GKNGLK

SEQ ID NO: 13887 - protein, 6 aa, synthetic construct
  REGION 1..6: note = Synthetic Construct
GKNGNK

SEQ ID NO: 13888 - protein, 6 aa, synthetic construct
  REGION 1..6: note = Synthetic Construct
GKNGQK

SEQ ID NO: 13889 - protein, 6 aa, synthetic construct
  REGION 1..6: note = Synthetic Construct
GKNGRK

SEQ ID NO: 13890 - protein, 6 aa, synthetic construct
  REGION 1..6: note = Synthetic Construct
GKNGSK

SEQ ID NO: 13891 - protein, 6 aa, synthetic construct
  REGION 1..6: note = Synthetic Construct
GKNGTK

SEQ ID NO: 13892 - protein, 6 aa, synthetic construct
  REGION 1..6: note = Synthetic Construct
GKNGYK

SEQ ID NO: 13893 - protein, 6 aa, synthetic construct
  REGION 1..6: note = Synthetic Construct
GKNHAK

SEQ ID NO: 13894 - protein, 6 aa, synthetic construct
  REGION 1..6: note = Synthetic Construct
GKNHDK

SEQ ID NO: 13895 - protein, 6 aa, synthetic construct
  REGION 1..6: note = Synthetic Construct
GKNHEK

SEQ ID NO: 13896 - protein, 6 aa, synthetic construct
  REGION 1..6: note = Synthetic Construct
GKNHFK

SEQ ID NO: 13897 - protein, 6 aa, synthetic construct
  REGION 1..6: note = Synthetic Construct
GKNHGK

SEQ ID NO: 13898 - protein, 6 aa, synthetic construct
  REGION 1..6: note = Synthetic Construct
GKNHHK

SEQ ID NO: 13899 - protein, 6 aa, synthetic construct
  REGION 1..6: note = Synthetic Construct
GKNHIK

SEQ ID NO: 13900 - protein, 6 aa, synthetic construct
  REGION 1..6: note = Synthetic Construct
GKNHLK

SEQ ID NO: 13901 - protein, 6 aa, synthetic construct
  REGION 1..6: note = Synthetic Construct
GKNHNK

SEQ ID NO: 13902 - protein, 6 aa, synthetic construct
  REGION 1..6: note = Synthetic Construct
GKNHQK

SEQ ID NO: 13903 - protein, 6 aa, synthetic construct
  REGION 1..6: note = Synthetic Construct
GKNHRK

SEQ ID NO: 13904 - protein, 6 aa, synthetic construct
  REGION 1..6: note = Synthetic Construct
GKNHSK

SEQ ID NO: 13905 - protein, 6 aa, synthetic construct
  REGION 1..6: note = Synthetic Construct
GKNHTK

SEQ ID NO: 13906 - protein, 6 aa, synthetic construct
  REGION 1..6: note = Synthetic Construct
GKNHYK

SEQ ID NO: 13907 - protein, 6 aa, synthetic construct
  REGION 1..6: note = Synthetic Construct
GKNIAK

SEQ ID NO: 13908 - protein, 6 aa, synthetic construct
  REGION 1..6: note = Synthetic Construct
GKNIDK

SEQ ID NO: 13909 - protein, 6 aa, synthetic construct
  REGION 1..6: note = Synthetic Construct
GKNIEK

SEQ ID NO: 13910 - protein, 6 aa, synthetic construct
  REGION 1..6: note = Synthetic Construct
GKNIFK

SEQ ID NO: 13911 - protein, 6 aa, synthetic construct
  REGION 1..6: note = Synthetic Construct
GKNIGK

SEQ ID NO: 13912 - protein, 6 aa, synthetic construct
  REGION 1..6: note = Synthetic Construct
GKNIHK

SEQ ID NO: 13913 - protein, 6 aa, synthetic construct
  REGION 1..6: note = Synthetic Construct
GKNIIK

SEQ ID NO: 13914 - protein, 6 aa, synthetic construct
  REGION 1..6: note = Synthetic Construct
GKNILK

SEQ ID NO: 13915 - protein, 6 aa, synthetic construct
  REGION 1..6: note = Synthetic Construct
GKNINK

SEQ ID NO: 13916 - protein, 6 aa, synthetic construct
  REGION 1..6: note = Synthetic Construct
GKNIQK

SEQ ID NO: 13917 - protein, 6 aa, synthetic construct
  REGION 1..6: note = Synthetic Construct
GKNIRK

SEQ ID NO: 13918 - protein, 6 aa, synthetic construct
  REGION 1..6: note = Synthetic Construct
GKNISK

SEQ ID NO: 13919 - protein, 6 aa, synthetic construct
  REGION 1..6: note = Synthetic Construct
GKNITK

SEQ ID NO: 13920 - protein, 6 aa, synthetic construct
  REGION 1..6: note = Synthetic Construct
GKNIYK

SEQ ID NO: 13921 - protein, 6 aa, synthetic construct
  REGION 1..6: note = Synthetic Construct
GKNLAK

SEQ ID NO: 13922 - protein, 6 aa, synthetic construct
  REGION 1..6: note = Synthetic Construct
GKNLDK

SEQ ID NO: 13923 - protein, 6 aa, synthetic construct
  REGION 1..6: note = Synthetic Construct
GKNLEK

SEQ ID NO: 13924 - protein, 6 aa, synthetic construct
  REGION 1..6: note = Synthetic Construct
GKNLFK

SEQ ID NO: 13925 - protein, 6 aa, synthetic construct
  REGION 1..6: note = Synthetic Construct
GKNLGK

SEQ ID NO: 13926 - protein, 6 aa, synthetic construct
  REGION 1..6: note = Synthetic Construct
GKNLHK

SEQ ID NO: 13927 - protein, 6 aa, synthetic construct
  REGION 1..6: note = Synthetic Construct
GKNLIK

SEQ ID NO: 13928 - protein, 6 aa, synthetic construct
  REGION 1..6: note = Synthetic Construct
GKNLLK

SEQ ID NO: 13929 - protein, 6 aa, synthetic construct
  REGION 1..6: note = Synthetic Construct
GKNLNK

SEQ ID NO: 13930 - protein, 6 aa, synthetic construct
  REGION 1..6: note = Synthetic Construct
GKNLQK

SEQ ID NO: 13931 - protein, 6 aa, synthetic construct
  REGION 1..6: note = Synthetic Construct
GKNLRK

SEQ ID NO: 13932 - protein, 6 aa, synthetic construct
  REGION 1..6: note = Synthetic Construct
GKNLSK

SEQ ID NO: 13933 - protein, 6 aa, synthetic construct
  REGION 1..6: note = Synthetic Construct
GKNLTK

SEQ ID NO: 13934 - protein, 6 aa, synthetic construct
  REGION 1..6: note = Synthetic Construct
GKNLYK

SEQ ID NO: 13935 - protein, 6 aa, synthetic construct
  REGION 1..6: note = Synthetic Construct
GKNNAK

SEQ ID NO: 13936 - protein, 6 aa, synthetic construct
  REGION 1..6: note = Synthetic Construct
GKNNDK

SEQ ID NO: 13937 - protein, 6 aa, synthetic construct
  REGION 1..6: note = Synthetic Construct
GKNNEK

SEQ ID NO: 13938 - protein, 6 aa, synthetic construct
  REGION 1..6: note = Synthetic Construct
GKNNFK

SEQ ID NO: 13939 - protein, 6 aa, synthetic construct
  REGION 1..6: note = Synthetic Construct
GKNNGK

SEQ ID NO: 13940 - protein, 6 aa, synthetic construct
  REGION 1..6: note = Synthetic Construct
GKNNHK

SEQ ID NO: 13941 - protein, 6 aa, synthetic construct
  REGION 1..6: note = Synthetic Construct
GKNNIK

SEQ ID NO: 13942 - protein, 6 aa, synthetic construct
  REGION 1..6: note = Synthetic Construct
GKNNLK

SEQ ID NO: 13943 - protein, 6 aa, synthetic construct
  REGION 1..6: note = Synthetic Construct
GKNNNK

SEQ ID NO: 13944 - protein, 6 aa, synthetic construct
  REGION 1..6: note = Synthetic Construct
GKNNQK

SEQ ID NO: 13945 - protein, 6 aa, synthetic construct
  REGION 1..6: note = Synthetic Construct
GKNNRK

SEQ ID NO: 13946 - protein, 6 aa, synthetic construct
  REGION 1..6: note = Synthetic Construct
GKNNSK

SEQ ID NO: 13947 - protein, 6 aa, synthetic construct
  REGION 1..6: note = Synthetic Construct
GKNNTK

SEQ ID NO: 13948 - protein, 6 aa, synthetic construct
  REGION 1..6: note = Synthetic Construct
GKNNYK

SEQ ID NO: 13949 - protein, 6 aa, synthetic construct
  REGION 1..6: note = Synthetic Construct
GKNQAK

SEQ ID NO: 13950 - protein, 6 aa, synthetic construct
  REGION 1..6: note = Synthetic Construct
GKNQDK

SEQ ID NO: 13951 - protein, 6 aa, synthetic construct
  REGION 1..6: note = Synthetic Construct
GKNQEK

SEQ ID NO: 13952 - protein, 6 aa, synthetic construct
  REGION 1..6: note = Synthetic Construct
GKNQFK

SEQ ID NO: 13953 - protein, 6 aa, synthetic construct
  REGION 1..6: note = Synthetic Construct
GKNQGK

SEQ ID NO: 13954 - protein, 6 aa, synthetic construct
  REGION 1..6: note = Synthetic Construct
GKNQHK

SEQ ID NO: 13955 - protein, 6 aa, synthetic construct
  REGION 1..6: note = Synthetic Construct
GKNQIK

SEQ ID NO: 13956 - protein, 6 aa, synthetic construct
  REGION 1..6: note = Synthetic Construct
GKNQLK

SEQ ID NO: 13957 - protein, 6 aa, synthetic construct
  REGION 1..6: note = Synthetic Construct
GKNQNK

SEQ ID NO: 13958 - protein, 6 aa, synthetic construct
  REGION 1..6: note = Synthetic Construct
GKNQQK

SEQ ID NO: 13959 - protein, 6 aa, synthetic construct
  REGION 1..6: note = Synthetic Construct
GKNQRK

SEQ ID NO: 13960 - protein, 6 aa, synthetic construct
  REGION 1..6: note = Synthetic Construct
GKNQSK

SEQ ID NO: 13961 - protein, 6 aa, synthetic construct
  REGION 1..6: note = Synthetic Construct
GKNQTK

SEQ ID NO: 13962 - protein, 6 aa, synthetic construct
  REGION 1..6: note = Synthetic Construct
GKNQYK

SEQ ID NO: 13963 - protein, 6 aa, synthetic construct
  REGION 1..6: note = Synthetic Construct
GKNRAK

SEQ ID NO: 13964 - protein, 6 aa, synthetic construct
  REGION 1..6: note = Synthetic Construct
GKNRDK

SEQ ID NO: 13965 - protein, 6 aa, synthetic construct
  REGION 1..6: note = Synthetic Construct
GKNREK

SEQ ID NO: 13966 - protein, 6 aa, synthetic construct
  REGION 1..6: note = Synthetic Construct
GKNRFK

SEQ ID NO: 13967 - protein, 6 aa, synthetic construct
  REGION 1..6: note = Synthetic Construct
GKNRGK

SEQ ID NO: 13968 - protein, 6 aa, synthetic construct
  REGION 1..6: note = Synthetic Construct
GKNRHK

SEQ ID NO: 13969 - protein, 6 aa, synthetic construct
  REGION 1..6: note = Synthetic Construct
GKNRIK

SEQ ID NO: 13970 - protein, 6 aa, synthetic construct
  REGION 1..6: note = Synthetic Construct
GKNRLK

SEQ ID NO: 13971 - protein, 6 aa, synthetic construct
  REGION 1..6: note = Synthetic Construct
GKNRNK

SEQ ID NO: 13972 - protein, 6 aa, synthetic construct
  REGION 1..6: note = Synthetic Construct
GKNRQK

SEQ ID NO: 13973 - protein, 6 aa, synthetic construct
  REGION 1..6: note = Synthetic Construct
GKNRRK

SEQ ID NO: 13974 - protein, 6 aa, synthetic construct
  REGION 1..6: note = Synthetic Construct
GKNRSK

SEQ ID NO: 13975 - protein, 6 aa, synthetic construct
  REGION 1..6: note = Synthetic Construct
GKNRTK

SEQ ID NO: 13976 - protein, 6 aa, synthetic construct
  REGION 1..6: note = Synthetic Construct
GKNRYK

SEQ ID NO: 13977 - protein, 6 aa, synthetic construct
  REGION 1..6: note = Synthetic Construct
GKNSAK

SEQ ID NO: 13978 - protein, 6 aa, synthetic construct
  REGION 1..6: note = Synthetic Construct
GKNSDK

SEQ ID NO: 13979 - protein, 6 aa, synthetic construct
  REGION 1..6: note = Synthetic Construct
GKNSEK

SEQ ID NO: 13980 - protein, 6 aa, synthetic construct
  REGION 1..6: note = Synthetic Construct
GKNSFK

SEQ ID NO: 13981 - protein, 6 aa, synthetic construct
  REGION 1..6: note = Synthetic Construct
GKNSGK

SEQ ID NO: 13982 - protein, 6 aa, synthetic construct
  REGION 1..6: note = Synthetic Construct
GKNSHK

SEQ ID NO: 13983 - protein, 6 aa, synthetic construct
  REGION 1..6: note = Synthetic Construct
GKNSIK

SEQ ID NO: 13984 - protein, 6 aa, synthetic construct
  REGION 1..6: note = Synthetic Construct
GKNSLK

SEQ ID NO: 13985 - protein, 6 aa, synthetic construct
  REGION 1..6: note = Synthetic Construct
GKNSNK

SEQ ID NO: 13986 - protein, 6 aa, synthetic construct
  REGION 1..6: note = Synthetic Construct
GKNSQK

SEQ ID NO: 13987 - protein, 6 aa, synthetic construct
  REGION 1..6: note = Synthetic Construct
GKNSRK

SEQ ID NO: 13988 - protein, 6 aa, synthetic construct
  REGION 1..6: note = Synthetic Construct
GKNSSK

SEQ ID NO: 13989 - protein, 6 aa, synthetic construct
  REGION 1..6: note = Synthetic Construct
GKNSTK

SEQ ID NO: 13990 - protein, 6 aa, synthetic construct
  REGION 1..6: note = Synthetic Construct
GKNSYK

SEQ ID NO: 13991 - protein, 6 aa, synthetic construct
  REGION 1..6: note = Synthetic Construct
GKNTAK

SEQ ID NO: 13992 - protein, 6 aa, synthetic construct
  REGION 1..6: note = Synthetic Construct
GKNTDK

SEQ ID NO: 13993 - protein, 6 aa, synthetic construct
  REGION 1..6: note = Synthetic Construct
GKNTEK

SEQ ID NO: 13994 - protein, 6 aa, synthetic construct
  REGION 1..6: note = Synthetic Construct
GKNTFK

SEQ ID NO: 13995 - protein, 6 aa, synthetic construct
  REGION 1..6: note = Synthetic Construct
GKNTGK

SEQ ID NO: 13996 - protein, 6 aa, synthetic construct
  REGION 1..6: note = Synthetic Construct
GKNTHK

SEQ ID NO: 13997 - protein, 6 aa, synthetic construct
  REGION 1..6: note = Synthetic Construct
GKNTIK

SEQ ID NO: 13998 - protein, 6 aa, synthetic construct
  REGION 1..6: note = Synthetic Construct
GKNTLK

SEQ ID NO: 13999 - protein, 6 aa, synthetic construct
  REGION 1..6: note = Synthetic Construct
GKNTNK

SEQ ID NO: 14000 - protein, 6 aa, synthetic construct
  REGION 1..6: note = Synthetic Construct
GKNTQK

SEQ ID NO: 14001 - protein, 6 aa, synthetic construct
  REGION 1..6: note = Synthetic Construct
GKNTRK

SEQ ID NO: 14002 - protein, 6 aa, synthetic construct
  REGION 1..6: note = Synthetic Construct
GKNTSK

SEQ ID NO: 14003 - protein, 6 aa, synthetic construct
  REGION 1..6: note = Synthetic Construct
GKNTTK

SEQ ID NO: 14004 - protein, 6 aa, synthetic construct
  REGION 1..6: note = Synthetic Construct
GKNTYK

SEQ ID NO: 14005 - protein, 6 aa, synthetic construct
  REGION 1..6: note = Synthetic Construct
GKNYAK

SEQ ID NO: 14006 - protein, 6 aa, synthetic construct
  REGION 1..6: note = Synthetic Construct
GKNYDK

SEQ ID NO: 14007 - protein, 6 aa, synthetic construct
  REGION 1..6: note = Synthetic Construct
GKNYEK

SEQ ID NO: 14008 - protein, 6 aa, synthetic construct
  REGION 1..6: note = Synthetic Construct
GKNYFK

SEQ ID NO: 14009 - protein, 6 aa, synthetic construct
  REGION 1..6: note = Synthetic Construct
GKNYGK

SEQ ID NO: 14010 - protein, 6 aa, synthetic construct
  REGION 1..6: note = Synthetic Construct
GKNYHK

SEQ ID NO: 14011 - protein, 6 aa, synthetic construct
  REGION 1..6: note = Synthetic Construct
GKNYIK

SEQ ID NO: 14012 - protein, 6 aa, synthetic construct
  REGION 1..6: note = Synthetic Construct
GKNYLK

SEQ ID NO: 14013 - protein, 6 aa, synthetic construct
  REGION 1..6: note = Synthetic Construct
GKNYNK

SEQ ID NO: 14014 - protein, 6 aa, synthetic construct
  REGION 1..6: note = Synthetic Construct
GKNYQK

SEQ ID NO: 14015 - protein, 6 aa, synthetic construct
  REGION 1..6: note = Synthetic Construct
GKNYRK

SEQ ID NO: 14016 - protein, 6 aa, synthetic construct
  REGION 1..6: note = Synthetic Construct
GKNYSK

SEQ ID NO: 14017 - protein, 6 aa, synthetic construct
  REGION 1..6: note = Synthetic Construct
GKNYTK

SEQ ID NO: 14018 - protein, 6 aa, synthetic construct
  REGION 1..6: note = Synthetic Construct
GKNYYK

SEQ ID NO: 14019 - protein, 6 aa, synthetic construct
  REGION 1..6: note = Synthetic Construct
GKPAAK

SEQ ID NO: 14020 - protein, 6 aa, synthetic construct
  REGION 1..6: note = Synthetic Construct
GKPADK

SEQ ID NO: 14021 - protein, 6 aa, synthetic construct
  REGION 1..6: note = Synthetic Construct
GKPAEK

SEQ ID NO: 14022 - protein, 6 aa, synthetic construct
  REGION 1..6: note = Synthetic Construct
GKPAFK

SEQ ID NO: 14023 - protein, 6 aa, synthetic construct
  REGION 1..6: note = Synthetic Construct
GKPAGK

SEQ ID NO: 14024 - protein, 6 aa, synthetic construct
  REGION 1..6: note = Synthetic Construct
GKPAHK

SEQ ID NO: 14025 - protein, 6 aa, synthetic construct
  REGION 1..6: note = Synthetic Construct
GKPAIK

SEQ ID NO: 14026 - protein, 6 aa, synthetic construct
  REGION 1..6: note = Synthetic Construct
GKPALK

SEQ ID NO: 14027 - protein, 6 aa, synthetic construct
  REGION 1..6: note = Synthetic Construct
GKPANK

SEQ ID NO: 14028 - protein, 6 aa, synthetic construct
  REGION 1..6: note = Synthetic Construct
GKPAQK

SEQ ID NO: 14029 - protein, 6 aa, synthetic construct
  REGION 1..6: note = Synthetic Construct
GKPARK

SEQ ID NO: 14030 - protein, 6 aa, synthetic construct
  REGION 1..6: note = Synthetic Construct
GKPASK

SEQ ID NO: 14031 - protein, 6 aa, synthetic construct
  REGION 1..6: note = Synthetic Construct
GKPATK

SEQ ID NO: 14032 - protein, 6 aa, synthetic construct
  REGION 1..6: note = Synthetic Construct
GKPAYK

SEQ ID NO: 14033 - protein, 6 aa, synthetic construct
  REGION 1..6: note = Synthetic Construct
GKPDAK

SEQ ID NO: 14034 - protein, 6 aa, synthetic construct
  REGION 1..6: note = Synthetic Construct
GKPDDK

SEQ ID NO: 14035 - protein, 6 aa, synthetic construct
  REGION 1..6: note = Synthetic Construct
GKPDEK

SEQ ID NO: 14036 - protein, 6 aa, synthetic construct
  REGION 1..6: note = Synthetic Construct
GKPDFK

SEQ ID NO: 14037 - protein, 6 aa, synthetic construct
  REGION 1..6: note = Synthetic Construct
GKPDGK

SEQ ID NO: 14038 - protein, 6 aa, synthetic construct
  REGION 1..6: note = Synthetic Construct
GKPDHK

SEQ ID NO: 14039 - protein, 6 aa, synthetic construct
  REGION 1..6: note = Synthetic Construct
GKPDIK

SEQ ID NO: 14040 - protein, 6 aa, synthetic construct
  REGION 1..6: note = Synthetic Construct
GKPDLK

SEQ ID NO: 14041 - protein, 6 aa, synthetic construct
  REGION 1..6: note = Synthetic Construct
GKPDNK

SEQ ID NO: 14042 - protein, 6 aa, synthetic construct
  REGION 1..6: note = Synthetic Construct
GKPDQK

SEQ ID NO: 14043 - protein, 6 aa, synthetic construct
  REGION 1..6: note = Synthetic Construct
GKPDRK

SEQ ID NO: 14044 - protein, 6 aa, synthetic construct
  REGION 1..6: note = Synthetic Construct
GKPDSK

SEQ ID NO: 14045 - protein, 6 aa, synthetic construct
  REGION 1..6: note = Synthetic Construct
GKPDTK

SEQ ID NO: 14046 - protein, 6 aa, synthetic construct
  REGION 1..6: note = Synthetic Construct
GKPDYK

SEQ ID NO: 14047 - protein, 6 aa, synthetic construct
  REGION 1..6: note = Synthetic Construct
GKPEAK

SEQ ID NO: 14048 - protein, 6 aa, synthetic construct
  REGION 1..6: note = Synthetic Construct
GKPEDK

SEQ ID NO: 14049 - protein, 6 aa, synthetic construct
  REGION 1..6: note = Synthetic Construct
GKPEEK

SEQ ID NO: 14050 - protein, 6 aa, synthetic construct
  REGION 1..6: note = Synthetic Construct
GKPEFK

SEQ ID NO: 14051 - protein, 6 aa, synthetic construct
  REGION 1..6: note = Synthetic Construct
GKPEGK

SEQ ID NO: 14052 - protein, 6 aa, synthetic construct
  REGION 1..6: note = Synthetic Construct
GKPEHK

SEQ ID NO: 14053 - protein, 6 aa, synthetic construct
  REGION 1..6: note = Synthetic Construct
GKPEIK

SEQ ID NO: 14054 - protein, 6 aa, synthetic construct
  REGION 1..6: note = Synthetic Construct
GKPELK

SEQ ID NO: 14055 - protein, 6 aa, synthetic construct
  REGION 1..6: note = Synthetic Construct
GKPENK

SEQ ID NO: 14056 - protein, 6 aa, synthetic construct
  REGION 1..6: note = Synthetic Construct
GKPEQK

SEQ ID NO: 14057 - protein, 6 aa, synthetic construct
  REGION 1..6: note = Synthetic Construct
GKPERK

SEQ ID NO: 14058 - protein, 6 aa, synthetic construct
  REGION 1..6: note = Synthetic Construct
GKPESK

SEQ ID NO: 14059 - protein, 6 aa, synthetic construct
  REGION 1..6: note = Synthetic Construct
GKPETK

SEQ ID NO: 14060 - protein, 6 aa, synthetic construct
  REGION 1..6: note = Synthetic Construct
GKPEYK

SEQ ID NO: 14061 - protein, 6 aa, synthetic construct
  REGION 1..6: note = Synthetic Construct
GKPFAK

SEQ ID NO: 14062 - protein, 6 aa, synthetic construct
  REGION 1..6: note = Synthetic Construct
GKPFDK

SEQ ID NO: 14063 - protein, 6 aa, synthetic construct
  REGION 1..6: note = Synthetic Construct
GKPFEK

SEQ ID NO: 14064 - protein, 6 aa, synthetic construct
  REGION 1..6: note = Synthetic Construct
GKPFFK

SEQ ID NO: 14065 - protein, 6 aa, synthetic construct
  REGION 1..6: note = Synthetic Construct
GKPFGK

SEQ ID NO: 14066 - protein, 6 aa, synthetic construct
  REGION 1..6: note = Synthetic Construct
GKPFHK

SEQ ID NO: 14067 - protein, 6 aa, synthetic construct
  REGION 1..6: note = Synthetic Construct
GKPFIK

SEQ ID NO: 14068 - protein, 6 aa, synthetic construct
  REGION 1..6: note = Synthetic Construct
GKPFLK

SEQ ID NO: 14069 - protein, 6 aa, synthetic construct
  REGION 1..6: note = Synthetic Construct
GKPFNK

SEQ ID NO: 14070 - protein, 6 aa, synthetic construct
  REGION 1..6: note = Synthetic Construct
GKPFQK

SEQ ID NO: 14071 - protein, 6 aa, synthetic construct
  REGION 1..6: note = Synthetic Construct
GKPFRK

SEQ ID NO: 14072 - protein, 6 aa, synthetic construct
  REGION 1..6: note = Synthetic Construct
GKPFSK

SEQ ID NO: 14073 - protein, 6 aa, synthetic construct
  REGION 1..6: note = Synthetic Construct
GKPFTK

SEQ ID NO: 14074 - protein, 6 aa, synthetic construct
  REGION 1..6: note = Synthetic Construct
GKPFYK

SEQ ID NO: 14075 - protein, 6 aa, synthetic construct
  REGION 1..6: note = Synthetic Construct
GKPGAK

SEQ ID NO: 14076 - protein, 6 aa, synthetic construct
  REGION 1..6: note = Synthetic Construct
GKPGDK

SEQ ID NO: 14077 - protein, 6 aa, synthetic construct
  REGION 1..6: note = Synthetic Construct
GKPGEK

SEQ ID NO: 14078 - protein, 6 aa, synthetic construct
  REGION 1..6: note = Synthetic Construct
GKPGFK

SEQ ID NO: 14079 - protein, 6 aa, synthetic construct
  REGION 1..6: note = Synthetic Construct
GKPGGK

SEQ ID NO: 14080 - protein, 6 aa, synthetic construct
  REGION 1..6: note = Synthetic Construct
GKPGHK

SEQ ID NO: 14081 - protein, 6 aa, synthetic construct
  REGION 1..6: note = Synthetic Construct
GKPGIK

SEQ ID NO: 14082 - protein, 6 aa, synthetic construct
  REGION 1..6: note = Synthetic Construct
GKPGLK

SEQ ID NO: 14083 - protein, 6 aa, synthetic construct
  REGION 1..6: note = Synthetic Construct
GKPGNK

SEQ ID NO: 14084 - protein, 6 aa, synthetic construct
  REGION 1..6: note = Synthetic Construct
GKPGQK

SEQ ID NO: 14085 - protein, 6 aa, synthetic construct
  REGION 1..6: note = Synthetic Construct
GKPGRK

SEQ ID NO: 14086 - protein, 6 aa, synthetic construct
  REGION 1..6: note = Synthetic Construct
GKPGSK

SEQ ID NO: 14087 - protein, 6 aa, synthetic construct
  REGION 1..6: note = Synthetic Construct
GKPGTK

SEQ ID NO: 14088 - protein, 6 aa, synthetic construct
  REGION 1..6: note = Synthetic Construct
GKPGYK

SEQ ID NO: 14089 - protein, 6 aa, synthetic construct
  REGION 1..6: note = Synthetic Construct
GKPHAK

SEQ ID NO: 14090 - protein, 6 aa, synthetic construct
  REGION 1..6: note = Synthetic Construct
GKPHDK

SEQ ID NO: 14091 - protein, 6 aa, synthetic construct
  REGION 1..6: note = Synthetic Construct
GKPHEK

SEQ ID NO: 14092 - protein, 6 aa, synthetic construct
  REGION 1..6: note = Synthetic Construct
GKPHFK

SEQ ID NO: 14093 - protein, 6 aa, synthetic construct
  REGION 1..6: note = Synthetic Construct
GKPHGK

SEQ ID NO: 14094 - protein, 6 aa, synthetic construct
  REGION 1..6: note = Synthetic Construct
GKPHHK

SEQ ID NO: 14095 - protein, 6 aa, synthetic construct
  REGION 1..6: note = Synthetic Construct
GKPHIK

SEQ ID NO: 14096 - protein, 6 aa, synthetic construct
  REGION 1..6: note = Synthetic Construct
GKPHLK

SEQ ID NO: 14097 - protein, 6 aa, synthetic construct
  REGION 1..6: note = Synthetic Construct
GKPHNK

SEQ ID NO: 14098 - protein, 6 aa, synthetic construct
  REGION 1..6: note = Synthetic Construct
GKPHQK

SEQ ID NO: 14099 - protein, 6 aa, synthetic construct
  REGION 1..6: note = Synthetic Construct
GKPHRK

SEQ ID NO: 14100 - protein, 6 aa, synthetic construct
  REGION 1..6: note = Synthetic Construct
GKPHSK

SEQ ID NO: 14101 - protein, 6 aa, synthetic construct
  REGION 1..6: note = Synthetic Construct
GKPHTK

SEQ ID NO: 14102 - protein, 6 aa, synthetic construct
  REGION 1..6: note = Synthetic Construct
GKPHYK

SEQ ID NO: 14103 - protein, 6 aa, synthetic construct
  REGION 1..6: note = Synthetic Construct
GKPIAK

SEQ ID NO: 14104 - protein, 6 aa, synthetic construct
  REGION 1..6: note = Synthetic Construct
GKPIDK

SEQ ID NO: 14105 - protein, 6 aa, synthetic construct
  REGION 1..6: note = Synthetic Construct
GKPIEK

SEQ ID NO: 14106 - protein, 6 aa, synthetic construct
  REGION 1..6: note = Synthetic Construct
GKPIFK

SEQ ID NO: 14107 - protein, 6 aa, synthetic construct
  REGION 1..6: note = Synthetic Construct
GKPIGK

SEQ ID NO: 14108 - protein, 6 aa, synthetic construct
  REGION 1..6: note = Synthetic Construct
GKPIHK

SEQ ID NO: 14109 - protein, 6 aa, synthetic construct
  REGION 1..6: note = Synthetic Construct
GKPIIK

SEQ ID NO: 14110 - protein, 6 aa, synthetic construct
  REGION 1..6: note = Synthetic Construct
GKPILK

SEQ ID NO: 14111 - protein, 6 aa, synthetic construct
  REGION 1..6: note = Synthetic Construct
GKPINK

SEQ ID NO: 14112 - protein, 6 aa, synthetic construct
  REGION 1..6: note = Synthetic Construct
GKPIQK

SEQ ID NO: 14113 - protein, 6 aa, synthetic construct
  REGION 1..6: note = Synthetic Construct
GKPIRK

SEQ ID NO: 14114 - protein, 6 aa, synthetic construct
  REGION 1..6: note = Synthetic Construct
GKPISK

SEQ ID NO: 14115 - protein, 6 aa, synthetic construct
  REGION 1..6: note = Synthetic Construct
GKPITK

SEQ ID NO: 14116 - protein, 6 aa, synthetic construct
  REGION 1..6: note = Synthetic Construct
GKPIYK

SEQ ID NO: 14117 - protein, 6 aa, synthetic construct
  REGION 1..6: note = Synthetic Construct
GKPLAK

SEQ ID NO: 14118 - protein, 6 aa, synthetic construct
  REGION 1..6: note = Synthetic Construct
GKPLDK

SEQ ID NO: 14119 - protein, 6 aa, synthetic construct
  REGION 1..6: note = Synthetic Construct
GKPLEK

SEQ ID NO: 14120 - protein, 6 aa, synthetic construct
  REGION 1..6: note = Synthetic Construct
GKPLFK

SEQ ID NO: 14121 - protein, 6 aa, synthetic construct
  REGION 1..6: note = Synthetic Construct
GKPLGK

SEQ ID NO: 14122 - protein, 6 aa, synthetic construct
  REGION 1..6: note = Synthetic Construct
GKPLHK

SEQ ID NO: 14123 - protein, 6 aa, synthetic construct
  REGION 1..6: note = Synthetic Construct
GKPLIK

SEQ ID NO: 14124 - protein, 6 aa, synthetic construct
  REGION 1..6: note = Synthetic Construct
GKPLLK

SEQ ID NO: 14125 - protein, 6 aa, synthetic construct
  REGION 1..6: note = Synthetic Construct
GKPLNK

SEQ ID NO: 14126 - protein, 6 aa, synthetic construct
  REGION 1..6: note = Synthetic Construct
GKPLQK

SEQ ID NO: 14127 - protein, 6 aa, synthetic construct
  REGION 1..6: note = Synthetic Construct
GKPLRK

SEQ ID NO: 14128 - protein, 6 aa, synthetic construct
  REGION 1..6: note = Synthetic Construct
GKPLSK

SEQ ID NO: 14129 - protein, 6 aa, synthetic construct
  REGION 1..6: note = Synthetic Construct
GKPLTK

SEQ ID NO: 14130 - protein, 6 aa, synthetic construct
  REGION 1..6: note = Synthetic Construct
GKPLYK

SEQ ID NO: 14131 - protein, 6 aa, synthetic construct
  REGION 1..6: note = Synthetic Construct
GKPNAK

SEQ ID NO: 14132 - protein, 6 aa, synthetic construct
  REGION 1..6: note = Synthetic Construct
GKPNDK

SEQ ID NO: 14133 - protein, 6 aa, synthetic construct
  REGION 1..6: note = Synthetic Construct
GKPNEK

SEQ ID NO: 14134 - protein, 6 aa, synthetic construct
  REGION 1..6: note = Synthetic Construct
GKPNFK

SEQ ID NO: 14135 - protein, 6 aa, synthetic construct
  REGION 1..6: note = Synthetic Construct
GKPNGK

SEQ ID NO: 14136 - protein, 6 aa, synthetic construct
  REGION 1..6: note = Synthetic Construct
GKPNHK

SEQ ID NO: 14137 - protein, 6 aa, synthetic construct
  REGION 1..6: note = Synthetic Construct
GKPNIK

SEQ ID NO: 14138 - protein, 6 aa, synthetic construct
  REGION 1..6: note = Synthetic Construct
GKPNLK

SEQ ID NO: 14139 - protein, 6 aa, synthetic construct
  REGION 1..6: note = Synthetic Construct
GKPNNK

SEQ ID NO: 14140 - protein, 6 aa, synthetic construct
  REGION 1..6: note = Synthetic Construct
GKPNQK

SEQ ID NO: 14141 - protein, 6 aa, synthetic construct
  REGION 1..6: note = Synthetic Construct
GKPNRK

SEQ ID NO: 14142 - protein, 6 aa, synthetic construct
  REGION 1..6: note = Synthetic Construct
GKPNSK

SEQ ID NO: 14143 - protein, 6 aa, synthetic construct
  REGION 1..6: note = Synthetic Construct
GKPNTK

SEQ ID NO: 14144 - protein, 6 aa, synthetic construct
  REGION 1..6: note = Synthetic Construct
GKPNYK

SEQ ID NO: 14145 - protein, 6 aa, synthetic construct
  REGION 1..6: note = Synthetic Construct
GKPQAK

SEQ ID NO: 14146 - protein, 6 aa, synthetic construct
  REGION 1..6: note = Synthetic Construct
GKPQDK

SEQ ID NO: 14147 - protein, 6 aa, synthetic construct
  REGION 1..6: note = Synthetic Construct
GKPQEK

SEQ ID NO: 14148 - protein, 6 aa, synthetic construct
  REGION 1..6: note = Synthetic Construct
GKPQFK

SEQ ID NO: 14149 - protein, 6 aa, synthetic construct
  REGION 1..6: note = Synthetic Construct
GKPQGK

SEQ ID NO: 14150 - protein, 6 aa, synthetic construct
  REGION 1..6: note = Synthetic Construct
GKPQHK

SEQ ID NO: 14151 - protein, 6 aa, synthetic construct
  REGION 1..6: note = Synthetic Construct
GKPQIK

SEQ ID NO: 14152 - protein, 6 aa, synthetic construct
  REGION 1..6: note = Synthetic Construct
GKPQLK

SEQ ID NO: 14153 - protein, 6 aa, synthetic construct
  REGION 1..6: note = Synthetic Construct
GKPQNK

SEQ ID NO: 14154 - protein, 6 aa, synthetic construct
  REGION 1..6: note = Synthetic Construct
GKPQQK

SEQ ID NO: 14155 - protein, 6 aa, synthetic construct
  REGION 1..6: note = Synthetic Construct
GKPQRK

SEQ ID NO: 14156 - protein, 6 aa, synthetic construct
  REGION 1..6: note = Synthetic Construct
GKPQSK

SEQ ID NO: 14157 - protein, 6 aa, synthetic construct
  REGION 1..6: note = Synthetic Construct
GKPQTK

SEQ ID NO: 14158 - protein, 6 aa, synthetic construct
  REGION 1..6: note = Synthetic Construct
GKPQYK

SEQ ID NO: 14159 - protein, 6 aa, synthetic construct
  REGION 1..6: note = Synthetic Construct
GKPRAK

SEQ ID NO: 14160 - protein, 6 aa, synthetic construct
  REGION 1..6: note = Synthetic Construct
GKPRDK

SEQ ID NO: 14161 - protein, 6 aa, synthetic construct
  REGION 1..6: note = Synthetic Construct
GKPREK

SEQ ID NO: 14162 - protein, 6 aa, synthetic construct
  REGION 1..6: note = Synthetic Construct
GKPRFK

SEQ ID NO: 14163 - protein, 6 aa, synthetic construct
  REGION 1..6: note = Synthetic Construct
GKPRGK

SEQ ID NO: 14164 - protein, 6 aa, synthetic construct
  REGION 1..6: note = Synthetic Construct
GKPRHK

SEQ ID NO: 14165 - protein, 6 aa, synthetic construct
  REGION 1..6: note = Synthetic Construct
GKPRIK

SEQ ID NO: 14166 - protein, 6 aa, synthetic construct
  REGION 1..6: note = Synthetic Construct
GKPRLK

SEQ ID NO: 14167 - protein, 6 aa, synthetic construct
  REGION 1..6: note = Synthetic Construct
GKPRNK

SEQ ID NO: 14168 - protein, 6 aa, synthetic construct
  REGION 1..6: note = Synthetic Construct
GKPRQK

SEQ ID NO: 14169 - protein, 6 aa, synthetic construct
  REGION 1..6: note = Synthetic Construct
GKPRRK

SEQ ID NO: 14170 - protein, 6 aa, synthetic construct
  REGION 1..6: note = Synthetic Construct
GKPRSK

SEQ ID NO: 14171 - protein, 6 aa, synthetic construct
  REGION 1..6: note = Synthetic Construct
GKPRTK

SEQ ID NO: 14172 - protein, 6 aa, synthetic construct
  REGION 1..6: note = Synthetic Construct
GKPRYK

SEQ ID NO: 14173 - protein, 6 aa, synthetic construct
  REGION 1..6: note = Synthetic Construct
GKPSAK

SEQ ID NO: 14174 - protein, 6 aa, synthetic construct
  REGION 1..6: note = Synthetic Construct
GKPSDK

SEQ ID NO: 14175 - protein, 6 aa, synthetic construct
  REGION 1..6: note = Synthetic Construct
GKPSEK

SEQ ID NO: 14176 - protein, 6 aa, synthetic construct
  REGION 1..6: note = Synthetic Construct
GKPSFK

SEQ ID NO: 14177 - protein, 6 aa, synthetic construct
  REGION 1..6: note = Synthetic Construct
GKPSGK

SEQ ID NO: 14178 - protein, 6 aa, synthetic construct
  REGION 1..6: note = Synthetic Construct
GKPSHK

SEQ ID NO: 14179 - protein, 6 aa, synthetic construct
  REGION 1..6: note = Synthetic Construct
GKPSIK

SEQ ID NO: 14180 - protein, 6 aa, synthetic construct
  REGION 1..6: note = Synthetic Construct
GKPSLK

SEQ ID NO: 14181 - protein, 6 aa, synthetic construct
  REGION 1..6: note = Synthetic Construct
GKPSNK

SEQ ID NO: 14182 - protein, 6 aa, synthetic construct
  REGION 1..6: note = Synthetic Construct
GKPSQK

SEQ ID NO: 14183 - protein, 6 aa, synthetic construct
  REGION 1..6: note = Synthetic Construct
GKPSRK

SEQ ID NO: 14184 - protein, 6 aa, synthetic construct
  REGION 1..6: note = Synthetic Construct
GKPSSK

SEQ ID NO: 14185 - protein, 6 aa, synthetic construct
  REGION 1..6: note = Synthetic Construct
GKPSTK

SEQ ID NO: 14186 - protein, 6 aa, synthetic construct
  REGION 1..6: note = Synthetic Construct
GKPSYK

SEQ ID NO: 14187 - protein, 6 aa, synthetic construct
  REGION 1..6: note = Synthetic Construct
GKPTAK

SEQ ID NO: 14188 - protein, 6 aa, synthetic construct
  REGION 1..6: note = Synthetic Construct
GKPTDK

SEQ ID NO: 14189 - protein, 6 aa, synthetic construct
  REGION 1..6: note = Synthetic Construct
GKPTEK

SEQ ID NO: 14190 - protein, 6 aa, synthetic construct
  REGION 1..6: note = Synthetic Construct
GKPTFK

SEQ ID NO: 14191 - protein, 6 aa, synthetic construct
  REGION 1..6: note = Synthetic Construct
GKPTGK

SEQ ID NO: 14192 - protein, 6 aa, synthetic construct
  REGION 1..6: note = Synthetic Construct
GKPTHK

SEQ ID NO: 14193 - protein, 6 aa, synthetic construct
  REGION 1..6: note = Synthetic Construct
GKPTIK

SEQ ID NO: 14194 - protein, 6 aa, synthetic construct
  REGION 1..6: note = Synthetic Construct
GKPTLK

SEQ ID NO: 14195 - protein, 6 aa, synthetic construct
  REGION 1..6: note = Synthetic Construct
GKPTNK

SEQ ID NO: 14196 - protein, 6 aa, synthetic construct
  REGION 1..6: note = Synthetic Construct
GKPTQK

SEQ ID NO: 14197 - protein, 6 aa, synthetic construct
  REGION 1..6: note = Synthetic Construct
GKPTRK

SEQ ID NO: 14198 - protein, 6 aa, synthetic construct
  REGION 1..6: note = Synthetic Construct
GKPTSK

SEQ ID NO: 14199 - protein, 6 aa, synthetic construct
  REGION 1..6: note = Synthetic Construct
GKPTTK

SEQ ID NO: 14200 - protein, 6 aa, synthetic construct
  REGION 1..6: note = Synthetic Construct
GKPTYK

SEQ ID NO: 14201 - protein, 6 aa, synthetic construct
  REGION 1..6: note = Synthetic Construct
GKPYAK

SEQ ID NO: 14202 - protein, 6 aa, synthetic construct
  REGION 1..6: note = Synthetic Construct
GKPYDK

SEQ ID NO: 14203 - protein, 6 aa, synthetic construct
  REGION 1..6: note = Synthetic Construct
GKPYEK

SEQ ID NO: 14204 - protein, 6 aa, synthetic construct
  REGION 1..6: note = Synthetic Construct
GKPYFK

SEQ ID NO: 14205 - protein, 6 aa, synthetic construct
  REGION 1..6: note = Synthetic Construct
GKPYGK

SEQ ID NO: 14206 - protein, 6 aa, synthetic construct
  REGION 1..6: note = Synthetic Construct
GKPYHK

SEQ ID NO: 14207 - protein, 6 aa, synthetic construct
  REGION 1..6: note = Synthetic Construct
GKPYIK

SEQ ID NO: 14208 - protein, 6 aa, synthetic construct
  REGION 1..6: note = Synthetic Construct
GKPYLK

SEQ ID NO: 14209 - protein, 6 aa, synthetic construct
  REGION 1..6: note = Synthetic Construct
GKPYNK

SEQ ID NO: 14210 - protein, 6 aa, synthetic construct
  REGION 1..6: note = Synthetic Construct
GKPYQK

SEQ ID NO: 14211 - protein, 6 aa, synthetic construct
  REGION 1..6: note = Synthetic Construct
GKPYRK

SEQ ID NO: 14212 - protein, 6 aa, synthetic construct
  REGION 1..6: note = Synthetic Construct
GKPYSK

SEQ ID NO: 14213 - protein, 6 aa, synthetic construct
  REGION 1..6: note = Synthetic Construct
GKPYTK

SEQ ID NO: 14214 - protein, 6 aa, synthetic construct
  REGION 1..6: note = Synthetic Construct
GKPYYK

SEQ ID NO: 14215 - protein, 6 aa, synthetic construct
  REGION 1..6: note = Synthetic Construct
GKQAAK

SEQ ID NO: 14216 - protein, 6 aa, synthetic construct
  REGION 1..6: note = Synthetic Construct
GKQADK

SEQ ID NO: 14217 - protein, 6 aa, synthetic construct
  REGION 1..6: note = Synthetic Construct
GKQAEK

SEQ ID NO: 14218 - protein, 6 aa, synthetic construct
  REGION 1..6: note = Synthetic Construct
GKQAFK

SEQ ID NO: 14219 - protein, 6 aa, synthetic construct
  REGION 1..6: note = Synthetic Construct
GKQAGK

SEQ ID NO: 14220 - protein, 6 aa, synthetic construct
  REGION 1..6: note = Synthetic Construct
GKQAHK

SEQ ID NO: 14221 - protein, 6 aa, synthetic construct
  REGION 1..6: note = Synthetic Construct
GKQAIK

SEQ ID NO: 14222 - protein, 6 aa, synthetic construct
  REGION 1..6: note = Synthetic Construct
GKQALK

SEQ ID NO: 14223 - protein, 6 aa, synthetic construct
  REGION 1..6: note = Synthetic Construct
GKQANK

SEQ ID NO: 14224 - protein, 6 aa, synthetic construct
  REGION 1..6: note = Synthetic Construct
GKQAQK

SEQ ID NO: 14225 - protein, 6 aa, synthetic construct
  REGION 1..6: note = Synthetic Construct
GKQARK

SEQ ID NO: 14226 - protein, 6 aa, synthetic construct
  REGION 1..6: note = Synthetic Construct
GKQASK

SEQ ID NO: 14227 - protein, 6 aa, synthetic construct
  REGION 1..6: note = Synthetic Construct
GKQATK

SEQ ID NO: 14228 - protein, 6 aa, synthetic construct
  REGION 1..6: note = Synthetic Construct
GKQAYK

SEQ ID NO: 14229 - protein, 6 aa, synthetic construct
  REGION 1..6: note = Synthetic Construct
GKQDAK

SEQ ID NO: 14230 - protein, 6 aa, synthetic construct
  REGION 1..6: note = Synthetic Construct
GKQDDK

SEQ ID NO: 14231 - protein, 6 aa, synthetic construct
  REGION 1..6: note = Synthetic Construct
GKQDEK

SEQ ID NO: 14232 - protein, 6 aa, synthetic construct
  REGION 1..6: note = Synthetic Construct
GKQDFK

SEQ ID NO: 14233 - protein, 6 aa, synthetic construct
  REGION 1..6: note = Synthetic Construct
GKQDGK

SEQ ID NO: 14234 - protein, 6 aa, synthetic construct
  REGION 1..6: note = Synthetic Construct
GKQDHK

SEQ ID NO: 14235 - protein, 6 aa, synthetic construct
  REGION 1..6: note = Synthetic Construct
GKQDIK

SEQ ID NO: 14236 - protein, 6 aa, synthetic construct
  REGION 1..6: note = Synthetic Construct
GKQDLK

SEQ ID NO: 14237 - protein, 6 aa, synthetic construct
  REGION 1..6: note = Synthetic Construct
GKQDNK

SEQ ID NO: 14238 - protein, 6 aa, synthetic construct
  REGION 1..6: note = Synthetic Construct
GKQDQK

SEQ ID NO: 14239 - protein, 6 aa, synthetic construct
  REGION 1..6: note = Synthetic Construct
GKQDRK

SEQ ID NO: 14240 - protein, 6 aa, synthetic construct
  REGION 1..6: note = Synthetic Construct
GKQDSK

SEQ ID NO: 14241 - protein, 6 aa, synthetic construct
  REGION 1..6: note = Synthetic Construct
GKQDTK

SEQ ID NO: 14242 - protein, 6 aa, synthetic construct
  REGION 1..6: note = Synthetic Construct
GKQDYK

SEQ ID NO: 14243 - protein, 6 aa, synthetic construct
  REGION 1..6: note = Synthetic Construct
GKQEAK

SEQ ID NO: 14244 - protein, 6 aa, synthetic construct
  REGION 1..6: note = Synthetic Construct
GKQEDK

SEQ ID NO: 14245 - protein, 6 aa, synthetic construct
  REGION 1..6: note = Synthetic Construct
GKQEEK

SEQ ID NO: 14246 - protein, 6 aa, synthetic construct
  REGION 1..6: note = Synthetic Construct
GKQEFK

SEQ ID NO: 14247 - protein, 6 aa, synthetic construct
  REGION 1..6: note = Synthetic Construct
GKQEGK

SEQ ID NO: 14248 - protein, 6 aa, synthetic construct
  REGION 1..6: note = Synthetic Construct
GKQEHK

SEQ ID NO: 14249 - protein, 6 aa, synthetic construct
  REGION 1..6: note = Synthetic Construct
GKQEIK

SEQ ID NO: 14250 - protein, 6 aa, synthetic construct
  REGION 1..6: note = Synthetic Construct
GKQELK

SEQ ID NO: 14251 - protein, 6 aa, synthetic construct
  REGION 1..6: note = Synthetic Construct
GKQENK

SEQ ID NO: 14252 - protein, 6 aa, synthetic construct
  REGION 1..6: note = Synthetic Construct
GKQEQK

SEQ ID NO: 14253 - protein, 6 aa, synthetic construct
  REGION 1..6: note = Synthetic Construct
GKQERK

SEQ ID NO: 14254 - protein, 6 aa, synthetic construct
  REGION 1..6: note = Synthetic Construct
GKQESK

SEQ ID NO: 14255 - protein, 6 aa, synthetic construct
  REGION 1..6: note = Synthetic Construct
GKQETK

SEQ ID NO: 14256 - protein, 6 aa, synthetic construct
  REGION 1..6: note = Synthetic Construct
GKQEYK

SEQ ID NO: 14257 - protein, 6 aa, synthetic construct
  REGION 1..6: note = Synthetic Construct
GKQFAK

SEQ ID NO: 14258 - protein, 6 aa, synthetic construct
  REGION 1..6: note = Synthetic Construct
GKQFDK

SEQ ID NO: 14259 - protein, 6 aa, synthetic construct
  REGION 1..6: note = Synthetic Construct
GKQFEK

SEQ ID NO: 14260 - protein, 6 aa, synthetic construct
  REGION 1..6: note = Synthetic Construct
GKQFFK

SEQ ID NO: 14261 - protein, 6 aa, synthetic construct
  REGION 1..6: note = Synthetic Construct
GKQFGK

SEQ ID NO: 14262 - protein, 6 aa, synthetic construct
  REGION 1..6: note = Synthetic Construct
GKQFHK

SEQ ID NO: 14263 - protein, 6 aa, synthetic construct
  REGION 1..6: note = Synthetic Construct
GKQFIK

SEQ ID NO: 14264 - protein, 6 aa, synthetic construct
  REGION 1..6: note = Synthetic Construct
GKQFLK

SEQ ID NO: 14265 - protein, 6 aa, synthetic construct
  REGION 1..6: note = Synthetic Construct
GKQFNK

SEQ ID NO: 14266 - protein, 6 aa, synthetic construct
  REGION 1..6: note = Synthetic Construct
GKQFQK

SEQ ID NO: 14267 - protein, 6 aa, synthetic construct
  REGION 1..6: note = Synthetic Construct
GKQFRK

SEQ ID NO: 14268 - protein, 6 aa, synthetic construct
  REGION 1..6: note = Synthetic Construct
GKQFSK

SEQ ID NO: 14269 - protein, 6 aa, synthetic construct
  REGION 1..6: note = Synthetic Construct
GKQFTK

SEQ ID NO: 14270 - protein, 6 aa, synthetic construct
  REGION 1..6: note = Synthetic Construct
GKQFYK

SEQ ID NO: 14271 - protein, 6 aa, synthetic construct
  REGION 1..6: note = Synthetic Construct
GKQGAK

SEQ ID NO: 14272 - protein, 6 aa, synthetic construct
  REGION 1..6: note = Synthetic Construct
GKQGDK

SEQ ID NO: 14273 - protein, 6 aa, synthetic construct
  REGION 1..6: note = Synthetic Construct
GKQGEK

SEQ ID NO: 14274 - protein, 6 aa, synthetic construct
  REGION 1..6: note = Synthetic Construct
GKQGFK

SEQ ID NO: 14275 - protein, 6 aa, synthetic construct
  REGION 1..6: note = Synthetic Construct
GKQGGK

SEQ ID NO: 14276 - protein, 6 aa, synthetic construct
  REGION 1..6: note = Synthetic Construct
GKQGHK

SEQ ID NO: 14277 - protein, 6 aa, synthetic construct
  REGION 1..6: note = Synthetic Construct
GKQGIK

SEQ ID NO: 14278 - protein, 6 aa, synthetic construct
  REGION 1..6: note = Synthetic Construct
GKQGLK

SEQ ID NO: 14279 - protein, 6 aa, synthetic construct
  REGION 1..6: note = Synthetic Construct
GKQGNK

SEQ ID NO: 14280 - protein, 6 aa, synthetic construct
  REGION 1..6: note = Synthetic Construct
GKQGQK

SEQ ID NO: 14281 - protein, 6 aa, synthetic construct
  REGION 1..6: note = Synthetic Construct
GKQGRK

SEQ ID NO: 14282 - protein, 6 aa, synthetic construct
  REGION 1..6: note = Synthetic Construct
GKQGSK

SEQ ID NO: 14283 - protein, 6 aa, synthetic construct
  REGION 1..6: note = Synthetic Construct
GKQGTK

SEQ ID NO: 14284 - protein, 6 aa, synthetic construct
  REGION 1..6: note = Synthetic Construct
GKQGYK

SEQ ID NO: 14285 - protein, 6 aa, synthetic construct
  REGION 1..6: note = Synthetic Construct
GKQHAK

SEQ ID NO: 14286 - protein, 6 aa, synthetic construct
  REGION 1..6: note = Synthetic Construct
GKQHDK

SEQ ID NO: 14287 - protein, 6 aa, synthetic construct
  REGION 1..6: note = Synthetic Construct
GKQHEK

SEQ ID NO: 14288 - protein, 6 aa, synthetic construct
  REGION 1..6: note = Synthetic Construct
GKQHFK

SEQ ID NO: 14289 - protein, 6 aa, synthetic construct
  REGION 1..6: note = Synthetic Construct
GKQHGK

SEQ ID NO: 14290 - protein, 6 aa, synthetic construct
  REGION 1..6: note = Synthetic Construct
GKQHHK

SEQ ID NO: 14291 - protein, 6 aa, synthetic construct
  REGION 1..6: note = Synthetic Construct
GKQHIK

SEQ ID NO: 14292 - protein, 6 aa, synthetic construct
  REGION 1..6: note = Synthetic Construct
GKQHLK

SEQ ID NO: 14293 - protein, 6 aa, synthetic construct
  REGION 1..6: note = Synthetic Construct
GKQHNK

SEQ ID NO: 14294 - protein, 6 aa, synthetic construct
  REGION 1..6: note = Synthetic Construct
GKQHQK

SEQ ID NO: 14295 - protein, 6 aa, synthetic construct
  REGION 1..6: note = Synthetic Construct
GKQHRK

SEQ ID NO: 14296 - protein, 6 aa, synthetic construct
  REGION 1..6: note = Synthetic Construct
GKQHSK

SEQ ID NO: 14297 - protein, 6 aa, synthetic construct
  REGION 1..6: note = Synthetic Construct
GKQHTK

SEQ ID NO: 14298 - protein, 6 aa, synthetic construct
  REGION 1..6: note = Synthetic Construct
GKQHYK

SEQ ID NO: 14299 - protein, 6 aa, synthetic construct
  REGION 1..6: note = Synthetic Construct
GKQIAK

SEQ ID NO: 14300 - protein, 6 aa, synthetic construct
  REGION 1..6: note = Synthetic Construct
GKQIDK

SEQ ID NO: 14301 - protein, 6 aa, synthetic construct
  REGION 1..6: note = Synthetic Construct
GKQIEK

SEQ ID NO: 14302 - protein, 6 aa, synthetic construct
  REGION 1..6: note = Synthetic Construct
GKQIFK

SEQ ID NO: 14303 - protein, 6 aa, synthetic construct
  REGION 1..6: note = Synthetic Construct
GKQIGK

SEQ ID NO: 14304 - protein, 6 aa, synthetic construct
  REGION 1..6: note = Synthetic Construct
GKQIHK

SEQ ID NO: 14305 - protein, 6 aa, synthetic construct
  REGION 1..6: note = Synthetic Construct
GKQIIK

SEQ ID NO: 14306 - protein, 6 aa, synthetic construct
  REGION 1..6: note = Synthetic Construct
GKQILK

SEQ ID NO: 14307 - protein, 6 aa, synthetic construct
  REGION 1..6: note = Synthetic Construct
GKQINK

SEQ ID NO: 14308 - protein, 6 aa, synthetic construct
  REGION 1..6: note = Synthetic Construct
GKQIQK

SEQ ID NO: 14309 - protein, 6 aa, synthetic construct
  REGION 1..6: note = Synthetic Construct
GKQIRK

SEQ ID NO: 14310 - protein, 6 aa, synthetic construct
  REGION 1..6: note = Synthetic Construct
GKQISK

SEQ ID NO: 14311 - protein, 6 aa, synthetic construct
  REGION 1..6: note = Synthetic Construct
GKQITK

SEQ ID NO: 14312 - protein, 6 aa, synthetic construct
  REGION 1..6: note = Synthetic Construct
GKQIYK

SEQ ID NO: 14313 - protein, 6 aa, synthetic construct
  REGION 1..6: note = Synthetic Construct
GKQLAK

SEQ ID NO: 14314 - protein, 6 aa, synthetic construct
  REGION 1..6: note = Synthetic Construct
GKQLDK

SEQ ID NO: 14315 - protein, 6 aa, synthetic construct
  REGION 1..6: note = Synthetic Construct
GKQLEK

SEQ ID NO: 14316 - protein, 6 aa, synthetic construct
  REGION 1..6: note = Synthetic Construct
GKQLFK

SEQ ID NO: 14317 - protein, 6 aa, synthetic construct
  REGION 1..6: note = Synthetic Construct
GKQLGK

SEQ ID NO: 14318 - protein, 6 aa, synthetic construct
  REGION 1..6: note = Synthetic Construct
GKQLHK

SEQ ID NO: 14319 - protein, 6 aa, synthetic construct
  REGION 1..6: note = Synthetic Construct
GKQLIK

SEQ ID NO: 14320 - protein, 6 aa, synthetic construct
  REGION 1..6: note = Synthetic Construct
GKQLLK

SEQ ID NO: 14321 - protein, 6 aa, synthetic construct
  REGION 1..6: note = Synthetic Construct
GKQLNK

SEQ ID NO: 14322 - protein, 6 aa, synthetic construct
  REGION 1..6: note = Synthetic Construct
GKQLQK

SEQ ID NO: 14323 - protein, 6 aa, synthetic construct
  REGION 1..6: note = Synthetic Construct
GKQLRK

SEQ ID NO: 14324 - protein, 6 aa, synthetic construct
  REGION 1..6: note = Synthetic Construct
GKQLSK

SEQ ID NO: 14325 - protein, 6 aa, synthetic construct
  REGION 1..6: note = Synthetic Construct
GKQLTK

SEQ ID NO: 14326 - protein, 6 aa, synthetic construct
  REGION 1..6: note = Synthetic Construct
GKQLYK

SEQ ID NO: 14327 - protein, 6 aa, synthetic construct
  REGION 1..6: note = Synthetic Construct
GKQNAK

SEQ ID NO: 14328 - protein, 6 aa, synthetic construct
  REGION 1..6: note = Synthetic Construct
GKQNDK

SEQ ID NO: 14329 - protein, 6 aa, synthetic construct
  REGION 1..6: note = Synthetic Construct
GKQNEK

SEQ ID NO: 14330 - protein, 6 aa, synthetic construct
  REGION 1..6: note = Synthetic Construct
GKQNFK

SEQ ID NO: 14331 - protein, 6 aa, synthetic construct
  REGION 1..6: note = Synthetic Construct
GKQNGK

SEQ ID NO: 14332 - protein, 6 aa, synthetic construct
  REGION 1..6: note = Synthetic Construct
GKQNHK

SEQ ID NO: 14333 - protein, 6 aa, synthetic construct
  REGION 1..6: note = Synthetic Construct
GKQNIK

SEQ ID NO: 14334 - protein, 6 aa, synthetic construct
  REGION 1..6: note = Synthetic Construct
GKQNLK

SEQ ID NO: 14335 - protein, 6 aa, synthetic construct
  REGION 1..6: note = Synthetic Construct
GKQNNK

SEQ ID NO: 14336 - protein, 6 aa, synthetic construct
  REGION 1..6: note = Synthetic Construct
GKQNQK

SEQ ID NO: 14337 - protein, 6 aa, synthetic construct
  REGION 1..6: note = Synthetic Construct
GKQNRK

SEQ ID NO: 14338 - protein, 6 aa, synthetic construct
  REGION 1..6: note = Synthetic Construct
GKQNSK

SEQ ID NO: 14339 - protein, 6 aa, synthetic construct
  REGION 1..6: note = Synthetic Construct
GKQNTK

SEQ ID NO: 14340 - protein, 6 aa, synthetic construct
  REGION 1..6: note = Synthetic Construct
GKQNYK

SEQ ID NO: 14341 - protein, 6 aa, synthetic construct
  REGION 1..6: note = Synthetic Construct
GKQQAK

SEQ ID NO: 14342 - protein, 6 aa, synthetic construct
  REGION 1..6: note = Synthetic Construct
GKQQDK

SEQ ID NO: 14343 - protein, 6 aa, synthetic construct
  REGION 1..6: note = Synthetic Construct
GKQQEK

SEQ ID NO: 14344 - protein, 6 aa, synthetic construct
  REGION 1..6: note = Synthetic Construct
GKQQFK

SEQ ID NO: 14345 - protein, 6 aa, synthetic construct
  REGION 1..6: note = Synthetic Construct
GKQQGK

SEQ ID NO: 14346 - protein, 6 aa, synthetic construct
  REGION 1..6: note = Synthetic Construct
GKQQHK

SEQ ID NO: 14347 - protein, 6 aa, synthetic construct
  REGION 1..6: note = Synthetic Construct
GKQQIK

SEQ ID NO: 14348 - protein, 6 aa, synthetic construct
  REGION 1..6: note = Synthetic Construct
GKQQLK

SEQ ID NO: 14349 - protein, 6 aa, synthetic construct
  REGION 1..6: note = Synthetic Construct
GKQQNK

SEQ ID NO: 14350 - protein, 6 aa, synthetic construct
  REGION 1..6: note = Synthetic Construct
GKQQQK

SEQ ID NO: 14351 - protein, 6 aa, synthetic construct
  REGION 1..6: note = Synthetic Construct
GKQQRK

SEQ ID NO: 14352 - protein, 6 aa, synthetic construct
  REGION 1..6: note = Synthetic Construct
GKQQSK

SEQ ID NO: 14353 - protein, 6 aa, synthetic construct
  REGION 1..6: note = Synthetic Construct
GKQQTK

SEQ ID NO: 14354 - protein, 6 aa, synthetic construct
  REGION 1..6: note = Synthetic Construct
GKQQYK

SEQ ID NO: 14355 - protein, 6 aa, synthetic construct
  REGION 1..6: note = Synthetic Construct
GKQRAK

SEQ ID NO: 14356 - protein, 6 aa, synthetic construct
  REGION 1..6: note = Synthetic Construct
GKQRDK

SEQ ID NO: 14357 - protein, 6 aa, synthetic construct
  REGION 1..6: note = Synthetic Construct
GKQREK

SEQ ID NO: 14358 - protein, 6 aa, synthetic construct
  REGION 1..6: note = Synthetic Construct
GKQRFK

SEQ ID NO: 14359 - protein, 6 aa, synthetic construct
  REGION 1..6: note = Synthetic Construct
GKQRGK

SEQ ID NO: 14360 - protein, 6 aa, synthetic construct
  REGION 1..6: note = Synthetic Construct
GKQRHK

SEQ ID NO: 14361 - protein, 6 aa, synthetic construct
  REGION 1..6: note = Synthetic Construct
GKQRIK

SEQ ID NO: 14362 - protein, 6 aa, synthetic construct
  REGION 1..6: note = Synthetic Construct
GKQRLK

SEQ ID NO: 14363 - protein, 6 aa, synthetic construct
  REGION 1..6: note = Synthetic Construct
GKQRNK

SEQ ID NO: 14364 - protein, 6 aa, synthetic construct
  REGION 1..6: note = Synthetic Construct
GKQRQK

SEQ ID NO: 14365 - protein, 6 aa, synthetic construct
  REGION 1..6: note = Synthetic Construct
GKQRRK

SEQ ID NO: 14366 - protein, 6 aa, synthetic construct
  REGION 1..6: note = Synthetic Construct
GKQRSK

SEQ ID NO: 14367 - protein, 6 aa, synthetic construct
  REGION 1..6: note = Synthetic Construct
GKQRTK

SEQ ID NO: 14368 - protein, 6 aa, synthetic construct
  REGION 1..6: note = Synthetic Construct
GKQRYK

SEQ ID NO: 14369 - protein, 6 aa, synthetic construct
  REGION 1..6: note = Synthetic Construct
GKQSAK

SEQ ID NO: 14370 - protein, 6 aa, synthetic construct
  REGION 1..6: note = Synthetic Construct
GKQSDK

SEQ ID NO: 14371 - protein, 6 aa, synthetic construct
  REGION 1..6: note = Synthetic Construct
GKQSEK

SEQ ID NO: 14372 - protein, 6 aa, synthetic construct
  REGION 1..6: note = Synthetic Construct
GKQSFK

SEQ ID NO: 14373 - protein, 6 aa, synthetic construct
  REGION 1..6: note = Synthetic Construct
GKQSGK

SEQ ID NO: 14374 - protein, 6 aa, synthetic construct
  REGION 1..6: note = Synthetic Construct
GKQSHK

SEQ ID NO: 14375 - protein, 6 aa, synthetic construct
  REGION 1..6: note = Synthetic Construct
GKQSIK

SEQ ID NO: 14376 - protein, 6 aa, synthetic construct
  REGION 1..6: note = Synthetic Construct
GKQSLK

SEQ ID NO: 14377 - protein, 6 aa, synthetic construct
  REGION 1..6: note = Synthetic Construct
GKQSNK

SEQ ID NO: 14378 - protein, 6 aa, synthetic construct
  REGION 1..6: note = Synthetic Construct
GKQSQK

SEQ ID NO: 14379 - protein, 6 aa, synthetic construct
  REGION 1..6: note = Synthetic Construct
GKQSRK

SEQ ID NO: 14380 - protein, 6 aa, synthetic construct
  REGION 1..6: note = Synthetic Construct
GKQSSK

SEQ ID NO: 14381 - protein, 6 aa, synthetic construct
  REGION 1..6: note = Synthetic Construct
GKQSTK

SEQ ID NO: 14382 - protein, 6 aa, synthetic construct
  REGION 1..6: note = Synthetic Construct
GKQSYK

SEQ ID NO: 14383 - protein, 6 aa, synthetic construct
  REGION 1..6: note = Synthetic Construct
GKQTAK

SEQ ID NO: 14384 - protein, 6 aa, synthetic construct
  REGION 1..6: note = Synthetic Construct
GKQTDK

SEQ ID NO: 14385 - protein, 6 aa, synthetic construct
  REGION 1..6: note = Synthetic Construct
GKQTEK

SEQ ID NO: 14386 - protein, 6 aa, synthetic construct
  REGION 1..6: note = Synthetic Construct
GKQTFK

SEQ ID NO: 14387 - protein, 6 aa, synthetic construct
  REGION 1..6: note = Synthetic Construct
GKQTGK

SEQ ID NO: 14388 - protein, 6 aa, synthetic construct
  REGION 1..6: note = Synthetic Construct
GKQTHK

SEQ ID NO: 14389 - protein, 6 aa, synthetic construct
  REGION 1..6: note = Synthetic Construct
GKQTIK

SEQ ID NO: 14390 - protein, 6 aa, synthetic construct
  REGION 1..6: note = Synthetic Construct
GKQTLK

SEQ ID NO: 14391 - protein, 6 aa, synthetic construct
  REGION 1..6: note = Synthetic Construct
GKQTNK

SEQ ID NO: 14392 - protein, 6 aa, synthetic construct
  REGION 1..6: note = Synthetic Construct
GKQTQK

SEQ ID NO: 14393 - protein, 6 aa, synthetic construct
  REGION 1..6: note = Synthetic Construct
GKQTRK

SEQ ID NO: 14394 - protein, 6 aa, synthetic construct
  REGION 1..6: note = Synthetic Construct
GKQTSK

SEQ ID NO: 14395 - protein, 6 aa, synthetic construct
  REGION 1..6: note = Synthetic Construct
GKQTTK

SEQ ID NO: 14396 - protein, 6 aa, synthetic construct
  REGION 1..6: note = Synthetic Construct
GKQTYK

SEQ ID NO: 14397 - protein, 6 aa, synthetic construct
  REGION 1..6: note = Synthetic Construct
GKQYAK

SEQ ID NO: 14398 - protein, 6 aa, synthetic construct
  REGION 1..6: note = Synthetic Construct
GKQYDK

SEQ ID NO: 14399 - protein, 6 aa, synthetic construct
  REGION 1..6: note = Synthetic Construct
GKQYEK

SEQ ID NO: 14400 - protein, 6 aa, synthetic construct
  REGION 1..6: note = Synthetic Construct
GKQYFK

SEQ ID NO: 14401 - protein, 6 aa, synthetic construct
  REGION 1..6: note = Synthetic Construct
GKQYGK

SEQ ID NO: 14402 - protein, 6 aa, synthetic construct
  REGION 1..6: note = Synthetic Construct
GKQYHK

SEQ ID NO: 14403 - protein, 6 aa, synthetic construct
  REGION 1..6: note = Synthetic Construct
GKQYIK

SEQ ID NO: 14404 - protein, 6 aa, synthetic construct
  REGION 1..6: note = Synthetic Construct
GKQYLK

SEQ ID NO: 14405 - protein, 6 aa, synthetic construct
  REGION 1..6: note = Synthetic Construct
GKQYNK

SEQ ID NO: 14406 - protein, 6 aa, synthetic construct
  REGION 1..6: note = Synthetic Construct
GKQYQK

SEQ ID NO: 14407 - protein, 6 aa, synthetic construct
  REGION 1..6: note = Synthetic Construct
GKQYRK

SEQ ID NO: 14408 - protein, 6 aa, synthetic construct
  REGION 1..6: note = Synthetic Construct
GKQYSK

SEQ ID NO: 14409 - protein, 6 aa, synthetic construct
  REGION 1..6: note = Synthetic Construct
GKQYTK

SEQ ID NO: 14410 - protein, 6 aa, synthetic construct
  REGION 1..6: note = Synthetic Construct
GKQYYK

SEQ ID NO: 14411 - protein, 6 aa, synthetic construct
  REGION 1..6: note = Synthetic Construct
GKRAAK

SEQ ID NO: 14412 - protein, 6 aa, synthetic construct
  REGION 1..6: note = Synthetic Construct
GKRADK

SEQ ID NO: 14413 - protein, 6 aa, synthetic construct
  REGION 1..6: note = Synthetic Construct
GKRAEK

SEQ ID NO: 14414 - protein, 6 aa, synthetic construct
  REGION 1..6: note = Synthetic Construct
GKRAFK

SEQ ID NO: 14415 - protein, 6 aa, synthetic construct
  REGION 1..6: note = Synthetic Construct
GKRAGK

SEQ ID NO: 14416 - protein, 6 aa, synthetic construct
  REGION 1..6: note = Synthetic Construct
GKRAHK

SEQ ID NO: 14417 - protein, 6 aa, synthetic construct
  REGION 1..6: note = Synthetic Construct
GKRAIK

SEQ ID NO: 14418 - protein, 6 aa, synthetic construct
  REGION 1..6: note = Synthetic Construct
GKRALK

SEQ ID NO: 14419 - protein, 6 aa, synthetic construct
  REGION 1..6: note = Synthetic Construct
GKRANK

SEQ ID NO: 14420 - protein, 6 aa, synthetic construct
  REGION 1..6: note = Synthetic Construct
GKRAQK

SEQ ID NO: 14421 - protein, 6 aa, synthetic construct
  REGION 1..6: note = Synthetic Construct
GKRARK

SEQ ID NO: 14422 - protein, 6 aa, synthetic construct
  REGION 1..6: note = Synthetic Construct
GKRASK

SEQ ID NO: 14423 - protein, 6 aa, synthetic construct
  REGION 1..6: note = Synthetic Construct
GKRATK

SEQ ID NO: 14424 - protein, 6 aa, synthetic construct
  REGION 1..6: note = Synthetic Construct
GKRAYK

SEQ ID NO: 14425 - protein, 6 aa, synthetic construct
  REGION 1..6: note = Synthetic Construct
GKRDAK

SEQ ID NO: 14426 - protein, 6 aa, synthetic construct
  REGION 1..6: note = Synthetic Construct
GKRDDK

SEQ ID NO: 14427 - protein, 6 aa, synthetic construct
  REGION 1..6: note = Synthetic Construct
GKRDEK

SEQ ID NO: 14428 - protein, 6 aa, synthetic construct
  REGION 1..6: note = Synthetic Construct
GKRDFK

SEQ ID NO: 14429 - protein, 6 aa, synthetic construct
  REGION 1..6: note = Synthetic Construct
GKRDGK

SEQ ID NO: 14430 - protein, 6 aa, synthetic construct
  REGION 1..6: note = Synthetic Construct
GKRDHK

SEQ ID NO: 14431 - protein, 6 aa, synthetic construct
  REGION 1..6: note = Synthetic Construct
GKRDIK

SEQ ID NO: 14432 - protein, 6 aa, synthetic construct
  REGION 1..6: note = Synthetic Construct
GKRDLK

SEQ ID NO: 14433 - protein, 6 aa, synthetic construct
  REGION 1..6: note = Synthetic Construct
GKRDNK

SEQ ID NO: 14434 - protein, 6 aa, synthetic construct
  REGION 1..6: note = Synthetic Construct
GKRDQK

SEQ ID NO: 14435 - protein, 6 aa, synthetic construct
  REGION 1..6: note = Synthetic Construct
GKRDRK

SEQ ID NO: 14436 - protein, 6 aa, synthetic construct
  REGION 1..6: note = Synthetic Construct
GKRDSK

SEQ ID NO: 14437 - protein, 6 aa, synthetic construct
  REGION 1..6: note = Synthetic Construct
GKRDTK

SEQ ID NO: 14438 - protein, 6 aa, synthetic construct
  REGION 1..6: note = Synthetic Construct
GKRDYK

SEQ ID NO: 14439 - protein, 6 aa, synthetic construct
  REGION 1..6: note = Synthetic Construct
GKREAK

SEQ ID NO: 14440 - protein, 6 aa, synthetic construct
  REGION 1..6: note = Synthetic Construct
GKREDK

SEQ ID NO: 14441 - protein, 6 aa, synthetic construct
  REGION 1..6: note = Synthetic Construct
GKREEK

SEQ ID NO: 14442 - protein, 6 aa, synthetic construct
  REGION 1..6: note = Synthetic Construct
GKREFK

SEQ ID NO: 14443 - protein, 6 aa, synthetic construct
  REGION 1..6: note = Synthetic Construct
GKREGK

SEQ ID NO: 14444 - protein, 6 aa, synthetic construct
  REGION 1..6: note = Synthetic Construct
GKREHK

SEQ ID NO: 14445 - protein, 6 aa, synthetic construct
  REGION 1..6: note = Synthetic Construct
GKREIK

SEQ ID NO: 14446 - protein, 6 aa, synthetic construct
  REGION 1..6: note = Synthetic Construct
GKRELK

SEQ ID NO: 14447 - protein, 6 aa, synthetic construct
  REGION 1..6: note = Synthetic Construct
GKRENK

SEQ ID NO: 14448 - protein, 6 aa, synthetic construct
  REGION 1..6: note = Synthetic Construct
GKREQK

SEQ ID NO: 14449 - protein, 6 aa, synthetic construct
  REGION 1..6: note = Synthetic Construct
GKRERK

SEQ ID NO: 14450 - protein, 6 aa, synthetic construct
  REGION 1..6: note = Synthetic Construct
GKRESK

SEQ ID NO: 14451 - protein, 6 aa, synthetic construct
  REGION 1..6: note = Synthetic Construct
GKRETK

SEQ ID NO: 14452 - protein, 6 aa, synthetic construct
  REGION 1..6: note = Synthetic Construct
GKREYK

SEQ ID NO: 14453 - protein, 6 aa, synthetic construct
  REGION 1..6: note = Synthetic Construct
GKRFAK

SEQ ID NO: 14454 - protein, 6 aa, synthetic construct
  REGION 1..6: note = Synthetic Construct
GKRFDK

SEQ ID NO: 14455 - protein, 6 aa, synthetic construct
  REGION 1..6: note = Synthetic Construct
GKRFEK

SEQ ID NO: 14456 - protein, 6 aa, synthetic construct
  REGION 1..6: note = Synthetic Construct
GKRFFK

SEQ ID NO: 14457 - protein, 6 aa, synthetic construct
  REGION 1..6: note = Synthetic Construct
GKRFGK

SEQ ID NO: 14458 - protein, 6 aa, synthetic construct
  REGION 1..6: note = Synthetic Construct
GKRFHK

SEQ ID NO: 14459 - protein, 6 aa, synthetic construct
  REGION 1..6: note = Synthetic Construct
GKRFIK

SEQ ID NO: 14460 - protein, 6 aa, synthetic construct
  REGION 1..6: note = Synthetic Construct
GKRFLK

SEQ ID NO: 14461 - protein, 6 aa, synthetic construct
  REGION 1..6: note = Synthetic Construct
GKRFNK

SEQ ID NO: 14462 - protein, 6 aa, synthetic construct
  REGION 1..6: note = Synthetic Construct
GKRFQK

SEQ ID NO: 14463 - protein, 6 aa, synthetic construct
  REGION 1..6: note = Synthetic Construct
GKRFRK

SEQ ID NO: 14464 - protein, 6 aa, synthetic construct
  REGION 1..6: note = Synthetic Construct
GKRFSK

SEQ ID NO: 14465 - protein, 6 aa, synthetic construct
  REGION 1..6: note = Synthetic Construct
GKRFTK

SEQ ID NO: 14466 - protein, 6 aa, synthetic construct
  REGION 1..6: note = Synthetic Construct
GKRFYK

SEQ ID NO: 14467 - protein, 6 aa, synthetic construct
  REGION 1..6: note = Synthetic Construct
GKRGAK

SEQ ID NO: 14468 - protein, 6 aa, synthetic construct
  REGION 1..6: note = Synthetic Construct
GKRGDK

SEQ ID NO: 14469 - protein, 6 aa, synthetic construct
  REGION 1..6: note = Synthetic Construct
GKRGEK

SEQ ID NO: 14470 - protein, 6 aa, synthetic construct
  REGION 1..6: note = Synthetic Construct
GKRGFK

SEQ ID NO: 14471 - protein, 6 aa, synthetic construct
  REGION 1..6: note = Synthetic Construct
GKRGGK

SEQ ID NO: 14472 - protein, 6 aa, synthetic construct
  REGION 1..6: note = Synthetic Construct
GKRGHK

SEQ ID NO: 14473 - protein, 6 aa, synthetic construct
  REGION 1..6: note = Synthetic Construct
GKRGIK

SEQ ID NO: 14474 - protein, 6 aa, synthetic construct
  REGION 1..6: note = Synthetic Construct
GKRGLK

SEQ ID NO: 14475 - protein, 6 aa, synthetic construct
  REGION 1..6: note = Synthetic Construct
GKRGNK

SEQ ID NO: 14476 - protein, 6 aa, synthetic construct
  REGION 1..6: note = Synthetic Construct
GKRGQK

SEQ ID NO: 14477 - protein, 6 aa, synthetic construct
  REGION 1..6: note = Synthetic Construct
GKRGRK

SEQ ID NO: 14478 - protein, 6 aa, synthetic construct
  REGION 1..6: note = Synthetic Construct
GKRGSK

SEQ ID NO: 14479 - protein, 6 aa, synthetic construct
  REGION 1..6: note = Synthetic Construct
GKRGTK

SEQ ID NO: 14480 - protein, 6 aa, synthetic construct
  REGION 1..6: note = Synthetic Construct
GKRGYK

SEQ ID NO: 14481 - protein, 6 aa, synthetic construct
  REGION 1..6: note = Synthetic Construct
GKRHAK

SEQ ID NO: 14482 - protein, 6 aa, synthetic construct
  REGION 1..6: note = Synthetic Construct
GKRHDK

SEQ ID NO: 14483 - protein, 6 aa, synthetic construct
  REGION 1..6: note = Synthetic Construct
GKRHEK

SEQ ID NO: 14484 - protein, 6 aa, synthetic construct
  REGION 1..6: note = Synthetic Construct
GKRHFK

SEQ ID NO: 14485 - protein, 6 aa, synthetic construct
  REGION 1..6: note = Synthetic Construct
GKRHGK

SEQ ID NO: 14486 - protein, 6 aa, synthetic construct
  REGION 1..6: note = Synthetic Construct
GKRHHK

SEQ ID NO: 14487 - protein, 6 aa, synthetic construct
  REGION 1..6: note = Synthetic Construct
GKRHIK

SEQ ID NO: 14488 - protein, 6 aa, synthetic construct
  REGION 1..6: note = Synthetic Construct
GKRHLK

SEQ ID NO: 14489 - protein, 6 aa, synthetic construct
  REGION 1..6: note = Synthetic Construct
GKRHNK

SEQ ID NO: 14490 - protein, 6 aa, synthetic construct
  REGION 1..6: note = Synthetic Construct
GKRHQK

SEQ ID NO: 14491 - protein, 6 aa, synthetic construct
  REGION 1..6: note = Synthetic Construct
GKRHRK

SEQ ID NO: 14492 - protein, 6 aa, synthetic construct
  REGION 1..6: note = Synthetic Construct
GKRHSK

SEQ ID NO: 14493 - protein, 6 aa, synthetic construct
  REGION 1..6: note = Synthetic Construct
GKRHTK

SEQ ID NO: 14494 - protein, 6 aa, synthetic construct
  REGION 1..6: note = Synthetic Construct
GKRHYK

SEQ ID NO: 14495 - protein, 6 aa, synthetic construct
  REGION 1..6: note = Synthetic Construct
GKRIAK

SEQ ID NO: 14496 - protein, 6 aa, synthetic construct
  REGION 1..6: note = Synthetic Construct
GKRIDK

SEQ ID NO: 14497 - protein, 6 aa, synthetic construct
  REGION 1..6: note = Synthetic Construct
GKRIEK

SEQ ID NO: 14498 - protein, 6 aa, synthetic construct
  REGION 1..6: note = Synthetic Construct
GKRIFK

SEQ ID NO: 14499 - protein, 6 aa, synthetic construct
  REGION 1..6: note = Synthetic Construct
GKRIGK

SEQ ID NO: 14500 - protein, 6 aa, synthetic construct
  REGION 1..6: note = Synthetic Construct
GKRIHK

SEQ ID NO: 14501 - protein, 6 aa, synthetic construct
  REGION 1..6: note = Synthetic Construct
GKRIIK

SEQ ID NO: 14502 - protein, 6 aa, synthetic construct
  REGION 1..6: note = Synthetic Construct
GKRILK

SEQ ID NO: 14503 - protein, 6 aa, synthetic construct
  REGION 1..6: note = Synthetic Construct
GKRINK

SEQ ID NO: 14504 - protein, 6 aa, synthetic construct
  REGION 1..6: note = Synthetic Construct
GKRIQK

SEQ ID NO: 14505 - protein, 6 aa, synthetic construct
  REGION 1..6: note = Synthetic Construct
GKRIRK

SEQ ID NO: 14506 - protein, 6 aa, synthetic construct
  REGION 1..6: note = Synthetic Construct
GKRISK

SEQ ID NO: 14507 - protein, 6 aa, synthetic construct
  REGION 1..6: note = Synthetic Construct
GKRITK

SEQ ID NO: 14508 - protein, 6 aa, synthetic construct
  REGION 1..6: note = Synthetic Construct
GKRIYK

SEQ ID NO: 14509 - protein, 6 aa, synthetic construct
  REGION 1..6: note = Synthetic Construct
GKRLAK

SEQ ID NO: 14510 - protein, 6 aa, synthetic construct
  REGION 1..6: note = Synthetic Construct
GKRLDK

SEQ ID NO: 14511 - protein, 6 aa, synthetic construct
  REGION 1..6: note = Synthetic Construct
GKRLEK

SEQ ID NO: 14512 - protein, 6 aa, synthetic construct
  REGION 1..6: note = Synthetic Construct
GKRLFK

SEQ ID NO: 14513 - protein, 6 aa, synthetic construct
  REGION 1..6: note = Synthetic Construct
GKRLGK

SEQ ID NO: 14514 - protein, 6 aa, synthetic construct
  REGION 1..6: note = Synthetic Construct
GKRLHK

SEQ ID NO: 14515 - protein, 6 aa, synthetic construct
  REGION 1..6: note = Synthetic Construct
GKRLIK

SEQ ID NO: 14516 - protein, 6 aa, synthetic construct
  REGION 1..6: note = Synthetic Construct
GKRLLK

SEQ ID NO: 14517 - protein, 6 aa, synthetic construct
  REGION 1..6: note = Synthetic Construct
GKRLNK

SEQ ID NO: 14518 - protein, 6 aa, synthetic construct
  REGION 1..6: note = Synthetic Construct
GKRLQK

SEQ ID NO: 14519 - protein, 6 aa, synthetic construct
  REGION 1..6: note = Synthetic Construct
GKRLRK

SEQ ID NO: 14520 - protein, 6 aa, synthetic construct
  REGION 1..6: note = Synthetic Construct
GKRLSK

SEQ ID NO: 14521 - protein, 6 aa, synthetic construct
  REGION 1..6: note = Synthetic Construct
GKRLTK

SEQ ID NO: 14522 - protein, 6 aa, synthetic construct
  REGION 1..6: note = Synthetic Construct
GKRLYK

SEQ ID NO: 14523 - protein, 6 aa, synthetic construct
  REGION 1..6: note = Synthetic Construct
GKRNAK

SEQ ID NO: 14524 - protein, 6 aa, synthetic construct
  REGION 1..6: note = Synthetic Construct
GKRNDK

SEQ ID NO: 14525 - protein, 6 aa, synthetic construct
  REGION 1..6: note = Synthetic Construct
GKRNEK

SEQ ID NO: 14526 - protein, 6 aa, synthetic construct
  REGION 1..6: note = Synthetic Construct
GKRNFK

SEQ ID NO: 14527 - protein, 6 aa, synthetic construct
  REGION 1..6: note = Synthetic Construct
GKRNGK

SEQ ID NO: 14528 - protein, 6 aa, synthetic construct
  REGION 1..6: note = Synthetic Construct
GKRNHK

SEQ ID NO: 14529 - protein, 6 aa, synthetic construct
  REGION 1..6: note = Synthetic Construct
GKRNIK

SEQ ID NO: 14530 - protein, 6 aa, synthetic construct
  REGION 1..6: note = Synthetic Construct
GKRNLK

SEQ ID NO: 14531 - protein, 6 aa, synthetic construct
  REGION 1..6: note = Synthetic Construct
GKRNNK

SEQ ID NO: 14532 - protein, 6 aa, synthetic construct
  REGION 1..6: note = Synthetic Construct
GKRNQK

SEQ ID NO: 14533 - protein, 6 aa, synthetic construct
  REGION 1..6: note = Synthetic Construct
GKRNRK

SEQ ID NO: 14534 - protein, 6 aa, synthetic construct
  REGION 1..6: note = Synthetic Construct
GKRNSK

SEQ ID NO: 14535 - protein, 6 aa, synthetic construct
  REGION 1..6: note = Synthetic Construct
GKRNTK

SEQ ID NO: 14536 - protein, 6 aa, synthetic construct
  REGION 1..6: note = Synthetic Construct
GKRNYK

SEQ ID NO: 14537 - protein, 6 aa, synthetic construct
  REGION 1..6: note = Synthetic Construct
GKRQAK

SEQ ID NO: 14538 - protein, 6 aa, synthetic construct
  REGION 1..6: note = Synthetic Construct
GKRQDK

SEQ ID NO: 14539 - protein, 6 aa, synthetic construct
  REGION 1..6: note = Synthetic Construct
GKRQEK

SEQ ID NO: 14540 - protein, 6 aa, synthetic construct
  REGION 1..6: note = Synthetic Construct
GKRQFK

SEQ ID NO: 14541 - protein, 6 aa, synthetic construct
  REGION 1..6: note = Synthetic Construct
GKRQGK

SEQ ID NO: 14542 - protein, 6 aa, synthetic construct
  REGION 1..6: note = Synthetic Construct
GKRQHK

SEQ ID NO: 14543 - protein, 6 aa, synthetic construct
  REGION 1..6: note = Synthetic Construct
GKRQIK

SEQ ID NO: 14544 - protein, 6 aa, synthetic construct
  REGION 1..6: note = Synthetic Construct
GKRQLK

SEQ ID NO: 14545 - protein, 6 aa, synthetic construct
  REGION 1..6: note = Synthetic Construct
GKRQNK

SEQ ID NO: 14546 - protein, 6 aa, synthetic construct
  REGION 1..6: note = Synthetic Construct
GKRQQK

SEQ ID NO: 14547 - protein, 6 aa, synthetic construct
  REGION 1..6: note = Synthetic Construct
GKRQRK

SEQ ID NO: 14548 - protein, 6 aa, synthetic construct
  REGION 1..6: note = Synthetic Construct
GKRQSK

SEQ ID NO: 14549 - protein, 6 aa, synthetic construct
  REGION 1..6: note = Synthetic Construct
GKRQTK

SEQ ID NO: 14550 - protein, 6 aa, synthetic construct
  REGION 1..6: note = Synthetic Construct
GKRQYK

SEQ ID NO: 14551 - protein, 6 aa, synthetic construct
  REGION 1..6: note = Synthetic Construct
GKRRAK

SEQ ID NO: 14552 - protein, 6 aa, synthetic construct
  REGION 1..6: note = Synthetic Construct
GKRRDK

SEQ ID NO: 14553 - protein, 6 aa, synthetic construct
  REGION 1..6: note = Synthetic Construct
GKRREK

SEQ ID NO: 14554 - protein, 6 aa, synthetic construct
  REGION 1..6: note = Synthetic Construct
GKRRFK

SEQ ID NO: 14555 - protein, 6 aa, synthetic construct
  REGION 1..6: note = Synthetic Construct
GKRRGK

SEQ ID NO: 14556 - protein, 6 aa, synthetic construct
  REGION 1..6: note = Synthetic Construct
GKRRHK

SEQ ID NO: 14557 - protein, 6 aa, synthetic construct
  REGION 1..6: note = Synthetic Construct
GKRRIK

SEQ ID NO: 14558 - protein, 6 aa, synthetic construct
  REGION 1..6: note = Synthetic Construct
GKRRLK

SEQ ID NO: 14559 - protein, 6 aa, synthetic construct
  REGION 1..6: note = Synthetic Construct
GKRRNK

SEQ ID NO: 14560 - protein, 6 aa, synthetic construct
  REGION 1..6: note = Synthetic Construct
GKRRQK

SEQ ID NO: 14561 - protein, 6 aa, synthetic construct
  REGION 1..6: note = Synthetic Construct
GKRRRK

SEQ ID NO: 14562 - protein, 6 aa, synthetic construct
  REGION 1..6: note = Synthetic Construct
GKRRSK

SEQ ID NO: 14563 - protein, 6 aa, synthetic construct
  REGION 1..6: note = Synthetic Construct
GKRRTK

SEQ ID NO: 14564 - protein, 6 aa, synthetic construct
  REGION 1..6: note = Synthetic Construct
GKRRYK

SEQ ID NO: 14565 - protein, 6 aa, synthetic construct
  REGION 1..6: note = Synthetic Construct
GKRSAK

SEQ ID NO: 14566 - protein, 6 aa, synthetic construct
  REGION 1..6: note = Synthetic Construct
GKRSDK

SEQ ID NO: 14567 - protein, 6 aa, synthetic construct
  REGION 1..6: note = Synthetic Construct
GKRSEK

SEQ ID NO: 14568 - protein, 6 aa, synthetic construct
  REGION 1..6: note = Synthetic Construct
GKRSFK

SEQ ID NO: 14569 - protein, 6 aa, synthetic construct
  REGION 1..6: note = Synthetic Construct
GKRSGK

SEQ ID NO: 14570 - protein, 6 aa, synthetic construct
  REGION 1..6: note = Synthetic Construct
GKRSHK

SEQ ID NO: 14571 - protein, 6 aa, synthetic construct
  REGION 1..6: note = Synthetic Construct
GKRSIK

SEQ ID NO: 14572 - protein, 6 aa, synthetic construct
  REGION 1..6: note = Synthetic Construct
GKRSLK

SEQ ID NO: 14573 - protein, 6 aa, synthetic construct
  REGION 1..6: note = Synthetic Construct
GKRSNK

SEQ ID NO: 14574 - protein, 6 aa, synthetic construct
  REGION 1..6: note = Synthetic Construct
GKRSQK

SEQ ID NO: 14575 - protein, 6 aa, synthetic construct
  REGION 1..6: note = Synthetic Construct
GKRSRK

SEQ ID NO: 14576 - protein, 6 aa, synthetic construct
  REGION 1..6: note = Synthetic Construct
GKRSSK

SEQ ID NO: 14577 - protein, 6 aa, synthetic construct
  REGION 1..6: note = Synthetic Construct
GKRSTK

SEQ ID NO: 14578 - protein, 6 aa, synthetic construct
  REGION 1..6: note = Synthetic Construct
GKRSYK

SEQ ID NO: 14579 - protein, 6 aa, synthetic construct
  REGION 1..6: note = Synthetic Construct
GKRTAK

SEQ ID NO: 14580 - protein, 6 aa, synthetic construct
  REGION 1..6: note = Synthetic Construct
GKRTDK

SEQ ID NO: 14581 - protein, 6 aa, synthetic construct
  REGION 1..6: note = Synthetic Construct
GKRTEK

SEQ ID NO: 14582 - protein, 6 aa, synthetic construct
  REGION 1..6: note = Synthetic Construct
GKRTFK

SEQ ID NO: 14583 - protein, 6 aa, synthetic construct
  REGION 1..6: note = Synthetic Construct
GKRTGK

SEQ ID NO: 14584 - protein, 6 aa, synthetic construct
  REGION 1..6: note = Synthetic Construct
GKRTHK

SEQ ID NO: 14585 - protein, 6 aa, synthetic construct
  REGION 1..6: note = Synthetic Construct
GKRTIK

SEQ ID NO: 14586 - protein, 6 aa, synthetic construct
  REGION 1..6: note = Synthetic Construct
GKRTLK

SEQ ID NO: 14587 - protein, 6 aa, synthetic construct
  REGION 1..6: note = Synthetic Construct
GKRTNK

SEQ ID NO: 14588 - protein, 6 aa, synthetic construct
  REGION 1..6: note = Synthetic Construct
GKRTQK

SEQ ID NO: 14589 - protein, 6 aa, synthetic construct
  REGION 1..6: note = Synthetic Construct
GKRTRK

SEQ ID NO: 14590 - protein, 6 aa, synthetic construct
  REGION 1..6: note = Synthetic Construct
GKRTSK

SEQ ID NO: 14591 - protein, 6 aa, synthetic construct
  REGION 1..6: note = Synthetic Construct
GKRTTK

SEQ ID NO: 14592 - protein, 6 aa, synthetic construct
  REGION 1..6: note = Synthetic Construct
GKRTYK

SEQ ID NO: 14593 - protein, 6 aa, synthetic construct
  REGION 1..6: note = Synthetic Construct
GKRYAK

SEQ ID NO: 14594 - protein, 6 aa, synthetic construct
  REGION 1..6: note = Synthetic Construct
GKRYDK

SEQ ID NO: 14595 - protein, 6 aa, synthetic construct
  REGION 1..6: note = Synthetic Construct
GKRYEK

SEQ ID NO: 14596 - protein, 6 aa, synthetic construct
  REGION 1..6: note = Synthetic Construct
GKRYFK

SEQ ID NO: 14597 - protein, 6 aa, synthetic construct
  REGION 1..6: note = Synthetic Construct
GKRYGK

SEQ ID NO: 14598 - protein, 6 aa, synthetic construct
  REGION 1..6: note = Synthetic Construct
GKRYHK

SEQ ID NO: 14599 - protein, 6 aa, synthetic construct
  REGION 1..6: note = Synthetic Construct
GKRYIK

SEQ ID NO: 14600 - protein, 6 aa, synthetic construct
  REGION 1..6: note = Synthetic Construct
GKRYLK

SEQ ID NO: 14601 - protein, 6 aa, synthetic construct
  REGION 1..6: note = Synthetic Construct
GKRYNK

SEQ ID NO: 14602 - protein, 6 aa, synthetic construct
  REGION 1..6: note = Synthetic Construct
GKRYQK

SEQ ID NO: 14603 - protein, 6 aa, synthetic construct
  REGION 1..6: note = Synthetic Construct
GKRYRK

SEQ ID NO: 14604 - protein, 6 aa, synthetic construct
  REGION 1..6: note = Synthetic Construct
GKRYSK

SEQ ID NO: 14605 - protein, 6 aa, synthetic construct
  REGION 1..6: note = Synthetic Construct
GKRYTK

SEQ ID NO: 14606 - protein, 6 aa, synthetic construct
  REGION 1..6: note = Synthetic Construct
GKRYYK

SEQ ID NO: 14607 - protein, 6 aa, synthetic construct
  REGION 1..6: note = Synthetic Construct
GKSAAK

SEQ ID NO: 14608 - protein, 6 aa, synthetic construct
  REGION 1..6: note = Synthetic Construct
GKSADK

SEQ ID NO: 14609 - protein, 6 aa, synthetic construct
  REGION 1..6: note = Synthetic Construct
GKSAEK

SEQ ID NO: 14610 - protein, 6 aa, synthetic construct
  REGION 1..6: note = Synthetic Construct
GKSAFK

SEQ ID NO: 14611 - protein, 6 aa, synthetic construct
  REGION 1..6: note = Synthetic Construct
GKSAGK

SEQ ID NO: 14612 - protein, 6 aa, synthetic construct
  REGION 1..6: note = Synthetic Construct
GKSAHK

SEQ ID NO: 14613 - protein, 6 aa, synthetic construct
  REGION 1..6: note = Synthetic Construct
GKSAIK

SEQ ID NO: 14614 - protein, 6 aa, synthetic construct
  REGION 1..6: note = Synthetic Construct
GKSALK

SEQ ID NO: 14615 - protein, 6 aa, synthetic construct
  REGION 1..6: note = Synthetic Construct
GKSANK

SEQ ID NO: 14616 - protein, 6 aa, synthetic construct
  REGION 1..6: note = Synthetic Construct
GKSAQK

SEQ ID NO: 14617 - protein, 6 aa, synthetic construct
  REGION 1..6: note = Synthetic Construct
GKSARK

SEQ ID NO: 14618 - protein, 6 aa, synthetic construct
  REGION 1..6: note = Synthetic Construct
GKSASK

SEQ ID NO: 14619 - protein, 6 aa, synthetic construct
  REGION 1..6: note = Synthetic Construct
GKSATK

SEQ ID NO: 14620 - protein, 6 aa, synthetic construct
  REGION 1..6: note = Synthetic Construct
GKSAYK

SEQ ID NO: 14621 - protein, 6 aa, synthetic construct
  REGION 1..6: note = Synthetic Construct
GKSDAK

SEQ ID NO: 14622 - protein, 6 aa, synthetic construct
  REGION 1..6: note = Synthetic Construct
GKSDDK

SEQ ID NO: 14623 - protein, 6 aa, synthetic construct
  REGION 1..6: note = Synthetic Construct
GKSDEK

SEQ ID NO: 14624 - protein, 6 aa, synthetic construct
  REGION 1..6: note = Synthetic Construct
GKSDFK

SEQ ID NO: 14625 - protein, 6 aa, synthetic construct
  REGION 1..6: note = Synthetic Construct
GKSDGK

SEQ ID NO: 14626 - protein, 6 aa, synthetic construct
  REGION 1..6: note = Synthetic Construct
GKSDHK

SEQ ID NO: 14627 - protein, 6 aa, synthetic construct
  REGION 1..6: note = Synthetic Construct
GKSDIK

SEQ ID NO: 14628 - protein, 6 aa, synthetic construct
  REGION 1..6: note = Synthetic Construct
GKSDLK

SEQ ID NO: 14629 - protein, 6 aa, synthetic construct
  REGION 1..6: note = Synthetic Construct
GKSDNK

SEQ ID NO: 14630 - protein, 6 aa, synthetic construct
  REGION 1..6: note = Synthetic Construct
GKSDQK

SEQ ID NO: 14631 - protein, 6 aa, synthetic construct
  REGION 1..6: note = Synthetic Construct
GKSDRK

SEQ ID NO: 14632 - protein, 6 aa, synthetic construct
  REGION 1..6: note = Synthetic Construct
GKSDSK

SEQ ID NO: 14633 - protein, 6 aa, synthetic construct
  REGION 1..6: note = Synthetic Construct
GKSDTK

SEQ ID NO: 14634 - protein, 6 aa, synthetic construct
  REGION 1..6: note = Synthetic Construct
GKSDYK

SEQ ID NO: 14635 - protein, 6 aa, synthetic construct
  REGION 1..6: note = Synthetic Construct
GKSEAK

SEQ ID NO: 14636 - protein, 6 aa, synthetic construct
  REGION 1..6: note = Synthetic Construct
GKSEDK

SEQ ID NO: 14637 - protein, 6 aa, synthetic construct
  REGION 1..6: note = Synthetic Construct
GKSEEK

SEQ ID NO: 14638 - protein, 6 aa, synthetic construct
  REGION 1..6: note = Synthetic Construct
GKSEFK

SEQ ID NO: 14639 - protein, 6 aa, synthetic construct
  REGION 1..6: note = Synthetic Construct
GKSEGK

SEQ ID NO: 14640 - protein, 6 aa, synthetic construct
  REGION 1..6: note = Synthetic Construct
GKSEHK

SEQ ID NO: 14641 - protein, 6 aa, synthetic construct
  REGION 1..6: note = Synthetic Construct
GKSEIK

SEQ ID NO: 14642 - protein, 6 aa, synthetic construct
  REGION 1..6: note = Synthetic Construct
GKSELK

SEQ ID NO: 14643 - protein, 6 aa, synthetic construct
  REGION 1..6: note = Synthetic Construct
GKSENK

SEQ ID NO: 14644 - protein, 6 aa, synthetic construct
  REGION 1..6: note = Synthetic Construct
GKSEQK

SEQ ID NO: 14645 - protein, 6 aa, synthetic construct
  REGION 1..6: note = Synthetic Construct
GKSERK

SEQ ID NO: 14646 - protein, 6 aa, synthetic construct
  REGION 1..6: note = Synthetic Construct
GKSESK

SEQ ID NO: 14647 - protein, 6 aa, synthetic construct
  REGION 1..6: note = Synthetic Construct
GKSETK

SEQ ID NO: 14648 - protein, 6 aa, synthetic construct
  REGION 1..6: note = Synthetic Construct
GKSEYK

SEQ ID NO: 14649 - protein, 6 aa, synthetic construct
  REGION 1..6: note = Synthetic Construct
GKSFAK

SEQ ID NO: 14650 - protein, 6 aa, synthetic construct
  REGION 1..6: note = Synthetic Construct
GKSFDK

SEQ ID NO: 14651 - protein, 6 aa, synthetic construct
  REGION 1..6: note = Synthetic Construct
GKSFEK

SEQ ID NO: 14652 - protein, 6 aa, synthetic construct
  REGION 1..6: note = Synthetic Construct
GKSFFK

SEQ ID NO: 14653 - protein, 6 aa, synthetic construct
  REGION 1..6: note = Synthetic Construct
GKSFGK

SEQ ID NO: 14654 - protein, 6 aa, synthetic construct
  REGION 1..6: note = Synthetic Construct
GKSFHK

SEQ ID NO: 14655 - protein, 6 aa, synthetic construct
  REGION 1..6: note = Synthetic Construct
GKSFIK

SEQ ID NO: 14656 - protein, 6 aa, synthetic construct
  REGION 1..6: note = Synthetic Construct
GKSFLK

SEQ ID NO: 14657 - protein, 6 aa, synthetic construct
  REGION 1..6: note = Synthetic Construct
GKSFNK

SEQ ID NO: 14658 - protein, 6 aa, synthetic construct
  REGION 1..6: note = Synthetic Construct
GKSFQK

SEQ ID NO: 14659 - protein, 6 aa, synthetic construct
  REGION 1..6: note = Synthetic Construct
GKSFRK

SEQ ID NO: 14660 - protein, 6 aa, synthetic construct
  REGION 1..6: note = Synthetic Construct
GKSFSK

SEQ ID NO: 14661 - protein, 6 aa, synthetic construct
  REGION 1..6: note = Synthetic Construct
GKSFTK

SEQ ID NO: 14662 - protein, 6 aa, synthetic construct
  REGION 1..6: note = Synthetic Construct
GKSFYK

SEQ ID NO: 14663 - protein, 6 aa, synthetic construct
  REGION 1..6: note = Synthetic Construct
GKSGAK

SEQ ID NO: 14664 - protein, 6 aa, synthetic construct
  REGION 1..6: note = Synthetic Construct
GKSGDK

SEQ ID NO: 14665 - protein, 6 aa, synthetic construct
  REGION 1..6: note = Synthetic Construct
GKSGEK

SEQ ID NO: 14666 - protein, 6 aa, synthetic construct
  REGION 1..6: note = Synthetic Construct
GKSGFK

SEQ ID NO: 14667 - protein, 6 aa, synthetic construct
  REGION 1..6: note = Synthetic Construct
GKSGGK

SEQ ID NO: 14668 - protein, 6 aa, synthetic construct
  REGION 1..6: note = Synthetic Construct
GKSGHK

SEQ ID NO: 14669 - protein, 6 aa, synthetic construct
  REGION 1..6: note = Synthetic Construct
GKSGIK

SEQ ID NO: 14670 - protein, 6 aa, synthetic construct
  REGION 1..6: note = Synthetic Construct
GKSGLK

SEQ ID NO: 14671 - protein, 6 aa, synthetic construct
  REGION 1..6: note = Synthetic Construct
GKSGNK

SEQ ID NO: 14672 - protein, 6 aa, synthetic construct
  REGION 1..6: note = Synthetic Construct
GKSGQK

SEQ ID NO: 14673 - protein, 6 aa, synthetic construct
  REGION 1..6: note = Synthetic Construct
GKSGRK

SEQ ID NO: 14674 - protein, 6 aa, synthetic construct
  REGION 1..6: note = Synthetic Construct
GKSGSK

SEQ ID NO: 14675 - protein, 6 aa, synthetic construct
  REGION 1..6: note = Synthetic Construct
GKSGTK

SEQ ID NO: 14676 - protein, 6 aa, synthetic construct
  REGION 1..6: note = Synthetic Construct
GKSGYK

SEQ ID NO: 14677 - protein, 6 aa, synthetic construct
  REGION 1..6: note = Synthetic Construct
GKSHAK

SEQ ID NO: 14678 - protein, 6 aa, synthetic construct
  REGION 1..6: note = Synthetic Construct
GKSHDK

SEQ ID NO: 14679 - protein, 6 aa, synthetic construct
  REGION 1..6: note = Synthetic Construct
GKSHEK

SEQ ID NO: 14680 - protein, 6 aa, synthetic construct
  REGION 1..6: note = Synthetic Construct
GKSHFK

SEQ ID NO: 14681 - protein, 6 aa, synthetic construct
  REGION 1..6: note = Synthetic Construct
GKSHGK

SEQ ID NO: 14682 - protein, 6 aa, synthetic construct
  REGION 1..6: note = Synthetic Construct
GKSHHK

SEQ ID NO: 14683 - protein, 6 aa, synthetic construct
  REGION 1..6: note = Synthetic Construct
GKSHIK

SEQ ID NO: 14684 - protein, 6 aa, synthetic construct
  REGION 1..6: note = Synthetic Construct
GKSHLK

SEQ ID NO: 14685 - protein, 6 aa, synthetic construct
  REGION 1..6: note = Synthetic Construct
GKSHNK

SEQ ID NO: 14686 - protein, 6 aa, synthetic construct
  REGION 1..6: note = Synthetic Construct
GKSHQK

SEQ ID NO: 14687 - protein, 6 aa, synthetic construct
  REGION 1..6: note = Synthetic Construct
GKSHRK

SEQ ID NO: 14688 - protein, 6 aa, synthetic construct
  REGION 1..6: note = Synthetic Construct
GKSHSK

SEQ ID NO: 14689 - protein, 6 aa, synthetic construct
  REGION 1..6: note = Synthetic Construct
GKSHTK

SEQ ID NO: 14690 - protein, 6 aa, synthetic construct
  REGION 1..6: note = Synthetic Construct
GKSHYK

SEQ ID NO: 14691 - protein, 6 aa, synthetic construct
  REGION 1..6: note = Synthetic Construct
GKSIAK

SEQ ID NO: 14692 - protein, 6 aa, synthetic construct
  REGION 1..6: note = Synthetic Construct
GKSIDK

SEQ ID NO: 14693 - protein, 6 aa, synthetic construct
  REGION 1..6: note = Synthetic Construct
GKSIEK

SEQ ID NO: 14694 - protein, 6 aa, synthetic construct
  REGION 1..6: note = Synthetic Construct
GKSIFK

SEQ ID NO: 14695 - protein, 6 aa, synthetic construct
  REGION 1..6: note = Synthetic Construct
GKSIGK

SEQ ID NO: 14696 - protein, 6 aa, synthetic construct
  REGION 1..6: note = Synthetic Construct
GKSIHK

SEQ ID NO: 14697 - protein, 6 aa, synthetic construct
  REGION 1..6: note = Synthetic Construct
GKSIIK

SEQ ID NO: 14698 - protein, 6 aa, synthetic construct
  REGION 1..6: note = Synthetic Construct
GKSILK

SEQ ID NO: 14699 - protein, 6 aa, synthetic construct
  REGION 1..6: note = Synthetic Construct
GKSINK

SEQ ID NO: 14700 - protein, 6 aa, synthetic construct
  REGION 1..6: note = Synthetic Construct
GKSIQK

SEQ ID NO: 14701 - protein, 6 aa, synthetic construct
  REGION 1..6: note = Synthetic Construct
GKSIRK

SEQ ID NO: 14702 - protein, 6 aa, synthetic construct
  REGION 1..6: note = Synthetic Construct
GKSISK

SEQ ID NO: 14703 - protein, 6 aa, synthetic construct
  REGION 1..6: note = Synthetic Construct
GKSITK

SEQ ID NO: 14704 - protein, 6 aa, synthetic construct
  REGION 1..6: note = Synthetic Construct
GKSIYK

SEQ ID NO: 14705 - protein, 6 aa, synthetic construct
  REGION 1..6: note = Synthetic Construct
GKSLAK

SEQ ID NO: 14706 - protein, 6 aa, synthetic construct
  REGION 1..6: note = Synthetic Construct
GKSLDK

SEQ ID NO: 14707 - protein, 6 aa, synthetic construct
  REGION 1..6: note = Synthetic Construct
GKSLEK

SEQ ID NO: 14708 - protein, 6 aa, synthetic construct
  REGION 1..6: note = Synthetic Construct
GKSLFK

SEQ ID NO: 14709 - protein, 6 aa, synthetic construct
  REGION 1..6: note = Synthetic Construct
GKSLGK

SEQ ID NO: 14710 - protein, 6 aa, synthetic construct
  REGION 1..6: note = Synthetic Construct
GKSLHK

SEQ ID NO: 14711 - protein, 6 aa, synthetic construct
  REGION 1..6: note = Synthetic Construct
GKSLIK

SEQ ID NO: 14712 - protein, 6 aa, synthetic construct
  REGION 1..6: note = Synthetic Construct
GKSLLK

SEQ ID NO: 14713 - protein, 6 aa, synthetic construct
  REGION 1..6: note = Synthetic Construct
GKSLNK

SEQ ID NO: 14714 - protein, 6 aa, synthetic construct
  REGION 1..6: note = Synthetic Construct
GKSLQK

SEQ ID NO: 14715 - protein, 6 aa, synthetic construct
  REGION 1..6: note = Synthetic Construct
GKSLRK

SEQ ID NO: 14716 - protein, 6 aa, synthetic construct
  REGION 1..6: note = Synthetic Construct
GKSLSK

SEQ ID NO: 14717 - protein, 6 aa, synthetic construct
  REGION 1..6: note = Synthetic Construct
GKSLTK

SEQ ID NO: 14718 - protein, 6 aa, synthetic construct
  REGION 1..6: note = Synthetic Construct
GKSLYK

SEQ ID NO: 14719 - protein, 6 aa, synthetic construct
  REGION 1..6: note = Synthetic Construct
GKSNAK

SEQ ID NO: 14720 - protein, 6 aa, synthetic construct
  REGION 1..6: note = Synthetic Construct
GKSNDK

SEQ ID NO: 14721 - protein, 6 aa, synthetic construct
  REGION 1..6: note = Synthetic Construct
GKSNEK

SEQ ID NO: 14722 - protein, 6 aa, synthetic construct
  REGION 1..6: note = Synthetic Construct
GKSNFK

SEQ ID NO: 14723 - protein, 6 aa, synthetic construct
  REGION 1..6: note = Synthetic Construct
GKSNGK

SEQ ID NO: 14724 - protein, 6 aa, synthetic construct
  REGION 1..6: note = Synthetic Construct
GKSNHK

SEQ ID NO: 14725 - protein, 6 aa, synthetic construct
  REGION 1..6: note = Synthetic Construct
GKSNIK

SEQ ID NO: 14726 - protein, 6 aa, synthetic construct
  REGION 1..6: note = Synthetic Construct
GKSNLK

SEQ ID NO: 14727 - protein, 6 aa, synthetic construct
  REGION 1..6: note = Synthetic Construct
GKSNNK

SEQ ID NO: 14728 - protein, 6 aa, synthetic construct
  REGION 1..6: note = Synthetic Construct
GKSNQK

SEQ ID NO: 14729 - protein, 6 aa, synthetic construct
  REGION 1..6: note = Synthetic Construct
GKSNRK

SEQ ID NO: 14730 - protein, 6 aa, synthetic construct
  REGION 1..6: note = Synthetic Construct
GKSNSK

SEQ ID NO: 14731 - protein, 6 aa, synthetic construct
  REGION 1..6: note = Synthetic Construct
GKSNTK

SEQ ID NO: 14732 - protein, 6 aa, synthetic construct
  REGION 1..6: note = Synthetic Construct
GKSNYK

SEQ ID NO: 14733 - protein, 6 aa, synthetic construct
  REGION 1..6: note = Synthetic Construct
GKSQAK

SEQ ID NO: 14734 - protein, 6 aa, synthetic construct
  REGION 1..6: note = Synthetic Construct
GKSQDK

SEQ ID NO: 14735 - protein, 6 aa, synthetic construct
  REGION 1..6: note = Synthetic Construct
GKSQEK

SEQ ID NO: 14736 - protein, 6 aa, synthetic construct
  REGION 1..6: note = Synthetic Construct
GKSQFK

SEQ ID NO: 14737 - protein, 6 aa, synthetic construct
  REGION 1..6: note = Synthetic Construct
GKSQGK

SEQ ID NO: 14738 - protein, 6 aa, synthetic construct
  REGION 1..6: note = Synthetic Construct
GKSQHK

SEQ ID NO: 14739 - protein, 6 aa, synthetic construct
  REGION 1..6: note = Synthetic Construct
GKSQIK

SEQ ID NO: 14740 - protein, 6 aa, synthetic construct
  REGION 1..6: note = Synthetic Construct
GKSQLK

SEQ ID NO: 14741 - protein, 6 aa, synthetic construct
  REGION 1..6: note = Synthetic Construct
GKSQNK

SEQ ID NO: 14742 - protein, 6 aa, synthetic construct
  REGION 1..6: note = Synthetic Construct
GKSQQK

SEQ ID NO: 14743 - protein, 6 aa, synthetic construct
  REGION 1..6: note = Synthetic Construct
GKSQRK

SEQ ID NO: 14744 - protein, 6 aa, synthetic construct
  REGION 1..6: note = Synthetic Construct
GKSQSK

SEQ ID NO: 14745 - protein, 6 aa, synthetic construct
  REGION 1..6: note = Synthetic Construct
GKSQTK

SEQ ID NO: 14746 - protein, 6 aa, synthetic construct
  REGION 1..6: note = Synthetic Construct
GKSQYK

SEQ ID NO: 14747 - protein, 6 aa, synthetic construct
  REGION 1..6: note = Synthetic Construct
GKSRAK

SEQ ID NO: 14748 - protein, 6 aa, synthetic construct
  REGION 1..6: note = Synthetic Construct
GKSRDK

SEQ ID NO: 14749 - protein, 6 aa, synthetic construct
  REGION 1..6: note = Synthetic Construct
GKSREK

SEQ ID NO: 14750 - protein, 6 aa, synthetic construct
  REGION 1..6: note = Synthetic Construct
GKSRFK

SEQ ID NO: 14751 - protein, 6 aa, synthetic construct
  REGION 1..6: note = Synthetic Construct
GKSRGK

SEQ ID NO: 14752 - protein, 6 aa, synthetic construct
  REGION 1..6: note = Synthetic Construct
GKSRHK

SEQ ID NO: 14753 - protein, 6 aa, synthetic construct
  REGION 1..6: note = Synthetic Construct
GKSRIK

SEQ ID NO: 14754 - protein, 6 aa, synthetic construct
  REGION 1..6: note = Synthetic Construct
GKSRLK

SEQ ID NO: 14755 - protein, 6 aa, synthetic construct
  REGION 1..6: note = Synthetic Construct
GKSRNK

SEQ ID NO: 14756 - protein, 6 aa, synthetic construct
  REGION 1..6: note = Synthetic Construct
GKSRQK

SEQ ID NO: 14757 - protein, 6 aa, synthetic construct
  REGION 1..6: note = Synthetic Construct
GKSRRK

SEQ ID NO: 14758 - protein, 6 aa, synthetic construct
  REGION 1..6: note = Synthetic Construct
GKSRSK

SEQ ID NO: 14759 - protein, 6 aa, synthetic construct
  REGION 1..6: note = Synthetic Construct
GKSRTK

SEQ ID NO: 14760 - protein, 6 aa, synthetic construct
  REGION 1..6: note = Synthetic Construct
GKSRYK

SEQ ID NO: 14761 - protein, 6 aa, synthetic construct
  REGION 1..6: note = Synthetic Construct
GKSSAK

SEQ ID NO: 14762 - protein, 6 aa, synthetic construct
  REGION 1..6: note = Synthetic Construct
GKSSDK

SEQ ID NO: 14763 - protein, 6 aa, synthetic construct
  REGION 1..6: note = Synthetic Construct
GKSSEK

SEQ ID NO: 14764 - protein, 6 aa, synthetic construct
  REGION 1..6: note = Synthetic Construct
GKSSFK

SEQ ID NO: 14765 - protein, 6 aa, synthetic construct
  REGION 1..6: note = Synthetic Construct
GKSSGK

SEQ ID NO: 14766 - protein, 6 aa, synthetic construct
  REGION 1..6: note = Synthetic Construct
GKSSHK

SEQ ID NO: 14767 - protein, 6 aa, synthetic construct
  REGION 1..6: note = Synthetic Construct
GKSSIK

SEQ ID NO: 14768 - protein, 6 aa, synthetic construct
  REGION 1..6: note = Synthetic Construct
GKSSLK

SEQ ID NO: 14769 - protein, 6 aa, synthetic construct
  REGION 1..6: note = Synthetic Construct
GKSSNK

SEQ ID NO: 14770 - protein, 6 aa, synthetic construct
  REGION 1..6: note = Synthetic Construct
GKSSQK

SEQ ID NO: 14771 - protein, 6 aa, synthetic construct
  REGION 1..6: note = Synthetic Construct
GKSSRK

SEQ ID NO: 14772 - protein, 6 aa, synthetic construct
  REGION 1..6: note = Synthetic Construct
GKSSSK

SEQ ID NO: 14773 - protein, 6 aa, synthetic construct
  REGION 1..6: note = Synthetic Construct
GKSSTK

SEQ ID NO: 14774 - protein, 6 aa, synthetic construct
  REGION 1..6: note = Synthetic Construct
GKSSYK

SEQ ID NO: 14775 - protein, 6 aa, synthetic construct
  REGION 1..6: note = Synthetic Construct
GKSTAK

SEQ ID NO: 14776 - protein, 6 aa, synthetic construct
  REGION 1..6: note = Synthetic Construct
GKSTDK

SEQ ID NO: 14777 - protein, 6 aa, synthetic construct
  REGION 1..6: note = Synthetic Construct
GKSTEK

SEQ ID NO: 14778 - protein, 6 aa, synthetic construct
  REGION 1..6: note = Synthetic Construct
GKSTFK

SEQ ID NO: 14779 - protein, 6 aa, synthetic construct
  REGION 1..6: note = Synthetic Construct
GKSTGK

SEQ ID NO: 14780 - protein, 6 aa, synthetic construct
  REGION 1..6: note = Synthetic Construct
GKSTHK

SEQ ID NO: 14781 - protein, 6 aa, synthetic construct
  REGION 1..6: note = Synthetic Construct
GKSTIK

SEQ ID NO: 14782 - protein, 6 aa, synthetic construct
  REGION 1..6: note = Synthetic Construct
GKSTLK

SEQ ID NO: 14783 - protein, 6 aa, synthetic construct
  REGION 1..6: note = Synthetic Construct
GKSTNK

SEQ ID NO: 14784 - protein, 6 aa, synthetic construct
  REGION 1..6: note = Synthetic Construct
GKSTQK

SEQ ID NO: 14785 - protein, 6 aa, synthetic construct
  REGION 1..6: note = Synthetic Construct
GKSTRK

SEQ ID NO: 14786 - protein, 6 aa, synthetic construct
  REGION 1..6: note = Synthetic Construct
GKSTSK

SEQ ID NO: 14787 - protein, 6 aa, synthetic construct
  REGION 1..6: note = Synthetic Construct
GKSTTK

SEQ ID NO: 14788 - protein, 6 aa, synthetic construct
  REGION 1..6: note = Synthetic Construct
GKSTYK

SEQ ID NO: 14789 - protein, 6 aa, synthetic construct
  REGION 1..6: note = Synthetic Construct
GKSYAK

SEQ ID NO: 14790 - protein, 6 aa, synthetic construct
  REGION 1..6: note = Synthetic Construct
GKSYDK

SEQ ID NO: 14791 - protein, 6 aa, synthetic construct
  REGION 1..6: note = Synthetic Construct
GKSYEK

SEQ ID NO: 14792 - protein, 6 aa, synthetic construct
  REGION 1..6: note = Synthetic Construct
GKSYFK

SEQ ID NO: 14793 - protein, 6 aa, synthetic construct
  REGION 1..6: note = Synthetic Construct
GKSYGK

SEQ ID NO: 14794 - protein, 6 aa, synthetic construct
  REGION 1..6: note = Synthetic Construct
GKSYHK

SEQ ID NO: 14795 - protein, 6 aa, synthetic construct
  REGION 1..6: note = Synthetic Construct
GKSYIK

SEQ ID NO: 14796 - protein, 6 aa, synthetic construct
  REGION 1..6: note = Synthetic Construct
GKSYLK

SEQ ID NO: 14797 - protein, 6 aa, synthetic construct
  REGION 1..6: note = Synthetic Construct
GKSYNK

SEQ ID NO: 14798 - protein, 6 aa, synthetic construct
  REGION 1..6: note = Synthetic Construct
GKSYQK

SEQ ID NO: 14799 - protein, 6 aa, synthetic construct
  REGION 1..6: note = Synthetic Construct
GKSYRK

SEQ ID NO: 14800 - protein, 6 aa, synthetic construct
  REGION 1..6: note = Synthetic Construct
GKSYSK

SEQ ID NO: 14801 - protein, 6 aa, synthetic construct
  REGION 1..6: note = Synthetic Construct
GKSYTK

SEQ ID NO: 14802 - protein, 6 aa, synthetic construct
  REGION 1..6: note = Synthetic Construct
GKSYYK

SEQ ID NO: 14803 - protein, 6 aa, synthetic construct
  REGION 1..6: note = Synthetic Construct
GKTAAK

SEQ ID NO: 14804 - protein, 6 aa, synthetic construct
  REGION 1..6: note = Synthetic Construct
GKTADK

SEQ ID NO: 14805 - protein, 6 aa, synthetic construct
  REGION 1..6: note = Synthetic Construct
GKTAEK

SEQ ID NO: 14806 - protein, 6 aa, synthetic construct
  REGION 1..6: note = Synthetic Construct
GKTAFK

SEQ ID NO: 14807 - protein, 6 aa, synthetic construct
  REGION 1..6: note = Synthetic Construct
GKTAGK

SEQ ID NO: 14808 - protein, 6 aa, synthetic construct
  REGION 1..6: note = Synthetic Construct
GKTAHK

SEQ ID NO: 14809 - protein, 6 aa, synthetic construct
  REGION 1..6: note = Synthetic Construct
GKTAIK

SEQ ID NO: 14810 - protein, 6 aa, synthetic construct
  REGION 1..6: note = Synthetic Construct
GKTALK

SEQ ID NO: 14811 - protein, 6 aa, synthetic construct
  REGION 1..6: note = Synthetic Construct
GKTANK

SEQ ID NO: 14812 - protein, 6 aa, synthetic construct
  REGION 1..6: note = Synthetic Construct
GKTAQK

SEQ ID NO: 14813 - protein, 6 aa, synthetic construct
  REGION 1..6: note = Synthetic Construct
GKTARK

SEQ ID NO: 14814 - protein, 6 aa, synthetic construct
  REGION 1..6: note = Synthetic Construct
GKTASK

SEQ ID NO: 14815 - protein, 6 aa, synthetic construct
  REGION 1..6: note = Synthetic Construct
GKTATK

SEQ ID NO: 14816 - protein, 6 aa, synthetic construct
  REGION 1..6: note = Synthetic Construct
GKTAYK

SEQ ID NO: 14817 - protein, 6 aa, synthetic construct
  REGION 1..6: note = Synthetic Construct
GKTDAK

SEQ ID NO: 14818 - protein, 6 aa, synthetic construct
  REGION 1..6: note = Synthetic Construct
GKTDDK

SEQ ID NO: 14819 - protein, 6 aa, synthetic construct
  REGION 1..6: note = Synthetic Construct
GKTDEK

SEQ ID NO: 14820 - protein, 6 aa, synthetic construct
  REGION 1..6: note = Synthetic Construct
GKTDFK

SEQ ID NO: 14821 - protein, 6 aa, synthetic construct
  REGION 1..6: note = Synthetic Construct
GKTDGK

SEQ ID NO: 14822 - protein, 6 aa, synthetic construct
  REGION 1..6: note = Synthetic Construct
GKTDHK

SEQ ID NO: 14823 - protein, 6 aa, synthetic construct
  REGION 1..6: note = Synthetic Construct
GKTDIK

SEQ ID NO: 14824 - protein, 6 aa, synthetic construct
  REGION 1..6: note = Synthetic Construct
GKTDLK

SEQ ID NO: 14825 - protein, 6 aa, synthetic construct
  REGION 1..6: note = Synthetic Construct
GKTDNK

SEQ ID NO: 14826 - protein, 6 aa, synthetic construct
  REGION 1..6: note = Synthetic Construct
GKTDQK

SEQ ID NO: 14827 - protein, 6 aa, synthetic construct
  REGION 1..6: note = Synthetic Construct
GKTDRK

SEQ ID NO: 14828 - protein, 6 aa, synthetic construct
  REGION 1..6: note = Synthetic Construct
GKTDSK

SEQ ID NO: 14829 - protein, 6 aa, synthetic construct
  REGION 1..6: note = Synthetic Construct
GKTDTK

SEQ ID NO: 14830 - protein, 6 aa, synthetic construct
  REGION 1..6: note = Synthetic Construct
GKTDYK

SEQ ID NO: 14831 - protein, 6 aa, synthetic construct
  REGION 1..6: note = Synthetic Construct
GKTEAK

SEQ ID NO: 14832 - protein, 6 aa, synthetic construct
  REGION 1..6: note = Synthetic Construct
GKTEDK

SEQ ID NO: 14833 - protein, 6 aa, synthetic construct
  REGION 1..6: note = Synthetic Construct
GKTEEK

SEQ ID NO: 14834 - protein, 6 aa, synthetic construct
  REGION 1..6: note = Synthetic Construct
GKTEFK

SEQ ID NO: 14835 - protein, 6 aa, synthetic construct
  REGION 1..6: note = Synthetic Construct
GKTEGK

SEQ ID NO: 14836 - protein, 6 aa, synthetic construct
  REGION 1..6: note = Synthetic Construct
GKTEHK

SEQ ID NO: 14837 - protein, 6 aa, synthetic construct
  REGION 1..6: note = Synthetic Construct
GKTEIK

SEQ ID NO: 14838 - protein, 6 aa, synthetic construct
  REGION 1..6: note = Synthetic Construct
GKTELK

SEQ ID NO: 14839 - protein, 6 aa, synthetic construct
  REGION 1..6: note = Synthetic Construct
GKTENK

SEQ ID NO: 14840 - protein, 6 aa, synthetic construct
  REGION 1..6: note = Synthetic Construct
GKTEQK

SEQ ID NO: 14841 - protein, 6 aa, synthetic construct
  REGION 1..6: note = Synthetic Construct
GKTERK

SEQ ID NO: 14842 - protein, 6 aa, synthetic construct
  REGION 1..6: note = Synthetic Construct
GKTESK

SEQ ID NO: 14843 - protein, 6 aa, synthetic construct
  REGION 1..6: note = Synthetic Construct
GKTETK

SEQ ID NO: 14844 - protein, 6 aa, synthetic construct
  REGION 1..6: note = Synthetic Construct
GKTEYK

SEQ ID NO: 14845 - protein, 6 aa, synthetic construct
  REGION 1..6: note = Synthetic Construct
GKTFAK

SEQ ID NO: 14846 - protein, 6 aa, synthetic construct
  REGION 1..6: note = Synthetic Construct
GKTFDK

SEQ ID NO: 14847 - protein, 6 aa, synthetic construct
  REGION 1..6: note = Synthetic Construct
GKTFEK

SEQ ID NO: 14848 - protein, 6 aa, synthetic construct
  REGION 1..6: note = Synthetic Construct
GKTFFK

SEQ ID NO: 14849 - protein, 6 aa, synthetic construct
  REGION 1..6: note = Synthetic Construct
GKTFGK

SEQ ID NO: 14850 - protein, 6 aa, synthetic construct
  REGION 1..6: note = Synthetic Construct
GKTFHK

SEQ ID NO: 14851 - protein, 6 aa, synthetic construct
  REGION 1..6: note = Synthetic Construct
GKTFIK

SEQ ID NO: 14852 - protein, 6 aa, synthetic construct
  REGION 1..6: note = Synthetic Construct
GKTFLK

SEQ ID NO: 14853 - protein, 6 aa, synthetic construct
  REGION 1..6: note = Synthetic Construct
GKTFNK

SEQ ID NO: 14854 - protein, 6 aa, synthetic construct
  REGION 1..6: note = Synthetic Construct
GKTFQK

SEQ ID NO: 14855 - protein, 6 aa, synthetic construct
  REGION 1..6: note = Synthetic Construct
GKTFRK

SEQ ID NO: 14856 - protein, 6 aa, synthetic construct
  REGION 1..6: note = Synthetic Construct
GKTFSK

SEQ ID NO: 14857 - protein, 6 aa, synthetic construct
  REGION 1..6: note = Synthetic Construct
GKTFTK

SEQ ID NO: 14858 - protein, 6 aa, synthetic construct
  REGION 1..6: note = Synthetic Construct
GKTFYK

SEQ ID NO: 14859 - protein, 6 aa, synthetic construct
  REGION 1..6: note = Synthetic Construct
GKTGAK

SEQ ID NO: 14860 - protein, 6 aa, synthetic construct
  REGION 1..6: note = Synthetic Construct
GKTGDK

SEQ ID NO: 14861 - protein, 6 aa, synthetic construct
  REGION 1..6: note = Synthetic Construct
GKTGEK

SEQ ID NO: 14862 - protein, 6 aa, synthetic construct
  REGION 1..6: note = Synthetic Construct
GKTGFK

SEQ ID NO: 14863 - protein, 6 aa, synthetic construct
  REGION 1..6: note = Synthetic Construct
GKTGGK

SEQ ID NO: 14864 - protein, 6 aa, synthetic construct
  REGION 1..6: note = Synthetic Construct
GKTGHK

SEQ ID NO: 14865 - protein, 6 aa, synthetic construct
  REGION 1..6: note = Synthetic Construct
GKTGIK

SEQ ID NO: 14866 - protein, 6 aa, synthetic construct
  REGION 1..6: note = Synthetic Construct
GKTGLK

SEQ ID NO: 14867 - protein, 6 aa, synthetic construct
  REGION 1..6: note = Synthetic Construct
GKTGNK

SEQ ID NO: 14868 - protein, 6 aa, synthetic construct
  REGION 1..6: note = Synthetic Construct
GKTGQK

SEQ ID NO: 14869 - protein, 6 aa, synthetic construct
  REGION 1..6: note = Synthetic Construct
GKTGRK

SEQ ID NO: 14870 - protein, 6 aa, synthetic construct
  REGION 1..6: note = Synthetic Construct
GKTGSK

SEQ ID NO: 14871 - protein, 6 aa, synthetic construct
  REGION 1..6: note = Synthetic Construct
GKTGTK

SEQ ID NO: 14872 - protein, 6 aa, synthetic construct
  REGION 1..6: note = Synthetic Construct
GKTGYK

SEQ ID NO: 14873 - protein, 6 aa, synthetic construct
  REGION 1..6: note = Synthetic Construct
GKTHAK

SEQ ID NO: 14874 - protein, 6 aa, synthetic construct
  REGION 1..6: note = Synthetic Construct
GKTHDK

SEQ ID NO: 14875 - protein, 6 aa, synthetic construct
  REGION 1..6: note = Synthetic Construct
GKTHEK

SEQ ID NO: 14876 - protein, 6 aa, synthetic construct
  REGION 1..6: note = Synthetic Construct
GKTHFK

SEQ ID NO: 14877 - protein, 6 aa, synthetic construct
  REGION 1..6: note = Synthetic Construct
GKTHGK

SEQ ID NO: 14878 - protein, 6 aa, synthetic construct
  REGION 1..6: note = Synthetic Construct
GKTHHK

SEQ ID NO: 14879 - protein, 6 aa, synthetic construct
  REGION 1..6: note = Synthetic Construct
GKTHIK

SEQ ID NO: 14880 - protein, 6 aa, synthetic construct
  REGION 1..6: note = Synthetic Construct
GKTHLK

SEQ ID NO: 14881 - protein, 6 aa, synthetic construct
  REGION 1..6: note = Synthetic Construct
GKTHNK

SEQ ID NO: 14882 - protein, 6 aa, synthetic construct
  REGION 1..6: note = Synthetic Construct
GKTHQK

SEQ ID NO: 14883 - protein, 6 aa, synthetic construct
  REGION 1..6: note = Synthetic Construct
GKTHRK

SEQ ID NO: 14884 - protein, 6 aa, synthetic construct
  REGION 1..6: note = Synthetic Construct
GKTHSK

SEQ ID NO: 14885 - protein, 6 aa, synthetic construct
  REGION 1..6: note = Synthetic Construct
GKTHTK

SEQ ID NO: 14886 - protein, 6 aa, synthetic construct
  REGION 1..6: note = Synthetic Construct
GKTHYK

SEQ ID NO: 14887 - protein, 6 aa, synthetic construct
  REGION 1..6: note = Synthetic Construct
GKTIAK

SEQ ID NO: 14888 - protein, 6 aa, synthetic construct
  REGION 1..6: note = Synthetic Construct
GKTIDK

SEQ ID NO: 14889 - protein, 6 aa, synthetic construct
  REGION 1..6: note = Synthetic Construct
GKTIEK

SEQ ID NO: 14890 - protein, 6 aa, synthetic construct
  REGION 1..6: note = Synthetic Construct
GKTIFK

SEQ ID NO: 14891 - protein, 6 aa, synthetic construct
  REGION 1..6: note = Synthetic Construct
GKTIGK

SEQ ID NO: 14892 - protein, 6 aa, synthetic construct
  REGION 1..6: note = Synthetic Construct
GKTIHK

SEQ ID NO: 14893 - protein, 6 aa, synthetic construct
  REGION 1..6: note = Synthetic Construct
GKTIIK

SEQ ID NO: 14894 - protein, 6 aa, synthetic construct
  REGION 1..6: note = Synthetic Construct
GKTILK

SEQ ID NO: 14895 - protein, 6 aa, synthetic construct
  REGION 1..6: note = Synthetic Construct
GKTINK

SEQ ID NO: 14896 - protein, 6 aa, synthetic construct
  REGION 1..6: note = Synthetic Construct
GKTIQK

SEQ ID NO: 14897 - protein, 6 aa, synthetic construct
  REGION 1..6: note = Synthetic Construct
GKTIRK

SEQ ID NO: 14898 - protein, 6 aa, synthetic construct
  REGION 1..6: note = Synthetic Construct
GKTISK

SEQ ID NO: 14899 - protein, 6 aa, synthetic construct
  REGION 1..6: note = Synthetic Construct
GKTITK

SEQ ID NO: 14900 - protein, 6 aa, synthetic construct
  REGION 1..6: note = Synthetic Construct
GKTIYK

SEQ ID NO: 14901 - protein, 6 aa, synthetic construct
  REGION 1..6: note = Synthetic Construct
GKTLAK

SEQ ID NO: 14902 - protein, 6 aa, synthetic construct
  REGION 1..6: note = Synthetic Construct
GKTLDK

SEQ ID NO: 14903 - protein, 6 aa, synthetic construct
  REGION 1..6: note = Synthetic Construct
GKTLEK

SEQ ID NO: 14904 - protein, 6 aa, synthetic construct
  REGION 1..6: note = Synthetic Construct
GKTLFK

SEQ ID NO: 14905 - protein, 6 aa, synthetic construct
  REGION 1..6: note = Synthetic Construct
GKTLGK

SEQ ID NO: 14906 - protein, 6 aa, synthetic construct
  REGION 1..6: note = Synthetic Construct
GKTLHK

SEQ ID NO: 14907 - protein, 6 aa, synthetic construct
  REGION 1..6: note = Synthetic Construct
GKTLIK

SEQ ID NO: 14908 - protein, 6 aa, synthetic construct
  REGION 1..6: note = Synthetic Construct
GKTLLK

SEQ ID NO: 14909 - protein, 6 aa, synthetic construct
  REGION 1..6: note = Synthetic Construct
GKTLNK

SEQ ID NO: 14910 - protein, 6 aa, synthetic construct
  REGION 1..6: note = Synthetic Construct
GKTLQK

SEQ ID NO: 14911 - protein, 6 aa, synthetic construct
  REGION 1..6: note = Synthetic Construct
GKTLRK

SEQ ID NO: 14912 - protein, 6 aa, synthetic construct
  REGION 1..6: note = Synthetic Construct
GKTLSK

SEQ ID NO: 14913 - protein, 6 aa, synthetic construct
  REGION 1..6: note = Synthetic Construct
GKTLTK

SEQ ID NO: 14914 - protein, 6 aa, synthetic construct
  REGION 1..6: note = Synthetic Construct
GKTLYK

SEQ ID NO: 14915 - protein, 6 aa, synthetic construct
  REGION 1..6: note = Synthetic Construct
GKTNAK

SEQ ID NO: 14916 - protein, 6 aa, synthetic construct
  REGION 1..6: note = Synthetic Construct
GKTNDK

SEQ ID NO: 14917 - protein, 6 aa, synthetic construct
  REGION 1..6: note = Synthetic Construct
GKTNEK

SEQ ID NO: 14918 - protein, 6 aa, synthetic construct
  REGION 1..6: note = Synthetic Construct
GKTNFK

SEQ ID NO: 14919 - protein, 6 aa, synthetic construct
  REGION 1..6: note = Synthetic Construct
GKTNGK

SEQ ID NO: 14920 - protein, 6 aa, synthetic construct
  REGION 1..6: note = Synthetic Construct
GKTNHK

SEQ ID NO: 14921 - protein, 6 aa, synthetic construct
  REGION 1..6: note = Synthetic Construct
GKTNIK

SEQ ID NO: 14922 - protein, 6 aa, synthetic construct
  REGION 1..6: note = Synthetic Construct
GKTNLK

SEQ ID NO: 14923 - protein, 6 aa, synthetic construct
  REGION 1..6: note = Synthetic Construct
GKTNNK

SEQ ID NO: 14924 - protein, 6 aa, synthetic construct
  REGION 1..6: note = Synthetic Construct
GKTNQK

SEQ ID NO: 14925 - protein, 6 aa, synthetic construct
  REGION 1..6: note = Synthetic Construct
GKTNRK

SEQ ID NO: 14926 - protein, 6 aa, synthetic construct
  REGION 1..6: note = Synthetic Construct
GKTNSK

SEQ ID NO: 14927 - protein, 6 aa, synthetic construct
  REGION 1..6: note = Synthetic Construct
GKTNTK

SEQ ID NO: 14928 - protein, 6 aa, synthetic construct
  REGION 1..6: note = Synthetic Construct
GKTNYK

SEQ ID NO: 14929 - protein, 6 aa, synthetic construct
  REGION 1..6: note = Synthetic Construct
GKTQAK

SEQ ID NO: 14930 - protein, 6 aa, synthetic construct
  REGION 1..6: note = Synthetic Construct
GKTQDK

SEQ ID NO: 14931 - protein, 6 aa, synthetic construct
  REGION 1..6: note = Synthetic Construct
GKTQEK

SEQ ID NO: 14932 - protein, 6 aa, synthetic construct
  REGION 1..6: note = Synthetic Construct
GKTQFK

SEQ ID NO: 14933 - protein, 6 aa, synthetic construct
  REGION 1..6: note = Synthetic Construct
GKTQGK

SEQ ID NO: 14934 - protein, 6 aa, synthetic construct
  REGION 1..6: note = Synthetic Construct
GKTQHK

SEQ ID NO: 14935 - protein, 6 aa, synthetic construct
  REGION 1..6: note = Synthetic Construct
GKTQIK

SEQ ID NO: 14936 - protein, 6 aa, synthetic construct
  REGION 1..6: note = Synthetic Construct
GKTQLK

SEQ ID NO: 14937 - protein, 6 aa, synthetic construct
  REGION 1..6: note = Synthetic Construct
GKTQNK

SEQ ID NO: 14938 - protein, 6 aa, synthetic construct
  REGION 1..6: note = Synthetic Construct
GKTQQK

SEQ ID NO: 14939 - protein, 6 aa, synthetic construct
  REGION 1..6: note = Synthetic Construct
GKTQRK

SEQ ID NO: 14940 - protein, 6 aa, synthetic construct
  REGION 1..6: note = Synthetic Construct
GKTQSK

SEQ ID NO: 14941 - protein, 6 aa, synthetic construct
  REGION 1..6: note = Synthetic Construct
GKTQTK

SEQ ID NO: 14942 - protein, 6 aa, synthetic construct
  REGION 1..6: note = Synthetic Construct
GKTQYK

SEQ ID NO: 14943 - protein, 6 aa, synthetic construct
  REGION 1..6: note = Synthetic Construct
GKTRAK

SEQ ID NO: 14944 - protein, 6 aa, synthetic construct
  REGION 1..6: note = Synthetic Construct
GKTRDK

SEQ ID NO: 14945 - protein, 6 aa, synthetic construct
  REGION 1..6: note = Synthetic Construct
GKTREK

SEQ ID NO: 14946 - protein, 6 aa, synthetic construct
  REGION 1..6: note = Synthetic Construct
GKTRFK

SEQ ID NO: 14947 - protein, 6 aa, synthetic construct
  REGION 1..6: note = Synthetic Construct
GKTRGK

SEQ ID NO: 14948 - protein, 6 aa, synthetic construct
  REGION 1..6: note = Synthetic Construct
GKTRHK

SEQ ID NO: 14949 - protein, 6 aa, synthetic construct
  REGION 1..6: note = Synthetic Construct
GKTRIK

SEQ ID NO: 14950 - protein, 6 aa, synthetic construct
  REGION 1..6: note = Synthetic Construct
GKTRLK

SEQ ID NO: 14951 - protein, 6 aa, synthetic construct
  REGION 1..6: note = Synthetic Construct
GKTRNK

SEQ ID NO: 14952 - protein, 6 aa, synthetic construct
  REGION 1..6: note = Synthetic Construct
GKTRQK

SEQ ID NO: 14953 - protein, 6 aa, synthetic construct
  REGION 1..6: note = Synthetic Construct
GKTRRK

SEQ ID NO: 14954 - protein, 6 aa, synthetic construct
  REGION 1..6: note = Synthetic Construct
GKTRSK

SEQ ID NO: 14955 - protein, 6 aa, synthetic construct
  REGION 1..6: note = Synthetic Construct
GKTRTK

SEQ ID NO: 14956 - protein, 6 aa, synthetic construct
  REGION 1..6: note = Synthetic Construct
GKTRYK

SEQ ID NO: 14957 - protein, 6 aa, synthetic construct
  REGION 1..6: note = Synthetic Construct
GKTSAK

SEQ ID NO: 14958 - protein, 6 aa, synthetic construct
  REGION 1..6: note = Synthetic Construct
GKTSDK

SEQ ID NO: 14959 - protein, 6 aa, synthetic construct
  REGION 1..6: note = Synthetic Construct
GKTSEK

SEQ ID NO: 14960 - protein, 6 aa, synthetic construct
  REGION 1..6: note = Synthetic Construct
GKTSFK

SEQ ID NO: 14961 - protein, 6 aa, synthetic construct
  REGION 1..6: note = Synthetic Construct
GKTSGK

SEQ ID NO: 14962 - protein, 6 aa, synthetic construct
  REGION 1..6: note = Synthetic Construct
GKTSHK

SEQ ID NO: 14963 - protein, 6 aa, synthetic construct
  REGION 1..6: note = Synthetic Construct
GKTSIK

SEQ ID NO: 14964 - protein, 6 aa, synthetic construct
  REGION 1..6: note = Synthetic Construct
GKTSLK

SEQ ID NO: 14965 - protein, 6 aa, synthetic construct
  REGION 1..6: note = Synthetic Construct
GKTSNK

SEQ ID NO: 14966 - protein, 6 aa, synthetic construct
  REGION 1..6: note = Synthetic Construct
GKTSQK

SEQ ID NO: 14967 - protein, 6 aa, synthetic construct
  REGION 1..6: note = Synthetic Construct
GKTSRK

SEQ ID NO: 14968 - protein, 6 aa, synthetic construct
  REGION 1..6: note = Synthetic Construct
GKTSSK

SEQ ID NO: 14969 - protein, 6 aa, synthetic construct
  REGION 1..6: note = Synthetic Construct
GKTSTK

SEQ ID NO: 14970 - protein, 6 aa, synthetic construct
  REGION 1..6: note = Synthetic Construct
GKTSYK

SEQ ID NO: 14971 - protein, 6 aa, synthetic construct
  REGION 1..6: note = Synthetic Construct
GKTTAK

SEQ ID NO: 14972 - protein, 6 aa, synthetic construct
  REGION 1..6: note = Synthetic Construct
GKTTDK

SEQ ID NO: 14973 - protein, 6 aa, synthetic construct
  REGION 1..6: note = Synthetic Construct
GKTTEK

SEQ ID NO: 14974 - protein, 6 aa, synthetic construct
  REGION 1..6: note = Synthetic Construct
GKTTFK

SEQ ID NO: 14975 - protein, 6 aa, synthetic construct
  REGION 1..6: note = Synthetic Construct
GKTTGK

SEQ ID NO: 14976 - protein, 6 aa, synthetic construct
  REGION 1..6: note = Synthetic Construct
GKTTHK

SEQ ID NO: 14977 - protein, 6 aa, synthetic construct
  REGION 1..6: note = Synthetic Construct
GKTTIK

SEQ ID NO: 14978 - protein, 6 aa, synthetic construct
  REGION 1..6: note = Synthetic Construct
GKTTLK

SEQ ID NO: 14979 - protein, 6 aa, synthetic construct
  REGION 1..6: note = Synthetic Construct
GKTTNK

SEQ ID NO: 14980 - protein, 6 aa, synthetic construct
  REGION 1..6: note = Synthetic Construct
GKTTQK

SEQ ID NO: 14981 - protein, 6 aa, synthetic construct
  REGION 1..6: note = Synthetic Construct
GKTTRK

SEQ ID NO: 14982 - protein, 6 aa, synthetic construct
  REGION 1..6: note = Synthetic Construct
GKTTSK

SEQ ID NO: 14983 - protein, 6 aa, synthetic construct
  REGION 1..6: note = Synthetic Construct
GKTTTK

SEQ ID NO: 14984 - protein, 6 aa, synthetic construct
  REGION 1..6: note = Synthetic Construct
GKTTYK

SEQ ID NO: 14985 - protein, 6 aa, synthetic construct
  REGION 1..6: note = Synthetic Construct
GKTYAK

SEQ ID NO: 14986 - protein, 6 aa, synthetic construct
  REGION 1..6: note = Synthetic Construct
GKTYDK

SEQ ID NO: 14987 - protein, 6 aa, synthetic construct
  REGION 1..6: note = Synthetic Construct
GKTYEK

SEQ ID NO: 14988 - protein, 6 aa, synthetic construct
  REGION 1..6: note = Synthetic Construct
GKTYFK

SEQ ID NO: 14989 - protein, 6 aa, synthetic construct
  REGION 1..6: note = Synthetic Construct
GKTYGK

SEQ ID NO: 14990 - protein, 6 aa, synthetic construct
  REGION 1..6: note = Synthetic Construct
GKTYHK

SEQ ID NO: 14991 - protein, 6 aa, synthetic construct
  REGION 1..6: note = Synthetic Construct
GKTYIK

SEQ ID NO: 14992 - protein, 6 aa, synthetic construct
  REGION 1..6: note = Synthetic Construct
GKTYLK

SEQ ID NO: 14993 - protein, 6 aa, synthetic construct
  REGION 1..6: note = Synthetic Construct
GKTYNK

SEQ ID NO: 14994 - protein, 6 aa, synthetic construct
  REGION 1..6: note = Synthetic Construct
GKTYQK

SEQ ID NO: 14995 - protein, 6 aa, synthetic construct
  REGION 1..6: note = Synthetic Construct
GKTYRK

SEQ ID NO: 14996 - protein, 6 aa, synthetic construct
  REGION 1..6: note = Synthetic Construct
GKTYSK

SEQ ID NO: 14997 - protein, 6 aa, synthetic construct
  REGION 1..6: note = Synthetic Construct
GKTYTK

SEQ ID NO: 14998 - protein, 6 aa, synthetic construct
  REGION 1..6: note = Synthetic Construct
GKTYYK

SEQ ID NO: 14999 - protein, 6 aa, synthetic construct
  REGION 1..6: note = Synthetic Construct
GKYAAK

SEQ ID NO: 15000 - protein, 6 aa, synthetic construct
  REGION 1..6: note = Synthetic Construct
GKYADK

SEQ ID NO: 15001 - protein, 6 aa, synthetic construct
  REGION 1..6: note = Synthetic Construct
GKYAEK

SEQ ID NO: 15002 - protein, 6 aa, synthetic construct
  REGION 1..6: note = Synthetic Construct
GKYAFK

SEQ ID NO: 15003 - protein, 6 aa, synthetic construct
  REGION 1..6: note = Synthetic Construct
GKYAGK

SEQ ID NO: 15004 - protein, 6 aa, synthetic construct
  REGION 1..6: note = Synthetic Construct
GKYAHK

SEQ ID NO: 15005 - protein, 6 aa, synthetic construct
  REGION 1..6: note = Synthetic Construct
GKYAIK

SEQ ID NO: 15006 - protein, 6 aa, synthetic construct
  REGION 1..6: note = Synthetic Construct
GKYALK

SEQ ID NO: 15007 - protein, 6 aa, synthetic construct
  REGION 1..6: note = Synthetic Construct
GKYANK

SEQ ID NO: 15008 - protein, 6 aa, synthetic construct
  REGION 1..6: note = Synthetic Construct
GKYAQK

SEQ ID NO: 15009 - protein, 6 aa, synthetic construct
  REGION 1..6: note = Synthetic Construct
GKYARK

SEQ ID NO: 15010 - protein, 6 aa, synthetic construct
  REGION 1..6: note = Synthetic Construct
GKYASK

SEQ ID NO: 15011 - protein, 6 aa, synthetic construct
  REGION 1..6: note = Synthetic Construct
GKYATK

SEQ ID NO: 15012 - protein, 6 aa, synthetic construct
  REGION 1..6: note = Synthetic Construct
GKYAYK

SEQ ID NO: 15013 - protein, 6 aa, synthetic construct
  REGION 1..6: note = Synthetic Construct
GKYDAK

SEQ ID NO: 15014 - protein, 6 aa, synthetic construct
  REGION 1..6: note = Synthetic Construct
GKYDDK

SEQ ID NO: 15015 - protein, 6 aa, synthetic construct
  REGION 1..6: note = Synthetic Construct
GKYDEK

SEQ ID NO: 15016 - protein, 6 aa, synthetic construct
  REGION 1..6: note = Synthetic Construct
GKYDFK

SEQ ID NO: 15017 - protein, 6 aa, synthetic construct
  REGION 1..6: note = Synthetic Construct
GKYDGK

SEQ ID NO: 15018 - protein, 6 aa, synthetic construct
  REGION 1..6: note = Synthetic Construct
GKYDHK

SEQ ID NO: 15019 - protein, 6 aa, synthetic construct
  REGION 1..6: note = Synthetic Construct
GKYDIK

SEQ ID NO: 15020 - protein, 6 aa, synthetic construct
  REGION 1..6: note = Synthetic Construct
GKYDLK

SEQ ID NO: 15021 - protein, 6 aa, synthetic construct
  REGION 1..6: note = Synthetic Construct
GKYDNK

SEQ ID NO: 15022 - protein, 6 aa, synthetic construct
  REGION 1..6: note = Synthetic Construct
GKYDQK

SEQ ID NO: 15023 - protein, 6 aa, synthetic construct
  REGION 1..6: note = Synthetic Construct
GKYDRK

SEQ ID NO: 15024 - protein, 6 aa, synthetic construct
  REGION 1..6: note = Synthetic Construct
GKYDSK

SEQ ID NO: 15025 - protein, 6 aa, synthetic construct
  REGION 1..6: note = Synthetic Construct
GKYDTK

SEQ ID NO: 15026 - protein, 6 aa, synthetic construct
  REGION 1..6: note = Synthetic Construct
GKYDYK

SEQ ID NO: 15027 - protein, 6 aa, synthetic construct
  REGION 1..6: note = Synthetic Construct
GKYEAK

SEQ ID NO: 15028 - protein, 6 aa, synthetic construct
  REGION 1..6: note = Synthetic Construct
GKYEDK

SEQ ID NO: 15029 - protein, 6 aa, synthetic construct
  REGION 1..6: note = Synthetic Construct
GKYEEK

SEQ ID NO: 15030 - protein, 6 aa, synthetic construct
  REGION 1..6: note = Synthetic Construct
GKYEFK

SEQ ID NO: 15031 - protein, 6 aa, synthetic construct
  REGION 1..6: note = Synthetic Construct
GKYEGK

SEQ ID NO: 15032 - protein, 6 aa, synthetic construct
  REGION 1..6: note = Synthetic Construct
GKYEHK

SEQ ID NO: 15033 - protein, 6 aa, synthetic construct
  REGION 1..6: note = Synthetic Construct
GKYEIK

SEQ ID NO: 15034 - protein, 6 aa, synthetic construct
  REGION 1..6: note = Synthetic Construct
GKYELK

SEQ ID NO: 15035 - protein, 6 aa, synthetic construct
  REGION 1..6: note = Synthetic Construct
GKYENK

SEQ ID NO: 15036 - protein, 6 aa, synthetic construct
  REGION 1..6: note = Synthetic Construct
GKYEQK

SEQ ID NO: 15037 - protein, 6 aa, synthetic construct
  REGION 1..6: note = Synthetic Construct
GKYERK

SEQ ID NO: 15038 - protein, 6 aa, synthetic construct
  REGION 1..6: note = Synthetic Construct
GKYESK

SEQ ID NO: 15039 - protein, 6 aa, synthetic construct
  REGION 1..6: note = Synthetic Construct
GKYETK

SEQ ID NO: 15040 - protein, 6 aa, synthetic construct
  REGION 1..6: note = Synthetic Construct
GKYEYK

SEQ ID NO: 15041 - protein, 6 aa, synthetic construct
  REGION 1..6: note = Synthetic Construct
GKYFAK

SEQ ID NO: 15042 - protein, 6 aa, synthetic construct
  REGION 1..6: note = Synthetic Construct
GKYFDK

SEQ ID NO: 15043 - protein, 6 aa, synthetic construct
  REGION 1..6: note = Synthetic Construct
GKYFEK

SEQ ID NO: 15044 - protein, 6 aa, synthetic construct
  REGION 1..6: note = Synthetic Construct
GKYFFK

SEQ ID NO: 15045 - protein, 6 aa, synthetic construct
  REGION 1..6: note = Synthetic Construct
GKYFGK

SEQ ID NO: 15046 - protein, 6 aa, synthetic construct
  REGION 1..6: note = Synthetic Construct
GKYFHK

SEQ ID NO: 15047 - protein, 6 aa, synthetic construct
  REGION 1..6: note = Synthetic Construct
GKYFIK

SEQ ID NO: 15048 - protein, 6 aa, synthetic construct
  REGION 1..6: note = Synthetic Construct
GKYFLK

SEQ ID NO: 15049 - protein, 6 aa, synthetic construct
  REGION 1..6: note = Synthetic Construct
GKYFNK

SEQ ID NO: 15050 - protein, 6 aa, synthetic construct
  REGION 1..6: note = Synthetic Construct
GKYFQK

SEQ ID NO: 15051 - protein, 6 aa, synthetic construct
  REGION 1..6: note = Synthetic Construct
GKYFRK

SEQ ID NO: 15052 - protein, 6 aa, synthetic construct
  REGION 1..6: note = Synthetic Construct
GKYFSK

SEQ ID NO: 15053 - protein, 6 aa, synthetic construct
  REGION 1..6: note = Synthetic Construct
GKYFTK

SEQ ID NO: 15054 - protein, 6 aa, synthetic construct
  REGION 1..6: note = Synthetic Construct
GKYFYK

SEQ ID NO: 15055 - protein, 6 aa, synthetic construct
  REGION 1..6: note = Synthetic Construct
GKYGAK

SEQ ID NO: 15056 - protein, 6 aa, synthetic construct
  REGION 1..6: note = Synthetic Construct
GKYGDK

SEQ ID NO: 15057 - protein, 6 aa, synthetic construct
  REGION 1..6: note = Synthetic Construct
GKYGEK

SEQ ID NO: 15058 - protein, 6 aa, synthetic construct
  REGION 1..6: note = Synthetic Construct
GKYGFK

SEQ ID NO: 15059 - protein, 6 aa, synthetic construct
  REGION 1..6: note = Synthetic Construct
GKYGGK

SEQ ID NO: 15060 - protein, 6 aa, synthetic construct
  REGION 1..6: note = Synthetic Construct
GKYGHK

SEQ ID NO: 15061 - protein, 6 aa, synthetic construct
  REGION 1..6: note = Synthetic Construct
GKYGIK

SEQ ID NO: 15062 - protein, 6 aa, synthetic construct
  REGION 1..6: note = Synthetic Construct
GKYGLK

SEQ ID NO: 15063 - protein, 6 aa, synthetic construct
  REGION 1..6: note = Synthetic Construct
GKYGNK

SEQ ID NO: 15064 - protein, 6 aa, synthetic construct
  REGION 1..6: note = Synthetic Construct
GKYGQK

SEQ ID NO: 15065 - protein, 6 aa, synthetic construct
  REGION 1..6: note = Synthetic Construct
GKYGRK

SEQ ID NO: 15066 - protein, 6 aa, synthetic construct
  REGION 1..6: note = Synthetic Construct
GKYGSK

SEQ ID NO: 15067 - protein, 6 aa, synthetic construct
  REGION 1..6: note = Synthetic Construct
GKYGTK

SEQ ID NO: 15068 - protein, 6 aa, synthetic construct
  REGION 1..6: note = Synthetic Construct
GKYGYK

SEQ ID NO: 15069 - protein, 6 aa, synthetic construct
  REGION 1..6: note = Synthetic Construct
GKYHAK

SEQ ID NO: 15070 - protein, 6 aa, synthetic construct
  REGION 1..6: note = Synthetic Construct
GKYHDK

SEQ ID NO: 15071 - protein, 6 aa, synthetic construct
  REGION 1..6: note = Synthetic Construct
GKYHEK

SEQ ID NO: 15072 - protein, 6 aa, synthetic construct
  REGION 1..6: note = Synthetic Construct
GKYHFK

SEQ ID NO: 15073 - protein, 6 aa, synthetic construct
  REGION 1..6: note = Synthetic Construct
GKYHGK

SEQ ID NO: 15074 - protein, 6 aa, synthetic construct
  REGION 1..6: note = Synthetic Construct
GKYHHK

SEQ ID NO: 15075 - protein, 6 aa, synthetic construct
  REGION 1..6: note = Synthetic Construct
GKYHIK

SEQ ID NO: 15076 - protein, 6 aa, synthetic construct
  REGION 1..6: note = Synthetic Construct
GKYHLK

SEQ ID NO: 15077 - protein, 6 aa, synthetic construct
  REGION 1..6: note = Synthetic Construct
GKYHNK

SEQ ID NO: 15078 - protein, 6 aa, synthetic construct
  REGION 1..6: note = Synthetic Construct
GKYHQK

SEQ ID NO: 15079 - protein, 6 aa, synthetic construct
  REGION 1..6: note = Synthetic Construct
GKYHRK

SEQ ID NO: 15080 - protein, 6 aa, synthetic construct
  REGION 1..6: note = Synthetic Construct
GKYHSK

SEQ ID NO: 15081 - protein, 6 aa, synthetic construct
  REGION 1..6: note = Synthetic Construct
GKYHTK

SEQ ID NO: 15082 - protein, 6 aa, synthetic construct
  REGION 1..6: note = Synthetic Construct
GKYHYK

SEQ ID NO: 15083 - protein, 6 aa, synthetic construct
  REGION 1..6: note = Synthetic Construct
GKYIAK

SEQ ID NO: 15084 - protein, 6 aa, synthetic construct
  REGION 1..6: note = Synthetic Construct
GKYIDK

SEQ ID NO: 15085 - protein, 6 aa, synthetic construct
  REGION 1..6: note = Synthetic Construct
GKYIEK

SEQ ID NO: 15086 - protein, 6 aa, synthetic construct
  REGION 1..6: note = Synthetic Construct
GKYIFK

SEQ ID NO: 15087 - protein, 6 aa, synthetic construct
  REGION 1..6: note = Synthetic Construct
GKYIGK

SEQ ID NO: 15088 - protein, 6 aa, synthetic construct
  REGION 1..6: note = Synthetic Construct
GKYIHK

SEQ ID NO: 15089 - protein, 6 aa, synthetic construct
  REGION 1..6: note = Synthetic Construct
GKYIIK

SEQ ID NO: 15090 - protein, 6 aa, synthetic construct
  REGION 1..6: note = Synthetic Construct
GKYILK

SEQ ID NO: 15091 - protein, 6 aa, synthetic construct
  REGION 1..6: note = Synthetic Construct
GKYINK

SEQ ID NO: 15092 - protein, 6 aa, synthetic construct
  REGION 1..6: note = Synthetic Construct
GKYIQK

SEQ ID NO: 15093 - protein, 6 aa, synthetic construct
  REGION 1..6: note = Synthetic Construct
GKYIRK

SEQ ID NO: 15094 - protein, 6 aa, synthetic construct
  REGION 1..6: note = Synthetic Construct
GKYISK

SEQ ID NO: 15095 - protein, 6 aa, synthetic construct
  REGION 1..6: note = Synthetic Construct
GKYITK

SEQ ID NO: 15096 - protein, 6 aa, synthetic construct
  REGION 1..6: note = Synthetic Construct
GKYIYK

SEQ ID NO: 15097 - protein, 6 aa, synthetic construct
  REGION 1..6: note = Synthetic Construct
GKYLAK

SEQ ID NO: 15098 - protein, 6 aa, synthetic construct
  REGION 1..6: note = Synthetic Construct
GKYLDK

SEQ ID NO: 15099 - protein, 6 aa, synthetic construct
  REGION 1..6: note = Synthetic Construct
GKYLEK

SEQ ID NO: 15100 - protein, 6 aa, synthetic construct
  REGION 1..6: note = Synthetic Construct
GKYLFK

SEQ ID NO: 15101 - protein, 6 aa, synthetic construct
  REGION 1..6: note = Synthetic Construct
GKYLGK

SEQ ID NO: 15102 - protein, 6 aa, synthetic construct
  REGION 1..6: note = Synthetic Construct
GKYLHK

SEQ ID NO: 15103 - protein, 6 aa, synthetic construct
  REGION 1..6: note = Synthetic Construct
GKYLIK

SEQ ID NO: 15104 - protein, 6 aa, synthetic construct
  REGION 1..6: note = Synthetic Construct
GKYLLK

SEQ ID NO: 15105 - protein, 6 aa, synthetic construct
  REGION 1..6: note = Synthetic Construct
GKYLNK

SEQ ID NO: 15106 - protein, 6 aa, synthetic construct
  REGION 1..6: note = Synthetic Construct
GKYLQK

SEQ ID NO: 15107 - protein, 6 aa, synthetic construct
  REGION 1..6: note = Synthetic Construct
GKYLRK

SEQ ID NO: 15108 - protein, 6 aa, synthetic construct
  REGION 1..6: note = Synthetic Construct
GKYLSK

SEQ ID NO: 15109 - protein, 6 aa, synthetic construct
  REGION 1..6: note = Synthetic Construct
GKYLTK

SEQ ID NO: 15110 - protein, 6 aa, synthetic construct
  REGION 1..6: note = Synthetic Construct
GKYLYK

SEQ ID NO: 15111 - protein, 6 aa, synthetic construct
  REGION 1..6: note = Synthetic Construct
GKYNAK

SEQ ID NO: 15112 - protein, 6 aa, synthetic construct
  REGION 1..6: note = Synthetic Construct
GKYNDK

SEQ ID NO: 15113 - protein, 6 aa, synthetic construct
  REGION 1..6: note = Synthetic Construct
GKYNEK

SEQ ID NO: 15114 - protein, 6 aa, synthetic construct
  REGION 1..6: note = Synthetic Construct
GKYNFK

SEQ ID NO: 15115 - protein, 6 aa, synthetic construct
  REGION 1..6: note = Synthetic Construct
GKYNGK

SEQ ID NO: 15116 - protein, 6 aa, synthetic construct
  REGION 1..6: note = Synthetic Construct
GKYNHK

SEQ ID NO: 15117 - protein, 6 aa, synthetic construct
  REGION 1..6: note = Synthetic Construct
GKYNIK

SEQ ID NO: 15118 - protein, 6 aa, synthetic construct
  REGION 1..6: note = Synthetic Construct
GKYNLK

SEQ ID NO: 15119 - protein, 6 aa, synthetic construct
  REGION 1..6: note = Synthetic Construct
GKYNNK

SEQ ID NO: 15120 - protein, 6 aa, synthetic construct
  REGION 1..6: note = Synthetic Construct
GKYNQK

SEQ ID NO: 15121 - protein, 6 aa, synthetic construct
  REGION 1..6: note = Synthetic Construct
GKYNRK

SEQ ID NO: 15122 - protein, 6 aa, synthetic construct
  REGION 1..6: note = Synthetic Construct
GKYNSK

SEQ ID NO: 15123 - protein, 6 aa, synthetic construct
  REGION 1..6: note = Synthetic Construct
GKYNTK

SEQ ID NO: 15124 - protein, 6 aa, synthetic construct
  REGION 1..6: note = Synthetic Construct
GKYNYK

SEQ ID NO: 15125 - protein, 6 aa, synthetic construct
  REGION 1..6: note = Synthetic Construct
GKYQAK

SEQ ID NO: 15126 - protein, 6 aa, synthetic construct
  REGION 1..6: note = Synthetic Construct
GKYQDK

SEQ ID NO: 15127 - protein, 6 aa, synthetic construct
  REGION 1..6: note = Synthetic Construct
GKYQEK

SEQ ID NO: 15128 - protein, 6 aa, synthetic construct
  REGION 1..6: note = Synthetic Construct
GKYQFK

SEQ ID NO: 15129 - protein, 6 aa, synthetic construct
  REGION 1..6: note = Synthetic Construct
GKYQGK

SEQ ID NO: 15130 - protein, 6 aa, synthetic construct
  REGION 1..6: note = Synthetic Construct
GKYQHK

SEQ ID NO: 15131 - protein, 6 aa, synthetic construct
  REGION 1..6: note = Synthetic Construct
GKYQIK

SEQ ID NO: 15132 - protein, 6 aa, synthetic construct
  REGION 1..6: note = Synthetic Construct
GKYQLK

SEQ ID NO: 15133 - protein, 6 aa, synthetic construct
  REGION 1..6: note = Synthetic Construct
GKYQNK

SEQ ID NO: 15134 - protein, 6 aa, synthetic construct
  REGION 1..6: note = Synthetic Construct
GKYQQK

SEQ ID NO: 15135 - protein, 6 aa, synthetic construct
  REGION 1..6: note = Synthetic Construct
GKYQRK

SEQ ID NO: 15136 - protein, 6 aa, synthetic construct
  REGION 1..6: note = Synthetic Construct
GKYQSK

SEQ ID NO: 15137 - protein, 6 aa, synthetic construct
  REGION 1..6: note = Synthetic Construct
GKYQTK

SEQ ID NO: 15138 - protein, 6 aa, synthetic construct
  REGION 1..6: note = Synthetic Construct
GKYQYK

SEQ ID NO: 15139 - protein, 6 aa, synthetic construct
  REGION 1..6: note = Synthetic Construct
GKYRAK

SEQ ID NO: 15140 - protein, 6 aa, synthetic construct
  REGION 1..6: note = Synthetic Construct
GKYRDK

SEQ ID NO: 15141 - protein, 6 aa, synthetic construct
  REGION 1..6: note = Synthetic Construct
GKYREK

SEQ ID NO: 15142 - protein, 6 aa, synthetic construct
  REGION 1..6: note = Synthetic Construct
GKYRFK

SEQ ID NO: 15143 - protein, 6 aa, synthetic construct
  REGION 1..6: note = Synthetic Construct
GKYRGK

SEQ ID NO: 15144 - protein, 6 aa, synthetic construct
  REGION 1..6: note = Synthetic Construct
GKYRHK

SEQ ID NO: 15145 - protein, 6 aa, synthetic construct
  REGION 1..6: note = Synthetic Construct
GKYRIK

SEQ ID NO: 15146 - protein, 6 aa, synthetic construct
  REGION 1..6: note = Synthetic Construct
GKYRLK

SEQ ID NO: 15147 - protein, 6 aa, synthetic construct
  REGION 1..6: note = Synthetic Construct
GKYRNK

SEQ ID NO: 15148 - protein, 6 aa, synthetic construct
  REGION 1..6: note = Synthetic Construct
GKYRQK

SEQ ID NO: 15149 - protein, 6 aa, synthetic construct
  REGION 1..6: note = Synthetic Construct
GKYRRK

SEQ ID NO: 15150 - protein, 6 aa, synthetic construct
  REGION 1..6: note = Synthetic Construct
GKYRSK

SEQ ID NO: 15151 - protein, 6 aa, synthetic construct
  REGION 1..6: note = Synthetic Construct
GKYRTK

SEQ ID NO: 15152 - protein, 6 aa, synthetic construct
  REGION 1..6: note = Synthetic Construct
GKYRYK

SEQ ID NO: 15153 - protein, 6 aa, synthetic construct
  REGION 1..6: note = Synthetic Construct
GKYSAK

SEQ ID NO: 15154 - protein, 6 aa, synthetic construct
  REGION 1..6: note = Synthetic Construct
GKYSDK

SEQ ID NO: 15155 - protein, 6 aa, synthetic construct
  REGION 1..6: note = Synthetic Construct
GKYSEK

SEQ ID NO: 15156 - protein, 6 aa, synthetic construct
  REGION 1..6: note = Synthetic Construct
GKYSFK

SEQ ID NO: 15157 - protein, 6 aa, synthetic construct
  REGION 1..6: note = Synthetic Construct
GKYSGK

SEQ ID NO: 15158 - protein, 6 aa, synthetic construct
  REGION 1..6: note = Synthetic Construct
GKYSHK

SEQ ID NO: 15159 - protein, 6 aa, synthetic construct
  REGION 1..6: note = Synthetic Construct
GKYSIK

SEQ ID NO: 15160 - protein, 6 aa, synthetic construct
  REGION 1..6: note = Synthetic Construct
GKYSLK

SEQ ID NO: 15161 - protein, 6 aa, synthetic construct
  REGION 1..6: note = Synthetic Construct
GKYSNK

SEQ ID NO: 15162 - protein, 6 aa, synthetic construct
  REGION 1..6: note = Synthetic Construct
GKYSQK

SEQ ID NO: 15163 - protein, 6 aa, synthetic construct
  REGION 1..6: note = Synthetic Construct
GKYSRK

SEQ ID NO: 15164 - protein, 6 aa, synthetic construct
  REGION 1..6: note = Synthetic Construct
GKYSSK

SEQ ID NO: 15165 - protein, 6 aa, synthetic construct
  REGION 1..6: note = Synthetic Construct
GKYSTK

SEQ ID NO: 15166 - protein, 6 aa, synthetic construct
  REGION 1..6: note = Synthetic Construct
GKYSYK

SEQ ID NO: 15167 - protein, 6 aa, synthetic construct
  REGION 1..6: note = Synthetic Construct
GKYTAK

SEQ ID NO: 15168 - protein, 6 aa, synthetic construct
  REGION 1..6: note = Synthetic Construct
GKYTDK

SEQ ID NO: 15169 - protein, 6 aa, synthetic construct
  REGION 1..6: note = Synthetic Construct
GKYTEK

SEQ ID NO: 15170 - protein, 6 aa, synthetic construct
  REGION 1..6: note = Synthetic Construct
GKYTFK

SEQ ID NO: 15171 - protein, 6 aa, synthetic construct
  REGION 1..6: note = Synthetic Construct
GKYTGK

SEQ ID NO: 15172 - protein, 6 aa, synthetic construct
  REGION 1..6: note = Synthetic Construct
GKYTHK

SEQ ID NO: 15173 - protein, 6 aa, synthetic construct
  REGION 1..6: note = Synthetic Construct
GKYTIK

SEQ ID NO: 15174 - protein, 6 aa, synthetic construct
  REGION 1..6: note = Synthetic Construct
GKYTLK

SEQ ID NO: 15175 - protein, 6 aa, synthetic construct
  REGION 1..6: note = Synthetic Construct
GKYTNK

SEQ ID NO: 15176 - protein, 6 aa, synthetic construct
  REGION 1..6: note = Synthetic Construct
GKYTQK

SEQ ID NO: 15177 - protein, 6 aa, synthetic construct
  REGION 1..6: note = Synthetic Construct
GKYTRK

SEQ ID NO: 15178 - protein, 6 aa, synthetic construct
  REGION 1..6: note = Synthetic Construct
GKYTSK

SEQ ID NO: 15179 - protein, 6 aa, synthetic construct
  REGION 1..6: note = Synthetic Construct
GKYTTK

SEQ ID NO: 15180 - protein, 6 aa, synthetic construct
  REGION 1..6: note = Synthetic Construct
GKYTYK

SEQ ID NO: 15181 - protein, 6 aa, synthetic construct
  REGION 1..6: note = Synthetic Construct
GKYYAK

SEQ ID NO: 15182 - protein, 6 aa, synthetic construct
  REGION 1..6: note = Synthetic Construct
GKYYDK

SEQ ID NO: 15183 - protein, 6 aa, synthetic construct
  REGION 1..6: note = Synthetic Construct
GKYYEK

SEQ ID NO: 15184 - protein, 6 aa, synthetic construct
  REGION 1..6: note = Synthetic Construct
GKYYFK

SEQ ID NO: 15185 - protein, 6 aa, synthetic construct
  REGION 1..6: note = Synthetic Construct
GKYYGK

SEQ ID NO: 15186 - protein, 6 aa, synthetic construct
  REGION 1..6: note = Synthetic Construct
GKYYHK

SEQ ID NO: 15187 - protein, 6 aa, synthetic construct
  REGION 1..6: note = Synthetic Construct
GKYYIK

SEQ ID NO: 15188 - protein, 6 aa, synthetic construct
  REGION 1..6: note = Synthetic Construct
GKYYLK

SEQ ID NO: 15189 - protein, 6 aa, synthetic construct
  REGION 1..6: note = Synthetic Construct
GKYYNK

SEQ ID NO: 15190 - protein, 6 aa, synthetic construct
  REGION 1..6: note = Synthetic Construct
GKYYQK

SEQ ID NO: 15191 - protein, 6 aa, synthetic construct
  REGION 1..6: note = Synthetic Construct
GKYYRK

SEQ ID NO: 15192 - protein, 6 aa, synthetic construct
  REGION 1..6: note = Synthetic Construct
GKYYSK

SEQ ID NO: 15193 - protein, 6 aa, synthetic construct
  REGION 1..6: note = Synthetic Construct
GKYYTK

SEQ ID NO: 15194 - protein, 6 aa, synthetic construct
  REGION 1..6: note = Synthetic Construct
GKYYYK

SEQ ID NO: 15195 - protein, 7 aa, synthetic construct
  REGION 1..7: note = Synthetic Construct
RSKAAAK

SEQ ID NO: 15196 - protein, 7 aa, synthetic construct
  REGION 1..7: note = Synthetic Construct
RSKAADK

SEQ ID NO: 15197 - protein, 7 aa, synthetic construct
  REGION 1..7: note = Synthetic Construct
RSKAAEK

SEQ ID NO: 15198 - protein, 7 aa, synthetic construct
  REGION 1..7: note = Synthetic Construct
RSKAAFK

SEQ ID NO: 15199 - protein, 7 aa, synthetic construct
  REGION 1..7: note = Synthetic Construct
RSKAAGK

SEQ ID NO: 15200 - protein, 7 aa, synthetic construct
  REGION 1..7: note = Synthetic Construct
RSKAAHK

SEQ ID NO: 15201 - protein, 7 aa, synthetic construct
  REGION 1..7: note = Synthetic Construct
RSKAAIK

SEQ ID NO: 15202 - protein, 7 aa, synthetic construct
  REGION 1..7: note = Synthetic Construct
RSKAALK

SEQ ID NO: 15203 - protein, 7 aa, synthetic construct
  REGION 1..7: note = Synthetic Construct
RSKAANK

SEQ ID NO: 15204 - protein, 7 aa, synthetic construct
  REGION 1..7: note = Synthetic Construct
RSKAAQK

SEQ ID NO: 15205 - protein, 7 aa, synthetic construct
  REGION 1..7: note = Synthetic Construct
RSKAARK

SEQ ID NO: 15206 - protein, 7 aa, synthetic construct
  REGION 1..7: note = Synthetic Construct
RSKAASK

SEQ ID NO: 15207 - protein, 7 aa, synthetic construct
  REGION 1..7: note = Synthetic Construct
RSKAATK

SEQ ID NO: 15208 - protein, 7 aa, synthetic construct
  REGION 1..7: note = Synthetic Construct
RSKAAYK

SEQ ID NO: 15209 - protein, 7 aa, synthetic construct
  REGION 1..7: note = Synthetic Construct
RSKADAK

SEQ ID NO: 15210 - protein, 7 aa, synthetic construct
  REGION 1..7: note = Synthetic Construct
RSKADDK

SEQ ID NO: 15211 - protein, 7 aa, synthetic construct
  REGION 1..7: note = Synthetic Construct
RSKADEK

SEQ ID NO: 15212 - protein, 7 aa, synthetic construct
  REGION 1..7: note = Synthetic Construct
RSKADFK

SEQ ID NO: 15213 - protein, 7 aa, synthetic construct
  REGION 1..7: note = Synthetic Construct
RSKADGK

SEQ ID NO: 15214 - protein, 7 aa, synthetic construct
  REGION 1..7: note = Synthetic Construct
RSKADHK

SEQ ID NO: 15215 - protein, 7 aa, synthetic construct
  REGION 1..7: note = Synthetic Construct
RSKADIK

SEQ ID NO: 15216 - protein, 7 aa, synthetic construct
  REGION 1..7: note = Synthetic Construct
RSKADLK

SEQ ID NO: 15217 - protein, 7 aa, synthetic construct
  REGION 1..7: note = Synthetic Construct
RSKADNK

SEQ ID NO: 15218 - protein, 7 aa, synthetic construct
  REGION 1..7: note = Synthetic Construct
RSKADQK

SEQ ID NO: 15219 - protein, 7 aa, synthetic construct
  REGION 1..7: note = Synthetic Construct
RSKADRK

SEQ ID NO: 15220 - protein, 7 aa, synthetic construct
  REGION 1..7: note = Synthetic Construct
RSKADSK

SEQ ID NO: 15221 - protein, 7 aa, synthetic construct
  REGION 1..7: note = Synthetic Construct
RSKADTK

SEQ ID NO: 15222 - protein, 7 aa, synthetic construct
  REGION 1..7: note = Synthetic Construct
RSKADYK

SEQ ID NO: 15223 - protein, 7 aa, synthetic construct
  REGION 1..7: note = Synthetic Construct
RSKAEAK

SEQ ID NO: 15224 - protein, 7 aa, synthetic construct
  REGION 1..7: note = Synthetic Construct
RSKAEDK

SEQ ID NO: 15225 - protein, 7 aa, synthetic construct
  REGION 1..7: note = Synthetic Construct
RSKAEEK

SEQ ID NO: 15226 - protein, 7 aa, synthetic construct
  REGION 1..7: note = Synthetic Construct
RSKAEFK

SEQ ID NO: 15227 - protein, 7 aa, synthetic construct
  REGION 1..7: note = Synthetic Construct
RSKAEGK

SEQ ID NO: 15228 - protein, 7 aa, synthetic construct
  REGION 1..7: note = Synthetic Construct
RSKAEHK

SEQ ID NO: 15229 - protein, 7 aa, synthetic construct
  REGION 1..7: note = Synthetic Construct
RSKAEIK

SEQ ID NO: 15230 - protein, 7 aa, synthetic construct
  REGION 1..7: note = Synthetic Construct
RSKAELK

SEQ ID NO: 15231 - protein, 7 aa, synthetic construct
  REGION 1..7: note = Synthetic Construct
RSKAENK

SEQ ID NO: 15232 - protein, 7 aa, synthetic construct
  REGION 1..7: note = Synthetic Construct
RSKAEQK

SEQ ID NO: 15233 - protein, 7 aa, synthetic construct
  REGION 1..7: note = Synthetic Construct
RSKAERK

SEQ ID NO: 15234 - protein, 7 aa, synthetic construct
  REGION 1..7: note = Synthetic Construct
RSKAESK

SEQ ID NO: 15235 - protein, 7 aa, synthetic construct
  REGION 1..7: note = Synthetic Construct
RSKAETK

SEQ ID NO: 15236 - protein, 7 aa, synthetic construct
  REGION 1..7: note = Synthetic Construct
RSKAEYK

SEQ ID NO: 15237 - protein, 7 aa, synthetic construct
  REGION 1..7: note = Synthetic Construct
RSKAFAK

SEQ ID NO: 15238 - protein, 7 aa, synthetic construct
  REGION 1..7: note = Synthetic Construct
RSKAFDK

SEQ ID NO: 15239 - protein, 7 aa, synthetic construct
  REGION 1..7: note = Synthetic Construct
RSKAFEK

SEQ ID NO: 15240 - protein, 7 aa, synthetic construct
  REGION 1..7: note = Synthetic Construct
RSKAFFK

SEQ ID NO: 15241 - protein, 7 aa, synthetic construct
  REGION 1..7: note = Synthetic Construct
RSKAFGK

SEQ ID NO: 15242 - protein, 7 aa, synthetic construct
  REGION 1..7: note = Synthetic Construct
RSKAFHK

SEQ ID NO: 15243 - protein, 7 aa, synthetic construct
  REGION 1..7: note = Synthetic Construct
RSKAFIK

SEQ ID NO: 15244 - protein, 7 aa, synthetic construct
  REGION 1..7: note = Synthetic Construct
RSKAFLK

SEQ ID NO: 15245 - protein, 7 aa, synthetic construct
  REGION 1..7: note = Synthetic Construct
RSKAFNK

SEQ ID NO: 15246 - protein, 7 aa, synthetic construct
  REGION 1..7: note = Synthetic Construct
RSKAFQK

SEQ ID NO: 15247 - protein, 7 aa, synthetic construct
  REGION 1..7: note = Synthetic Construct
RSKAFRK

SEQ ID NO: 15248 - protein, 7 aa, synthetic construct
  REGION 1..7: note = Synthetic Construct
RSKAFSK

SEQ ID NO: 15249 - protein, 7 aa, synthetic construct
  REGION 1..7: note = Synthetic Construct
RSKAFTK

SEQ ID NO: 15250 - protein, 7 aa, synthetic construct
  REGION 1..7: note = Synthetic Construct
RSKAFYK

SEQ ID NO: 15251 - protein, 7 aa, synthetic construct
  REGION 1..7: note = Synthetic Construct
RSKAGAK

SEQ ID NO: 15252 - protein, 7 aa, synthetic construct
  REGION 1..7: note = Synthetic Construct
RSKAGDK

SEQ ID NO: 15253 - protein, 7 aa, synthetic construct
  REGION 1..7: note = Synthetic Construct
RSKAGEK

SEQ ID NO: 15254 - protein, 7 aa, synthetic construct
  REGION 1..7: note = Synthetic Construct
RSKAGFK

SEQ ID NO: 15255 - protein, 7 aa, synthetic construct
  REGION 1..7: note = Synthetic Construct
RSKAGGK

SEQ ID NO: 15256 - protein, 7 aa, synthetic construct
  REGION 1..7: note = Synthetic Construct
RSKAGHK

SEQ ID NO: 15257 - protein, 7 aa, synthetic construct
  REGION 1..7: note = Synthetic Construct
RSKAGIK

SEQ ID NO: 15258 - protein, 7 aa, synthetic construct
  REGION 1..7: note = Synthetic Construct
RSKAGLK

SEQ ID NO: 15259 - protein, 7 aa, synthetic construct
  REGION 1..7: note = Synthetic Construct
RSKAGNK

SEQ ID NO: 15260 - protein, 7 aa, synthetic construct
  REGION 1..7: note = Synthetic Construct
RSKAGQK

SEQ ID NO: 15261 - protein, 7 aa, synthetic construct
  REGION 1..7: note = Synthetic Construct
RSKAGRK

SEQ ID NO: 15262 - protein, 7 aa, synthetic construct
  REGION 1..7: note = Synthetic Construct
RSKAGSK

SEQ ID NO: 15263 - protein, 7 aa, synthetic construct
  REGION 1..7: note = Synthetic Construct
RSKAGTK

SEQ ID NO: 15264 - protein, 7 aa, synthetic construct
  REGION 1..7: note = Synthetic Construct
RSKAGYK

SEQ ID NO: 15265 - protein, 7 aa, synthetic construct
  REGION 1..7: note = Synthetic Construct
RSKAHAK

SEQ ID NO: 15266 - protein, 7 aa, synthetic construct
  REGION 1..7: note = Synthetic Construct
RSKAHDK

SEQ ID NO: 15267 - protein, 7 aa, synthetic construct
  REGION 1..7: note = Synthetic Construct
RSKAHEK

SEQ ID NO: 15268 - protein, 7 aa, synthetic construct
  REGION 1..7: note = Synthetic Construct
RSKAHFK

SEQ ID NO: 15269 - protein, 7 aa, synthetic construct
  REGION 1..7: note = Synthetic Construct
RSKAHGK

SEQ ID NO: 15270 - protein, 7 aa, synthetic construct
  REGION 1..7: note = Synthetic Construct
RSKAHHK

SEQ ID NO: 15271 - protein, 7 aa, synthetic construct
  REGION 1..7: note = Synthetic Construct
RSKAHIK

SEQ ID NO: 15272 - protein, 7 aa, synthetic construct
  REGION 1..7: note = Synthetic Construct
RSKAHLK

SEQ ID NO: 15273 - protein, 7 aa, synthetic construct
  REGION 1..7: note = Synthetic Construct
RSKAHNK

SEQ ID NO: 15274 - protein, 7 aa, synthetic construct
  REGION 1..7: note = Synthetic Construct
RSKAHQK

SEQ ID NO: 15275 - protein, 7 aa, synthetic construct
  REGION 1..7: note = Synthetic Construct
RSKAHRK

SEQ ID NO: 15276 - protein, 7 aa, synthetic construct
  REGION 1..7: note = Synthetic Construct
RSKAHSK

SEQ ID NO: 15277 - protein, 7 aa, synthetic construct
  REGION 1..7: note = Synthetic Construct
RSKAHTK

SEQ ID NO: 15278 - protein, 7 aa, synthetic construct
  REGION 1..7: note = Synthetic Construct
RSKAHYK

SEQ ID NO: 15279 - protein, 7 aa, synthetic construct
  REGION 1..7: note = Synthetic Construct
RSKAIAK

SEQ ID NO: 15280 - protein, 7 aa, synthetic construct
  REGION 1..7: note = Synthetic Construct
RSKAIDK

SEQ ID NO: 15281 - protein, 7 aa, synthetic construct
  REGION 1..7: note = Synthetic Construct
RSKAIEK

SEQ ID NO: 15282 - protein, 7 aa, synthetic construct
  REGION 1..7: note = Synthetic Construct
RSKAIFK

SEQ ID NO: 15283 - protein, 7 aa, synthetic construct
  REGION 1..7: note = Synthetic Construct
RSKAIGK

SEQ ID NO: 15284 - protein, 7 aa, synthetic construct
  REGION 1..7: note = Synthetic Construct
RSKAIHK

SEQ ID NO: 15285 - protein, 7 aa, synthetic construct
  REGION 1..7: note = Synthetic Construct
RSKAIIK

SEQ ID NO: 15286 - protein, 7 aa, synthetic construct
  REGION 1..7: note = Synthetic Construct
RSKAILK

SEQ ID NO: 15287 - protein, 7 aa, synthetic construct
  REGION 1..7: note = Synthetic Construct
RSKAINK

SEQ ID NO: 15288 - protein, 7 aa, synthetic construct
  REGION 1..7: note = Synthetic Construct
RSKAIQK

SEQ ID NO: 15289 - protein, 7 aa, synthetic construct
  REGION 1..7: note = Synthetic Construct
RSKAIRK

SEQ ID NO: 15290 - protein, 7 aa, synthetic construct
  REGION 1..7: note = Synthetic Construct
RSKAISK

SEQ ID NO: 15291 - protein, 7 aa, synthetic construct
  REGION 1..7: note = Synthetic Construct
RSKAITK

SEQ ID NO: 15292 - protein, 7 aa, synthetic construct
  REGION 1..7: note = Synthetic Construct
RSKAIYK

SEQ ID NO: 15293 - protein, 7 aa, synthetic construct
  REGION 1..7: note = Synthetic Construct
RSKALAK

SEQ ID NO: 15294 - protein, 7 aa, synthetic construct
  REGION 1..7: note = Synthetic Construct
RSKALDK

SEQ ID NO: 15295 - protein, 7 aa, synthetic construct
  REGION 1..7: note = Synthetic Construct
RSKALEK

SEQ ID NO: 15296 - protein, 7 aa, synthetic construct
  REGION 1..7: note = Synthetic Construct
RSKALFK

SEQ ID NO: 15297 - protein, 7 aa, synthetic construct
  REGION 1..7: note = Synthetic Construct
RSKALGK

SEQ ID NO: 15298 - protein, 7 aa, synthetic construct
  REGION 1..7: note = Synthetic Construct
RSKALHK

SEQ ID NO: 15299 - protein, 7 aa, synthetic construct
  REGION 1..7: note = Synthetic Construct
RSKALIK

SEQ ID NO: 15300 - protein, 7 aa, synthetic construct
  REGION 1..7: note = Synthetic Construct
RSKALLK

SEQ ID NO: 15301 - protein, 7 aa, synthetic construct
  REGION 1..7: note = Synthetic Construct
RSKALNK

SEQ ID NO: 15302 - protein, 7 aa, synthetic construct
  REGION 1..7: note = Synthetic Construct
RSKALQK

SEQ ID NO: 15303 - protein, 7 aa, synthetic construct
  REGION 1..7: note = Synthetic Construct
RSKALRK

SEQ ID NO: 15304 - protein, 7 aa, synthetic construct
  REGION 1..7: note = Synthetic Construct
RSKALSK

SEQ ID NO: 15305 - protein, 7 aa, synthetic construct
  REGION 1..7: note = Synthetic Construct
RSKALTK

SEQ ID NO: 15306 - protein, 7 aa, synthetic construct
  REGION 1..7: note = Synthetic Construct
RSKALYK

SEQ ID NO: 15307 - protein, 7 aa, synthetic construct
  REGION 1..7: note = Synthetic Construct
RSKANAK

SEQ ID NO: 15308 - protein, 7 aa, synthetic construct
  REGION 1..7: note = Synthetic Construct
RSKANDK

SEQ ID NO: 15309 - protein, 7 aa, synthetic construct
  REGION 1..7: note = Synthetic Construct
RSKANEK

SEQ ID NO: 15310 - protein, 7 aa, synthetic construct
  REGION 1..7: note = Synthetic Construct
RSKANFK

SEQ ID NO: 15311 - protein, 7 aa, synthetic construct
  REGION 1..7: note = Synthetic Construct
RSKANGK

SEQ ID NO: 15312 - protein, 7 aa, synthetic construct
  REGION 1..7: note = Synthetic Construct
RSKANHK

SEQ ID NO: 15313 - protein, 7 aa, synthetic construct
  REGION 1..7: note = Synthetic Construct
RSKANIK

SEQ ID NO: 15314 - protein, 7 aa, synthetic construct
  REGION 1..7: note = Synthetic Construct
RSKANLK

SEQ ID NO: 15315 - protein, 7 aa, synthetic construct
  REGION 1..7: note = Synthetic Construct
RSKANNK

SEQ ID NO: 15316 - protein, 7 aa, synthetic construct
  REGION 1..7: note = Synthetic Construct
RSKANQK

SEQ ID NO: 15317 - protein, 7 aa, synthetic construct
  REGION 1..7: note = Synthetic Construct
RSKANRK

SEQ ID NO: 15318 - protein, 7 aa, synthetic construct
  REGION 1..7: note = Synthetic Construct
RSKANSK

SEQ ID NO: 15319 - protein, 7 aa, synthetic construct
  REGION 1..7: note = Synthetic Construct
RSKANTK

SEQ ID NO: 15320 - protein, 7 aa, synthetic construct
  REGION 1..7: note = Synthetic Construct
RSKANYK

SEQ ID NO: 15321 - protein, 7 aa, synthetic construct
  REGION 1..7: note = Synthetic Construct
RSKAQAK

SEQ ID NO: 15322 - protein, 7 aa, synthetic construct
  REGION 1..7: note = Synthetic Construct
RSKAQDK

SEQ ID NO: 15323 - protein, 7 aa, synthetic construct
  REGION 1..7: note = Synthetic Construct
RSKAQEK

SEQ ID NO: 15324 - protein, 7 aa, synthetic construct
  REGION 1..7: note = Synthetic Construct
RSKAQFK

SEQ ID NO: 15325 - protein, 7 aa, synthetic construct
  REGION 1..7: note = Synthetic Construct
RSKAQGK

SEQ ID NO: 15326 - protein, 7 aa, synthetic construct
  REGION 1..7: note = Synthetic Construct
RSKAQHK

SEQ ID NO: 15327 - protein, 7 aa, synthetic construct
  REGION 1..7: note = Synthetic Construct
RSKAQIK

SEQ ID NO: 15328 - protein, 7 aa, synthetic construct
  REGION 1..7: note = Synthetic Construct
RSKAQLK

SEQ ID NO: 15329 - protein, 7 aa, synthetic construct
  REGION 1..7: note = Synthetic Construct
RSKAQNK

SEQ ID NO: 15330 - protein, 7 aa, synthetic construct
  REGION 1..7: note = Synthetic Construct
RSKAQQK

SEQ ID NO: 15331 - protein, 7 aa, synthetic construct
  REGION 1..7: note = Synthetic Construct
RSKAQRK

SEQ ID NO: 15332 - protein, 7 aa, synthetic construct
  REGION 1..7: note = Synthetic Construct
RSKAQSK

SEQ ID NO: 15333 - protein, 7 aa, synthetic construct
  REGION 1..7: note = Synthetic Construct
RSKAQTK

SEQ ID NO: 15334 - protein, 7 aa, synthetic construct
  REGION 1..7: note = Synthetic Construct
RSKAQYK

SEQ ID NO: 15335 - protein, 7 aa, synthetic construct
  REGION 1..7: note = Synthetic Construct
RSKARAK

SEQ ID NO: 15336 - protein, 7 aa, synthetic construct
  REGION 1..7: note = Synthetic Construct
RSKARDK

SEQ ID NO: 15337 - protein, 7 aa, synthetic construct
  REGION 1..7: note = Synthetic Construct
RSKAREK

SEQ ID NO: 15338 - protein, 7 aa, synthetic construct
  REGION 1..7: note = Synthetic Construct
RSKARFK

SEQ ID NO: 15339 - protein, 7 aa, synthetic construct
  REGION 1..7: note = Synthetic Construct
RSKARGK

SEQ ID NO: 15340 - protein, 7 aa, synthetic construct
  REGION 1..7: note = Synthetic Construct
RSKARHK

SEQ ID NO: 15341 - protein, 7 aa, synthetic construct
  REGION 1..7: note = Synthetic Construct
RSKARIK

SEQ ID NO: 15342 - protein, 7 aa, synthetic construct
  REGION 1..7: note = Synthetic Construct
RSKARLK

SEQ ID NO: 15343 - protein, 7 aa, synthetic construct
  REGION 1..7: note = Synthetic Construct
RSKARNK

SEQ ID NO: 15344 - protein, 7 aa, synthetic construct
  REGION 1..7: note = Synthetic Construct
RSKARQK

SEQ ID NO: 15345 - protein, 7 aa, synthetic construct
  REGION 1..7: note = Synthetic Construct
RSKARRK

SEQ ID NO: 15346 - protein, 7 aa, synthetic construct
  REGION 1..7: note = Synthetic Construct
RSKARSK

SEQ ID NO: 15347 - protein, 7 aa, synthetic construct
  REGION 1..7: note = Synthetic Construct
RSKARTK

SEQ ID NO: 15348 - protein, 7 aa, synthetic construct
  REGION 1..7: note = Synthetic Construct
RSKARYK

SEQ ID NO: 15349 - protein, 7 aa, synthetic construct
  REGION 1..7: note = Synthetic Construct
RSKASAK

SEQ ID NO: 15350 - protein, 7 aa, synthetic construct
  REGION 1..7: note = Synthetic Construct
RSKASDK

SEQ ID NO: 15351 - protein, 7 aa, synthetic construct
  REGION 1..7: note = Synthetic Construct
RSKASEK

SEQ ID NO: 15352 - protein, 7 aa, synthetic construct
  REGION 1..7: note = Synthetic Construct
RSKASFK

SEQ ID NO: 15353 - protein, 7 aa, synthetic construct
  REGION 1..7: note = Synthetic Construct
RSKASGK

SEQ ID NO: 15354 - protein, 7 aa, synthetic construct
  REGION 1..7: note = Synthetic Construct
RSKASHK

SEQ ID NO: 15355 - protein, 7 aa, synthetic construct
  REGION 1..7: note = Synthetic Construct
RSKASIK

SEQ ID NO: 15356 - protein, 7 aa, synthetic construct
  REGION 1..7: note = Synthetic Construct
RSKASLK

SEQ ID NO: 15357 - protein, 7 aa, synthetic construct
  REGION 1..7: note = Synthetic Construct
RSKASNK

SEQ ID NO: 15358 - protein, 7 aa, synthetic construct
  REGION 1..7: note = Synthetic Construct
RSKASQK

SEQ ID NO: 15359 - protein, 7 aa, synthetic construct
  REGION 1..7: note = Synthetic Construct
RSKASRK

SEQ ID NO: 15360 - protein, 7 aa, synthetic construct
  REGION 1..7: note = Synthetic Construct
RSKASSK

SEQ ID NO: 15361 - protein, 7 aa, synthetic construct
  REGION 1..7: note = Synthetic Construct
RSKASTK

SEQ ID NO: 15362 - protein, 7 aa, synthetic construct
  REGION 1..7: note = Synthetic Construct
RSKASYK

SEQ ID NO: 15363 - protein, 7 aa, synthetic construct
  REGION 1..7: note = Synthetic Construct
RSKATAK

SEQ ID NO: 15364 - protein, 7 aa, synthetic construct
  REGION 1..7: note = Synthetic Construct
RSKATDK

SEQ ID NO: 15365 - protein, 7 aa, synthetic construct
  REGION 1..7: note = Synthetic Construct
RSKATEK

SEQ ID NO: 15366 - protein, 7 aa, synthetic construct
  REGION 1..7: note = Synthetic Construct
RSKATFK

SEQ ID NO: 15367 - protein, 7 aa, synthetic construct
  REGION 1..7: note = Synthetic Construct
RSKATGK

SEQ ID NO: 15368 - protein, 7 aa, synthetic construct
  REGION 1..7: note = Synthetic Construct
RSKATHK

SEQ ID NO: 15369 - protein, 7 aa, synthetic construct
  REGION 1..7: note = Synthetic Construct
RSKATIK

SEQ ID NO: 15370 - protein, 7 aa, synthetic construct
  REGION 1..7: note = Synthetic Construct
RSKATLK

SEQ ID NO: 15371 - protein, 7 aa, synthetic construct
  REGION 1..7: note = Synthetic Construct
RSKATNK

SEQ ID NO: 15372 - protein, 7 aa, synthetic construct
  REGION 1..7: note = Synthetic Construct
RSKATQK

SEQ ID NO: 15373 - protein, 7 aa, synthetic construct
  REGION 1..7: note = Synthetic Construct
RSKATRK

SEQ ID NO: 15374 - protein, 7 aa, synthetic construct
  REGION 1..7: note = Synthetic Construct
RSKATSK

SEQ ID NO: 15375 - protein, 7 aa, synthetic construct
  REGION 1..7: note = Synthetic Construct
RSKATTK

SEQ ID NO: 15376 - protein, 7 aa, synthetic construct
  REGION 1..7: note = Synthetic Construct
RSKATYK

SEQ ID NO: 15377 - protein, 7 aa, synthetic construct
  REGION 1..7: note = Synthetic Construct
RSKAYAK

SEQ ID NO: 15378 - protein, 7 aa, synthetic construct
  REGION 1..7: note = Synthetic Construct
RSKAYDK

SEQ ID NO: 15379 - protein, 7 aa, synthetic construct
  REGION 1..7: note = Synthetic Construct
RSKAYEK

SEQ ID NO: 15380 - protein, 7 aa, synthetic construct
  REGION 1..7: note = Synthetic Construct
RSKAYFK

SEQ ID NO: 15381 - protein, 7 aa, synthetic construct
  REGION 1..7: note = Synthetic Construct
RSKAYGK

SEQ ID NO: 15382 - protein, 7 aa, synthetic construct
  REGION 1..7: note = Synthetic Construct
RSKAYHK

SEQ ID NO: 15383 - protein, 7 aa, synthetic construct
  REGION 1..7: note = Synthetic Construct
RSKAYIK

SEQ ID NO: 15384 - protein, 7 aa, synthetic construct
  REGION 1..7: note = Synthetic Construct
RSKAYLK

SEQ ID NO: 15385 - protein, 7 aa, synthetic construct
  REGION 1..7: note = Synthetic Construct
RSKAYNK

SEQ ID NO: 15386 - protein, 7 aa, synthetic construct
  REGION 1..7: note = Synthetic Construct
RSKAYQK

SEQ ID NO: 15387 - protein, 7 aa, synthetic construct
  REGION 1..7: note = Synthetic Construct
RSKAYRK

SEQ ID NO: 15388 - protein, 7 aa, synthetic construct
  REGION 1..7: note = Synthetic Construct
RSKAYSK

SEQ ID NO: 15389 - protein, 7 aa, synthetic construct
  REGION 1..7: note = Synthetic Construct
RSKAYTK

SEQ ID NO: 15390 - protein, 7 aa, synthetic construct
  REGION 1..7: note = Synthetic Construct
RSKAYYK

SEQ ID NO: 15391 - protein, 7 aa, synthetic construct
  REGION 1..7: note = Synthetic Construct
RSKDAAK

SEQ ID NO: 15392 - protein, 7 aa, synthetic construct
  REGION 1..7: note = Synthetic Construct
RSKDADK

SEQ ID NO: 15393 - protein, 7 aa, synthetic construct
  REGION 1..7: note = Synthetic Construct
RSKDAEK

SEQ ID NO: 15394 - protein, 7 aa, synthetic construct
  REGION 1..7: note = Synthetic Construct
RSKDAFK

SEQ ID NO: 15395 - protein, 7 aa, synthetic construct
  REGION 1..7: note = Synthetic Construct
RSKDAGK

SEQ ID NO: 15396 - protein, 7 aa, synthetic construct
  REGION 1..7: note = Synthetic Construct
RSKDAHK

SEQ ID NO: 15397 - protein, 7 aa, synthetic construct
  REGION 1..7: note = Synthetic Construct
RSKDAIK

SEQ ID NO: 15398 - protein, 7 aa, synthetic construct
  REGION 1..7: note = Synthetic Construct
RSKDALK

SEQ ID NO: 15399 - protein, 7 aa, synthetic construct
  REGION 1..7: note = Synthetic Construct
RSKDANK

SEQ ID NO: 15400 - protein, 7 aa, synthetic construct
  REGION 1..7: note = Synthetic Construct
RSKDAQK

SEQ ID NO: 15401 - protein, 7 aa, synthetic construct
  REGION 1..7: note = Synthetic Construct
RSKDARK

SEQ ID NO: 15402 - protein, 7 aa, synthetic construct
  REGION 1..7: note = Synthetic Construct
RSKDASK

SEQ ID NO: 15403 - protein, 7 aa, synthetic construct
  REGION 1..7: note = Synthetic Construct
RSKDATK

SEQ ID NO: 15404 - protein, 7 aa, synthetic construct
  REGION 1..7: note = Synthetic Construct
RSKDAYK

SEQ ID NO: 15405 - protein, 7 aa, synthetic construct
  REGION 1..7: note = Synthetic Construct
RSKDDAK

SEQ ID NO: 15406 - protein, 7 aa, synthetic construct
  REGION 1..7: note = Synthetic Construct
RSKDDDK

SEQ ID NO: 15407 - protein, 7 aa, synthetic construct
  REGION 1..7: note = Synthetic Construct
RSKDDEK

SEQ ID NO: 15408 - protein, 7 aa, synthetic construct
  REGION 1..7: note = Synthetic Construct
RSKDDFK

SEQ ID NO: 15409 - protein, 7 aa, synthetic construct
  REGION 1..7: note = Synthetic Construct
RSKDDGK

SEQ ID NO: 15410 - protein, 7 aa, synthetic construct
  REGION 1..7: note = Synthetic Construct
RSKDDHK

SEQ ID NO: 15411 - protein, 7 aa, synthetic construct
  REGION 1..7: note = Synthetic Construct
RSKDDIK

SEQ ID NO: 15412 - protein, 7 aa, synthetic construct
  REGION 1..7: note = Synthetic Construct
RSKDDLK

SEQ ID NO: 15413 - protein, 7 aa, synthetic construct
  REGION 1..7: note = Synthetic Construct
RSKDDNK

SEQ ID NO: 15414 - protein, 7 aa, synthetic construct
  REGION 1..7: note = Synthetic Construct
RSKDDQK

SEQ ID NO: 15415 - protein, 7 aa, synthetic construct
  REGION 1..7: note = Synthetic Construct
RSKDDRK

SEQ ID NO: 15416 - protein, 7 aa, synthetic construct
  REGION 1..7: note = Synthetic Construct
RSKDDSK

SEQ ID NO: 15417 - protein, 7 aa, synthetic construct
  REGION 1..7: note = Synthetic Construct
RSKDDTK

SEQ ID NO: 15418 - protein, 7 aa, synthetic construct
  REGION 1..7: note = Synthetic Construct
RSKDDYK

SEQ ID NO: 15419 - protein, 7 aa, synthetic construct
  REGION 1..7: note = Synthetic Construct
RSKDEAK

SEQ ID NO: 15420 - protein, 7 aa, synthetic construct
  REGION 1..7: note = Synthetic Construct
RSKDEDK

SEQ ID NO: 15421 - protein, 7 aa, synthetic construct
  REGION 1..7: note = Synthetic Construct
RSKDEEK

SEQ ID NO: 15422 - protein, 7 aa, synthetic construct
  REGION 1..7: note = Synthetic Construct
RSKDEFK

SEQ ID NO: 15423 - protein, 7 aa, synthetic construct
  REGION 1..7: note = Synthetic Construct
RSKDEGK

SEQ ID NO: 15424 - protein, 7 aa, synthetic construct
  REGION 1..7: note = Synthetic Construct
RSKDEHK

SEQ ID NO: 15425 - protein, 7 aa, synthetic construct
  REGION 1..7: note = Synthetic Construct
RSKDEIK

SEQ ID NO: 15426 - protein, 7 aa, synthetic construct
  REGION 1..7: note = Synthetic Construct
RSKDELK

SEQ ID NO: 15427 - protein, 7 aa, synthetic construct
  REGION 1..7: note = Synthetic Construct
RSKDENK

SEQ ID NO: 15428 - protein, 7 aa, synthetic construct
  REGION 1..7: note = Synthetic Construct
RSKDEQK

SEQ ID NO: 15429 - protein, 7 aa, synthetic construct
  REGION 1..7: note = Synthetic Construct
RSKDERK

SEQ ID NO: 15430 - protein, 7 aa, synthetic construct
  REGION 1..7: note = Synthetic Construct
RSKDESK

SEQ ID NO: 15431 - protein, 7 aa, synthetic construct
  REGION 1..7: note = Synthetic Construct
RSKDETK

SEQ ID NO: 15432 - protein, 7 aa, synthetic construct
  REGION 1..7: note = Synthetic Construct
RSKDEYK

SEQ ID NO: 15433 - protein, 7 aa, synthetic construct
  REGION 1..7: note = Synthetic Construct
RSKDFAK

SEQ ID NO: 15434 - protein, 7 aa, synthetic construct
  REGION 1..7: note = Synthetic Construct
RSKDFDK

SEQ ID NO: 15435 - protein, 7 aa, synthetic construct
  REGION 1..7: note = Synthetic Construct
RSKDFEK

SEQ ID NO: 15436 - protein, 7 aa, synthetic construct
  REGION 1..7: note = Synthetic Construct
RSKDFFK

SEQ ID NO: 15437 - protein, 7 aa, synthetic construct
  REGION 1..7: note = Synthetic Construct
RSKDFGK

SEQ ID NO: 15438 - protein, 7 aa, synthetic construct
  REGION 1..7: note = Synthetic Construct
RSKDFHK

SEQ ID NO: 15439 - protein, 7 aa, synthetic construct
  REGION 1..7: note = Synthetic Construct
RSKDFIK

SEQ ID NO: 15440 - protein, 7 aa, synthetic construct
  REGION 1..7: note = Synthetic Construct
RSKDFLK

SEQ ID NO: 15441 - protein, 7 aa, synthetic construct
  REGION 1..7: note = Synthetic Construct
RSKDFNK

SEQ ID NO: 15442 - protein, 7 aa, synthetic construct
  REGION 1..7: note = Synthetic Construct
RSKDFQK

SEQ ID NO: 15443 - protein, 7 aa, synthetic construct
  REGION 1..7: note = Synthetic Construct
RSKDFRK

SEQ ID NO: 15444 - protein, 7 aa, synthetic construct
  REGION 1..7: note = Synthetic Construct
RSKDFSK

SEQ ID NO: 15445 - protein, 7 aa, synthetic construct
  REGION 1..7: note = Synthetic Construct
RSKDFTK

SEQ ID NO: 15446 - protein, 7 aa, synthetic construct
  REGION 1..7: note = Synthetic Construct
RSKDFYK

SEQ ID NO: 15447 - protein, 7 aa, synthetic construct
  REGION 1..7: note = Synthetic Construct
RSKDGAK

SEQ ID NO: 15448 - protein, 7 aa, synthetic construct
  REGION 1..7: note = Synthetic Construct
RSKDGDK

SEQ ID NO: 15449 - protein, 7 aa, synthetic construct
  REGION 1..7: note = Synthetic Construct
RSKDGEK

SEQ ID NO: 15450 - protein, 7 aa, synthetic construct
  REGION 1..7: note = Synthetic Construct
RSKDGFK

SEQ ID NO: 15451 - protein, 7 aa, synthetic construct
  REGION 1..7: note = Synthetic Construct
RSKDGGK

SEQ ID NO: 15452 - protein, 7 aa, synthetic construct
  REGION 1..7: note = Synthetic Construct
RSKDGHK

SEQ ID NO: 15453 - protein, 7 aa, synthetic construct
  REGION 1..7: note = Synthetic Construct
RSKDGIK

SEQ ID NO: 15454 - protein, 7 aa, synthetic construct
  REGION 1..7: note = Synthetic Construct
RSKDGLK

SEQ ID NO: 15455 - protein, 7 aa, synthetic construct
  REGION 1..7: note = Synthetic Construct
RSKDGNK

SEQ ID NO: 15456 - protein, 7 aa, synthetic construct
  REGION 1..7: note = Synthetic Construct
RSKDGQK

SEQ ID NO: 15457 - protein, 7 aa, synthetic construct
  REGION 1..7: note = Synthetic Construct
RSKDGRK

SEQ ID NO: 15458 - protein, 7 aa, synthetic construct
  REGION 1..7: note = Synthetic Construct
RSKDGSK

SEQ ID NO: 15459 - protein, 7 aa, synthetic construct
  REGION 1..7: note = Synthetic Construct
RSKDGTK

SEQ ID NO: 15460 - protein, 7 aa, synthetic construct
  REGION 1..7: note = Synthetic Construct
RSKDGYK

SEQ ID NO: 15461 - protein, 7 aa, synthetic construct
  REGION 1..7: note = Synthetic Construct
RSKDHAK

SEQ ID NO: 15462 - protein, 7 aa, synthetic construct
  REGION 1..7: note = Synthetic Construct
RSKDHDK

SEQ ID NO: 15463 - protein, 7 aa, synthetic construct
  REGION 1..7: note = Synthetic Construct
RSKDHEK

SEQ ID NO: 15464 - protein, 7 aa, synthetic construct
  REGION 1..7: note = Synthetic Construct
RSKDHFK

SEQ ID NO: 15465 - protein, 7 aa, synthetic construct
  REGION 1..7: note = Synthetic Construct
RSKDHGK

SEQ ID NO: 15466 - protein, 7 aa, synthetic construct
  REGION 1..7: note = Synthetic Construct
RSKDHHK

SEQ ID NO: 15467 - protein, 7 aa, synthetic construct
  REGION 1..7: note = Synthetic Construct
RSKDHIK

SEQ ID NO: 15468 - protein, 7 aa, synthetic construct
  REGION 1..7: note = Synthetic Construct
RSKDHLK

SEQ ID NO: 15469 - protein, 7 aa, synthetic construct
  REGION 1..7: note = Synthetic Construct
RSKDHNK

SEQ ID NO: 15470 - protein, 7 aa, synthetic construct
  REGION 1..7: note = Synthetic Construct
RSKDHQK

SEQ ID NO: 15471 - protein, 7 aa, synthetic construct
  REGION 1..7: note = Synthetic Construct
RSKDHRK

SEQ ID NO: 15472 - protein, 7 aa, synthetic construct
  REGION 1..7: note = Synthetic Construct
RSKDHSK

SEQ ID NO: 15473 - protein, 7 aa, synthetic construct
  REGION 1..7: note = Synthetic Construct
RSKDHTK

SEQ ID NO: 15474 - protein, 7 aa, synthetic construct
  REGION 1..7: note = Synthetic Construct
RSKDHYK

SEQ ID NO: 15475 - protein, 7 aa, synthetic construct
  REGION 1..7: note = Synthetic Construct
RSKDIAK

SEQ ID NO: 15476 - protein, 7 aa, synthetic construct
  REGION 1..7: note = Synthetic Construct
RSKDIDK

SEQ ID NO: 15477 - protein, 7 aa, synthetic construct
  REGION 1..7: note = Synthetic Construct
RSKDIEK

SEQ ID NO: 15478 - protein, 7 aa, synthetic construct
  REGION 1..7: note = Synthetic Construct
RSKDIFK

SEQ ID NO: 15479 - protein, 7 aa, synthetic construct
  REGION 1..7: note = Synthetic Construct
RSKDIGK

SEQ ID NO: 15480 - protein, 7 aa, synthetic construct
  REGION 1..7: note = Synthetic Construct
RSKDIHK

SEQ ID NO: 15481 - protein, 7 aa, synthetic construct
  REGION 1..7: note = Synthetic Construct
RSKDIIK

SEQ ID NO: 15482 - protein, 7 aa, synthetic construct
  REGION 1..7: note = Synthetic Construct
RSKDILK

SEQ ID NO: 15483 - protein, 7 aa, synthetic construct
  REGION 1..7: note = Synthetic Construct
RSKDINK

SEQ ID NO: 15484 - protein, 7 aa, synthetic construct
  REGION 1..7: note = Synthetic Construct
RSKDIQK

SEQ ID NO: 15485 - protein, 7 aa, synthetic construct
  REGION 1..7: note = Synthetic Construct
RSKDIRK

SEQ ID NO: 15486 - protein, 7 aa, synthetic construct
  REGION 1..7: note = Synthetic Construct
RSKDISK

SEQ ID NO: 15487 - protein, 7 aa, synthetic construct
  REGION 1..7: note = Synthetic Construct
RSKDITK

SEQ ID NO: 15488 - protein, 7 aa, synthetic construct
  REGION 1..7: note = Synthetic Construct
RSKDIYK

SEQ ID NO: 15489 - protein, 7 aa, synthetic construct
  REGION 1..7: note = Synthetic Construct
RSKDLAK

SEQ ID NO: 15490 - protein, 7 aa, synthetic construct
  REGION 1..7: note = Synthetic Construct
RSKDLDK

SEQ ID NO: 15491 - protein, 7 aa, synthetic construct
  REGION 1..7: note = Synthetic Construct
RSKDLEK

SEQ ID NO: 15492 - protein, 7 aa, synthetic construct
  REGION 1..7: note = Synthetic Construct
RSKDLFK

SEQ ID NO: 15493 - protein, 7 aa, synthetic construct
  REGION 1..7: note = Synthetic Construct
RSKDLGK

SEQ ID NO: 15494 - protein, 7 aa, synthetic construct
  REGION 1..7: note = Synthetic Construct
RSKDLHK

SEQ ID NO: 15495 - protein, 7 aa, synthetic construct
  REGION 1..7: note = Synthetic Construct
RSKDLIK

SEQ ID NO: 15496 - protein, 7 aa, synthetic construct
  REGION 1..7: note = Synthetic Construct
RSKDLLK

SEQ ID NO: 15497 - protein, 7 aa, synthetic construct
  REGION 1..7: note = Synthetic Construct
RSKDLNK

SEQ ID NO: 15498 - protein, 7 aa, synthetic construct
  REGION 1..7: note = Synthetic Construct
RSKDLQK

SEQ ID NO: 15499 - protein, 7 aa, synthetic construct
  REGION 1..7: note = Synthetic Construct
RSKDLRK

SEQ ID NO: 15500 - protein, 7 aa, synthetic construct
  REGION 1..7: note = Synthetic Construct
RSKDLSK

SEQ ID NO: 15501 - protein, 7 aa, synthetic construct
  REGION 1..7: note = Synthetic Construct
RSKDLTK

SEQ ID NO: 15502 - protein, 7 aa, synthetic construct
  REGION 1..7: note = Synthetic Construct
RSKDLYK

SEQ ID NO: 15503 - protein, 7 aa, synthetic construct
  REGION 1..7: note = Synthetic Construct
RSKDNAK

SEQ ID NO: 15504 - protein, 7 aa, synthetic construct
  REGION 1..7: note = Synthetic Construct
RSKDNDK

SEQ ID NO: 15505 - protein, 7 aa, synthetic construct
  REGION 1..7: note = Synthetic Construct
RSKDNEK

SEQ ID NO: 15506 - protein, 7 aa, synthetic construct
  REGION 1..7: note = Synthetic Construct
RSKDNFK

SEQ ID NO: 15507 - protein, 7 aa, synthetic construct
  REGION 1..7: note = Synthetic Construct
RSKDNGK

SEQ ID NO: 15508 - protein, 7 aa, synthetic construct
  REGION 1..7: note = Synthetic Construct
RSKDNHK

SEQ ID NO: 15509 - protein, 7 aa, synthetic construct
  REGION 1..7: note = Synthetic Construct
RSKDNIK

SEQ ID NO: 15510 - protein, 7 aa, synthetic construct
  REGION 1..7: note = Synthetic Construct
RSKDNLK

SEQ ID NO: 15511 - protein, 7 aa, synthetic construct
  REGION 1..7: note = Synthetic Construct
RSKDNNK

SEQ ID NO: 15512 - protein, 7 aa, synthetic construct
  REGION 1..7: note = Synthetic Construct
RSKDNQK

SEQ ID NO: 15513 - protein, 7 aa, synthetic construct
  REGION 1..7: note = Synthetic Construct
RSKDNRK

SEQ ID NO: 15514 - protein, 7 aa, synthetic construct
  REGION 1..7: note = Synthetic Construct
RSKDNSK

SEQ ID NO: 15515 - protein, 7 aa, synthetic construct
  REGION 1..7: note = Synthetic Construct
RSKDNTK

SEQ ID NO: 15516 - protein, 7 aa, synthetic construct
  REGION 1..7: note = Synthetic Construct
RSKDNYK

SEQ ID NO: 15517 - protein, 7 aa, synthetic construct
  REGION 1..7: note = Synthetic Construct
RSKDQAK

SEQ ID NO: 15518 - protein, 7 aa, synthetic construct
  REGION 1..7: note = Synthetic Construct
RSKDQDK

SEQ ID NO: 15519 - protein, 7 aa, synthetic construct
  REGION 1..7: note = Synthetic Construct
RSKDQEK

SEQ ID NO: 15520 - protein, 7 aa, synthetic construct
  REGION 1..7: note = Synthetic Construct
RSKDQFK

SEQ ID NO: 15521 - protein, 7 aa, synthetic construct
  REGION 1..7: note = Synthetic Construct
RSKDQGK

SEQ ID NO: 15522 - protein, 7 aa, synthetic construct
  REGION 1..7: note = Synthetic Construct
RSKDQHK

SEQ ID NO: 15523 - protein, 7 aa, synthetic construct
  REGION 1..7: note = Synthetic Construct
RSKDQIK

SEQ ID NO: 15524 - protein, 7 aa, synthetic construct
  REGION 1..7: note = Synthetic Construct
RSKDQLK

SEQ ID NO: 15525 - protein, 7 aa, synthetic construct
  REGION 1..7: note = Synthetic Construct
RSKDQNK

SEQ ID NO: 15526 - protein, 7 aa, synthetic construct
  REGION 1..7: note = Synthetic Construct
RSKDQQK

SEQ ID NO: 15527 - protein, 7 aa, synthetic construct
  REGION 1..7: note = Synthetic Construct
RSKDQRK

SEQ ID NO: 15528 - protein, 7 aa, synthetic construct
  REGION 1..7: note = Synthetic Construct
RSKDQSK

SEQ ID NO: 15529 - protein, 7 aa, synthetic construct
  REGION 1..7: note = Synthetic Construct
RSKDQTK

SEQ ID NO: 15530 - protein, 7 aa, synthetic construct
  REGION 1..7: note = Synthetic Construct
RSKDQYK

SEQ ID NO: 15531 - protein, 7 aa, synthetic construct
  REGION 1..7: note = Synthetic Construct
RSKDRAK

SEQ ID NO: 15532 - protein, 7 aa, synthetic construct
  REGION 1..7: note = Synthetic Construct
RSKDRDK

SEQ ID NO: 15533 - protein, 7 aa, synthetic construct
  REGION 1..7: note = Synthetic Construct
RSKDREK

SEQ ID NO: 15534 - protein, 7 aa, synthetic construct
  REGION 1..7: note = Synthetic Construct
RSKDRFK

SEQ ID NO: 15535 - protein, 7 aa, synthetic construct
  REGION 1..7: note = Synthetic Construct
RSKDRGK

SEQ ID NO: 15536 - protein, 7 aa, synthetic construct
  REGION 1..7: note = Synthetic Construct
RSKDRHK

SEQ ID NO: 15537 - protein, 7 aa, synthetic construct
  REGION 1..7: note = Synthetic Construct
RSKDRIK

SEQ ID NO: 15538 - protein, 7 aa, synthetic construct
  REGION 1..7: note = Synthetic Construct
RSKDRLK

SEQ ID NO: 15539 - protein, 7 aa, synthetic construct
  REGION 1..7: note = Synthetic Construct
RSKDRNK

SEQ ID NO: 15540 - protein, 7 aa, synthetic construct
  REGION 1..7: note = Synthetic Construct
RSKDRQK

SEQ ID NO: 15541 - protein, 7 aa, synthetic construct
  REGION 1..7: note = Synthetic Construct
RSKDRRK

SEQ ID NO: 15542 - protein, 7 aa, synthetic construct
  REGION 1..7: note = Synthetic Construct
RSKDRSK

SEQ ID NO: 15543 - protein, 7 aa, synthetic construct
  REGION 1..7: note = Synthetic Construct
RSKDRTK

SEQ ID NO: 15544 - protein, 7 aa, synthetic construct
  REGION 1..7: note = Synthetic Construct
RSKDRYK

SEQ ID NO: 15545 - protein, 7 aa, synthetic construct
  REGION 1..7: note = Synthetic Construct
RSKDSAK

SEQ ID NO: 15546 - protein, 7 aa, synthetic construct
  REGION 1..7: note = Synthetic Construct
RSKDSDK

SEQ ID NO: 15547 - protein, 7 aa, synthetic construct
  REGION 1..7: note = Synthetic Construct
RSKDSEK

SEQ ID NO: 15548 - protein, 7 aa, synthetic construct
  REGION 1..7: note = Synthetic Construct
RSKDSFK

SEQ ID NO: 15549 - protein, 7 aa, synthetic construct
  REGION 1..7: note = Synthetic Construct
RSKDSGK

SEQ ID NO: 15550 - protein, 7 aa, synthetic construct
  REGION 1..7: note = Synthetic Construct
RSKDSHK

SEQ ID NO: 15551 - protein, 7 aa, synthetic construct
  REGION 1..7: note = Synthetic Construct
RSKDSIK

SEQ ID NO: 15552 - protein, 7 aa, synthetic construct
  REGION 1..7: note = Synthetic Construct
RSKDSLK

SEQ ID NO: 15553 - protein, 7 aa, synthetic construct
  REGION 1..7: note = Synthetic Construct
RSKDSNK

SEQ ID NO: 15554 - protein, 7 aa, synthetic construct
  REGION 1..7: note = Synthetic Construct
RSKDSQK

SEQ ID NO: 15555 - protein, 7 aa, synthetic construct
  REGION 1..7: note = Synthetic Construct
RSKDSRK

SEQ ID NO: 15556 - protein, 7 aa, synthetic construct
  REGION 1..7: note = Synthetic Construct
RSKDSSK

SEQ ID NO: 15557 - protein, 7 aa, synthetic construct
  REGION 1..7: note = Synthetic Construct
RSKDSTK

SEQ ID NO: 15558 - protein, 7 aa, synthetic construct
  REGION 1..7: note = Synthetic Construct
RSKDSYK

SEQ ID NO: 15559 - protein, 7 aa, synthetic construct
  REGION 1..7: note = Synthetic Construct
RSKDTAK

SEQ ID NO: 15560 - protein, 7 aa, synthetic construct
  REGION 1..7: note = Synthetic Construct
RSKDTDK

SEQ ID NO: 15561 - protein, 7 aa, synthetic construct
  REGION 1..7: note = Synthetic Construct
RSKDTEK

SEQ ID NO: 15562 - protein, 7 aa, synthetic construct
  REGION 1..7: note = Synthetic Construct
RSKDTFK

SEQ ID NO: 15563 - protein, 7 aa, synthetic construct
  REGION 1..7: note = Synthetic Construct
RSKDTGK

SEQ ID NO: 15564 - protein, 7 aa, synthetic construct
  REGION 1..7: note = Synthetic Construct
RSKDTHK

SEQ ID NO: 15565 - protein, 7 aa, synthetic construct
  REGION 1..7: note = Synthetic Construct
RSKDTIK

SEQ ID NO: 15566 - protein, 7 aa, synthetic construct
  REGION 1..7: note = Synthetic Construct
RSKDTLK

SEQ ID NO: 15567 - protein, 7 aa, synthetic construct
  REGION 1..7: note = Synthetic Construct
RSKDTNK

SEQ ID NO: 15568 - protein, 7 aa, synthetic construct
  REGION 1..7: note = Synthetic Construct
RSKDTQK

SEQ ID NO: 15569 - protein, 7 aa, synthetic construct
  REGION 1..7: note = Synthetic Construct
RSKDTRK

SEQ ID NO: 15570 - protein, 7 aa, synthetic construct
  REGION 1..7: note = Synthetic Construct
RSKDTSK

SEQ ID NO: 15571 - protein, 7 aa, synthetic construct
  REGION 1..7: note = Synthetic Construct
RSKDTTK

SEQ ID NO: 15572 - protein, 7 aa, synthetic construct
  REGION 1..7: note = Synthetic Construct
RSKDTYK

SEQ ID NO: 15573 - protein, 7 aa, synthetic construct
  REGION 1..7: note = Synthetic Construct
RSKDYAK

SEQ ID NO: 15574 - protein, 7 aa, synthetic construct
  REGION 1..7: note = Synthetic Construct
RSKDYDK

SEQ ID NO: 15575 - protein, 7 aa, synthetic construct
  REGION 1..7: note = Synthetic Construct
RSKDYEK

SEQ ID NO: 15576 - protein, 7 aa, synthetic construct
  REGION 1..7: note = Synthetic Construct
RSKDYFK

SEQ ID NO: 15577 - protein, 7 aa, synthetic construct
  REGION 1..7: note = Synthetic Construct
RSKDYGK

SEQ ID NO: 15578 - protein, 7 aa, synthetic construct
  REGION 1..7: note = Synthetic Construct
RSKDYHK

SEQ ID NO: 15579 - protein, 7 aa, synthetic construct
  REGION 1..7: note = Synthetic Construct
RSKDYIK

SEQ ID NO: 15580 - protein, 7 aa, synthetic construct
  REGION 1..7: note = Synthetic Construct
RSKDYLK

SEQ ID NO: 15581 - protein, 7 aa, synthetic construct
  REGION 1..7: note = Synthetic Construct
RSKDYNK

SEQ ID NO: 15582 - protein, 7 aa, synthetic construct
  REGION 1..7: note = Synthetic Construct
RSKDYQK

SEQ ID NO: 15583 - protein, 7 aa, synthetic construct
  REGION 1..7: note = Synthetic Construct
RSKDYRK

SEQ ID NO: 15584 - protein, 7 aa, synthetic construct
  REGION 1..7: note = Synthetic Construct
RSKDYSK

SEQ ID NO: 15585 - protein, 7 aa, synthetic construct
  REGION 1..7: note = Synthetic Construct
RSKDYTK

SEQ ID NO: 15586 - protein, 7 aa, synthetic construct
  REGION 1..7: note = Synthetic Construct
RSKDYYK

SEQ ID NO: 15587 - protein, 7 aa, synthetic construct
  REGION 1..7: note = Synthetic Construct
RSKEAAK

SEQ ID NO: 15588 - protein, 7 aa, synthetic construct
  REGION 1..7: note = Synthetic Construct
RSKEADK

SEQ ID NO: 15589 - protein, 7 aa, synthetic construct
  REGION 1..7: note = Synthetic Construct
RSKEAEK

SEQ ID NO: 15590 - protein, 7 aa, synthetic construct
  REGION 1..7: note = Synthetic Construct
RSKEAFK

SEQ ID NO: 15591 - protein, 7 aa, synthetic construct
  REGION 1..7: note = Synthetic Construct
RSKEAGK

SEQ ID NO: 15592 - protein, 7 aa, synthetic construct
  REGION 1..7: note = Synthetic Construct
RSKEAHK

SEQ ID NO: 15593 - protein, 7 aa, synthetic construct
  REGION 1..7: note = Synthetic Construct
RSKEAIK

SEQ ID NO: 15594 - protein, 7 aa, synthetic construct
  REGION 1..7: note = Synthetic Construct
RSKEALK

SEQ ID NO: 15595 - protein, 7 aa, synthetic construct
  REGION 1..7: note = Synthetic Construct
RSKEANK

SEQ ID NO: 15596 - protein, 7 aa, synthetic construct
  REGION 1..7: note = Synthetic Construct
RSKEAQK

SEQ ID NO: 15597 - protein, 7 aa, synthetic construct
  REGION 1..7: note = Synthetic Construct
RSKEARK

SEQ ID NO: 15598 - protein, 7 aa, synthetic construct
  REGION 1..7: note = Synthetic Construct
RSKEASK

SEQ ID NO: 15599 - protein, 7 aa, synthetic construct
  REGION 1..7: note = Synthetic Construct
RSKEATK

SEQ ID NO: 15600 - protein, 7 aa, synthetic construct
  REGION 1..7: note = Synthetic Construct
RSKEAYK

SEQ ID NO: 15601 - protein, 7 aa, synthetic construct
  REGION 1..7: note = Synthetic Construct
RSKEDAK

SEQ ID NO: 15602 - protein, 7 aa, synthetic construct
  REGION 1..7: note = Synthetic Construct
RSKEDDK

SEQ ID NO: 15603 - protein, 7 aa, synthetic construct
  REGION 1..7: note = Synthetic Construct
RSKEDEK

SEQ ID NO: 15604 - protein, 7 aa, synthetic construct
  REGION 1..7: note = Synthetic Construct
RSKEDFK

SEQ ID NO: 15605 - protein, 7 aa, synthetic construct
  REGION 1..7: note = Synthetic Construct
RSKEDGK

SEQ ID NO: 15606 - protein, 7 aa, synthetic construct
  REGION 1..7: note = Synthetic Construct
RSKEDHK

SEQ ID NO: 15607 - protein, 7 aa, synthetic construct
  REGION 1..7: note = Synthetic Construct
RSKEDIK

SEQ ID NO: 15608 - protein, 7 aa, synthetic construct
  REGION 1..7: note = Synthetic Construct
RSKEDLK

SEQ ID NO: 15609 - protein, 7 aa, synthetic construct
  REGION 1..7: note = Synthetic Construct
RSKEDNK

SEQ ID NO: 15610 - protein, 7 aa, synthetic construct
  REGION 1..7: note = Synthetic Construct
RSKEDQK

SEQ ID NO: 15611 - protein, 7 aa, synthetic construct
  REGION 1..7: note = Synthetic Construct
RSKEDRK

SEQ ID NO: 15612 - protein, 7 aa, synthetic construct
  REGION 1..7: note = Synthetic Construct
RSKEDSK

SEQ ID NO: 15613 - protein, 7 aa, synthetic construct
  REGION 1..7: note = Synthetic Construct
RSKEDTK

SEQ ID NO: 15614 - protein, 7 aa, synthetic construct
  REGION 1..7: note = Synthetic Construct
RSKEDYK

SEQ ID NO: 15615 - protein, 7 aa, synthetic construct
  REGION 1..7: note = Synthetic Construct
RSKEEAK

SEQ ID NO: 15616 - protein, 7 aa, synthetic construct
  REGION 1..7: note = Synthetic Construct
RSKEEDK

SEQ ID NO: 15617 - protein, 7 aa, synthetic construct
  REGION 1..7: note = Synthetic Construct
RSKEEEK

SEQ ID NO: 15618 - protein, 7 aa, synthetic construct
  REGION 1..7: note = Synthetic Construct
RSKEEFK

SEQ ID NO: 15619 - protein, 7 aa, synthetic construct
  REGION 1..7: note = Synthetic Construct
RSKEEGK

SEQ ID NO: 15620 - protein, 7 aa, synthetic construct
  REGION 1..7: note = Synthetic Construct
RSKEEHK

SEQ ID NO: 15621 - protein, 7 aa, synthetic construct
  REGION 1..7: note = Synthetic Construct
RSKEEIK

SEQ ID NO: 15622 - protein, 7 aa, synthetic construct
  REGION 1..7: note = Synthetic Construct
RSKEELK

SEQ ID NO: 15623 - protein, 7 aa, synthetic construct
  REGION 1..7: note = Synthetic Construct
RSKEENK

SEQ ID NO: 15624 - protein, 7 aa, synthetic construct
  REGION 1..7: note = Synthetic Construct
RSKEEQK

SEQ ID NO: 15625 - protein, 7 aa, synthetic construct
  REGION 1..7: note = Synthetic Construct
RSKEERK

SEQ ID NO: 15626 - protein, 7 aa, synthetic construct
  REGION 1..7: note = Synthetic Construct
RSKEESK

SEQ ID NO: 15627 - protein, 7 aa, synthetic construct
  REGION 1..7: note = Synthetic Construct
RSKEETK

SEQ ID NO: 15628 - protein, 7 aa, synthetic construct
  REGION 1..7: note = Synthetic Construct
RSKEEYK

SEQ ID NO: 15629 - protein, 7 aa, synthetic construct
  REGION 1..7: note = Synthetic Construct
RSKEFAK

SEQ ID NO: 15630 - protein, 7 aa, synthetic construct
  REGION 1..7: note = Synthetic Construct
RSKEFDK

SEQ ID NO: 15631 - protein, 7 aa, synthetic construct
  REGION 1..7: note = Synthetic Construct
RSKEFEK

SEQ ID NO: 15632 - protein, 7 aa, synthetic construct
  REGION 1..7: note = Synthetic Construct
RSKEFFK

SEQ ID NO: 15633 - protein, 7 aa, synthetic construct
  REGION 1..7: note = Synthetic Construct
RSKEFGK

SEQ ID NO: 15634 - protein, 7 aa, synthetic construct
  REGION 1..7: note = Synthetic Construct
RSKEFHK

SEQ ID NO: 15635 - protein, 7 aa, synthetic construct
  REGION 1..7: note = Synthetic Construct
RSKEFIK

SEQ ID NO: 15636 - protein, 7 aa, synthetic construct
  REGION 1..7: note = Synthetic Construct
RSKEFLK

SEQ ID NO: 15637 - protein, 7 aa, synthetic construct
  REGION 1..7: note = Synthetic Construct
RSKEFNK

SEQ ID NO: 15638 - protein, 7 aa, synthetic construct
  REGION 1..7: note = Synthetic Construct
RSKEFQK

SEQ ID NO: 15639 - protein, 7 aa, synthetic construct
  REGION 1..7: note = Synthetic Construct
RSKEFRK

SEQ ID NO: 15640 - protein, 7 aa, synthetic construct
  REGION 1..7: note = Synthetic Construct
RSKEFSK

SEQ ID NO: 15641 - protein, 7 aa, synthetic construct
  REGION 1..7: note = Synthetic Construct
RSKEFTK

SEQ ID NO: 15642 - protein, 7 aa, synthetic construct
  REGION 1..7: note = Synthetic Construct
RSKEFYK

SEQ ID NO: 15643 - protein, 7 aa, synthetic construct
  REGION 1..7: note = Synthetic Construct
RSKEGAK

SEQ ID NO: 15644 - protein, 7 aa, synthetic construct
  REGION 1..7: note = Synthetic Construct
RSKEGDK

SEQ ID NO: 15645 - protein, 7 aa, synthetic construct
  REGION 1..7: note = Synthetic Construct
RSKEGEK

SEQ ID NO: 15646 - protein, 7 aa, synthetic construct
  REGION 1..7: note = Synthetic Construct
RSKEGFK

SEQ ID NO: 15647 - protein, 7 aa, synthetic construct
  REGION 1..7: note = Synthetic Construct
RSKEGGK

SEQ ID NO: 15648 - protein, 7 aa, synthetic construct
  REGION 1..7: note = Synthetic Construct
RSKEGHK

SEQ ID NO: 15649 - protein, 7 aa, synthetic construct
  REGION 1..7: note = Synthetic Construct
RSKEGIK

SEQ ID NO: 15650 - protein, 7 aa, synthetic construct
  REGION 1..7: note = Synthetic Construct
RSKEGLK

SEQ ID NO: 15651 - protein, 7 aa, synthetic construct
  REGION 1..7: note = Synthetic Construct
RSKEGNK

SEQ ID NO: 15652 - protein, 7 aa, synthetic construct
  REGION 1..7: note = Synthetic Construct
RSKEGQK

SEQ ID NO: 15653 - protein, 7 aa, synthetic construct
  REGION 1..7: note = Synthetic Construct
RSKEGRK

SEQ ID NO: 15654 - protein, 7 aa, synthetic construct
  REGION 1..7: note = Synthetic Construct
RSKEGSK

SEQ ID NO: 15655 - protein, 7 aa, synthetic construct
  REGION 1..7: note = Synthetic Construct
RSKEGTK

SEQ ID NO: 15656 - protein, 7 aa, synthetic construct
  REGION 1..7: note = Synthetic Construct
RSKEGYK

SEQ ID NO: 15657 - protein, 7 aa, synthetic construct
  REGION 1..7: note = Synthetic Construct
RSKEHAK

SEQ ID NO: 15658 - protein, 7 aa, synthetic construct
  REGION 1..7: note = Synthetic Construct
RSKEHDK

SEQ ID NO: 15659 - protein, 7 aa, synthetic construct
  REGION 1..7: note = Synthetic Construct
RSKEHEK

SEQ ID NO: 15660 - protein, 7 aa, synthetic construct
  REGION 1..7: note = Synthetic Construct
RSKEHFK

SEQ ID NO: 15661 - protein, 7 aa, synthetic construct
  REGION 1..7: note = Synthetic Construct
RSKEHGK

SEQ ID NO: 15662 - protein, 7 aa, synthetic construct
  REGION 1..7: note = Synthetic Construct
RSKEHHK

SEQ ID NO: 15663 - protein, 7 aa, synthetic construct
  REGION 1..7: note = Synthetic Construct
RSKEHIK

SEQ ID NO: 15664 - protein, 7 aa, synthetic construct
  REGION 1..7: note = Synthetic Construct
RSKEHLK

SEQ ID NO: 15665 - protein, 7 aa, synthetic construct
  REGION 1..7: note = Synthetic Construct
RSKEHNK

SEQ ID NO: 15666 - protein, 7 aa, synthetic construct
  REGION 1..7: note = Synthetic Construct
RSKEHQK

SEQ ID NO: 15667 - protein, 7 aa, synthetic construct
  REGION 1..7: note = Synthetic Construct
RSKEHRK

SEQ ID NO: 15668 - protein, 7 aa, synthetic construct
  REGION 1..7: note = Synthetic Construct
RSKEHSK

SEQ ID NO: 15669 - protein, 7 aa, synthetic construct
  REGION 1..7: note = Synthetic Construct
RSKEHTK

SEQ ID NO: 15670 - protein, 7 aa, synthetic construct
  REGION 1..7: note = Synthetic Construct
RSKEHYK

SEQ ID NO: 15671 - protein, 7 aa, synthetic construct
  REGION 1..7: note = Synthetic Construct
RSKEIAK

SEQ ID NO: 15672 - protein, 7 aa, synthetic construct
  REGION 1..7: note = Synthetic Construct
RSKEIDK

SEQ ID NO: 15673 - protein, 7 aa, synthetic construct
  REGION 1..7: note = Synthetic Construct
RSKEIEK

SEQ ID NO: 15674 - protein, 7 aa, synthetic construct
  REGION 1..7: note = Synthetic Construct
RSKEIFK

SEQ ID NO: 15675 - protein, 7 aa, synthetic construct
  REGION 1..7: note = Synthetic Construct
RSKEIGK

SEQ ID NO: 15676 - protein, 7 aa, synthetic construct
  REGION 1..7: note = Synthetic Construct
RSKEIHK

SEQ ID NO: 15677 - protein, 7 aa, synthetic construct
  REGION 1..7: note = Synthetic Construct
RSKEIIK

SEQ ID NO: 15678 - protein, 7 aa, synthetic construct
  REGION 1..7: note = Synthetic Construct
RSKEILK

SEQ ID NO: 15679 - protein, 7 aa, synthetic construct
  REGION 1..7: note = Synthetic Construct
RSKEINK

SEQ ID NO: 15680 - protein, 7 aa, synthetic construct
  REGION 1..7: note = Synthetic Construct
RSKEIQK

SEQ ID NO: 15681 - protein, 7 aa, synthetic construct
  REGION 1..7: note = Synthetic Construct
RSKEIRK

SEQ ID NO: 15682 - protein, 7 aa, synthetic construct
  REGION 1..7: note = Synthetic Construct
RSKEISK

SEQ ID NO: 15683 - protein, 7 aa, synthetic construct
  REGION 1..7: note = Synthetic Construct
RSKEITK

SEQ ID NO: 15684 - protein, 7 aa, synthetic construct
  REGION 1..7: note = Synthetic Construct
RSKEIYK

SEQ ID NO: 15685 - protein, 7 aa, synthetic construct
  REGION 1..7: note = Synthetic Construct
RSKELAK

SEQ ID NO: 15686 - protein, 7 aa, synthetic construct
  REGION 1..7: note = Synthetic Construct
RSKELDK

SEQ ID NO: 15687 - protein, 7 aa, synthetic construct
  REGION 1..7: note = Synthetic Construct
RSKELEK

SEQ ID NO: 15688 - protein, 7 aa, synthetic construct
  REGION 1..7: note = Synthetic Construct
RSKELFK

SEQ ID NO: 15689 - protein, 7 aa, synthetic construct
  REGION 1..7: note = Synthetic Construct
RSKELGK

SEQ ID NO: 15690 - protein, 7 aa, synthetic construct
  REGION 1..7: note = Synthetic Construct
RSKELHK

SEQ ID NO: 15691 - protein, 7 aa, synthetic construct
  REGION 1..7: note = Synthetic Construct
RSKELIK

SEQ ID NO: 15692 - protein, 7 aa, synthetic construct
  REGION 1..7: note = Synthetic Construct
RSKELLK

SEQ ID NO: 15693 - protein, 7 aa, synthetic construct
  REGION 1..7: note = Synthetic Construct
RSKELNK

SEQ ID NO: 15694 - protein, 7 aa, synthetic construct
  REGION 1..7: note = Synthetic Construct
RSKELQK

SEQ ID NO: 15695 - protein, 7 aa, synthetic construct
  REGION 1..7: note = Synthetic Construct
RSKELRK

SEQ ID NO: 15696 - protein, 7 aa, synthetic construct
  REGION 1..7: note = Synthetic Construct
RSKELSK

SEQ ID NO: 15697 - protein, 7 aa, synthetic construct
  REGION 1..7: note = Synthetic Construct
RSKELTK

SEQ ID NO: 15698 - protein, 7 aa, synthetic construct
  REGION 1..7: note = Synthetic Construct
RSKELYK

SEQ ID NO: 15699 - protein, 7 aa, synthetic construct
  REGION 1..7: note = Synthetic Construct
RSKENAK

SEQ ID NO: 15700 - protein, 7 aa, synthetic construct
  REGION 1..7: note = Synthetic Construct
RSKENDK

SEQ ID NO: 15701 - protein, 7 aa, synthetic construct
  REGION 1..7: note = Synthetic Construct
RSKENEK

SEQ ID NO: 15702 - protein, 7 aa, synthetic construct
  REGION 1..7: note = Synthetic Construct
RSKENFK

SEQ ID NO: 15703 - protein, 7 aa, synthetic construct
  REGION 1..7: note = Synthetic Construct
RSKENGK

SEQ ID NO: 15704 - protein, 7 aa, synthetic construct
  REGION 1..7: note = Synthetic Construct
RSKENHK

SEQ ID NO: 15705 - protein, 7 aa, synthetic construct
  REGION 1..7: note = Synthetic Construct
RSKENIK

SEQ ID NO: 15706 - protein, 7 aa, synthetic construct
  REGION 1..7: note = Synthetic Construct
RSKENLK

SEQ ID NO: 15707 - protein, 7 aa, synthetic construct
  REGION 1..7: note = Synthetic Construct
RSKENNK

SEQ ID NO: 15708 - protein, 7 aa, synthetic construct
  REGION 1..7: note = Synthetic Construct
RSKENQK

SEQ ID NO: 15709 - protein, 7 aa, synthetic construct
  REGION 1..7: note = Synthetic Construct
RSKENRK

SEQ ID NO: 15710 - protein, 7 aa, synthetic construct
  REGION 1..7: note = Synthetic Construct
RSKENSK

SEQ ID NO: 15711 - protein, 7 aa, synthetic construct
  REGION 1..7: note = Synthetic Construct
RSKENTK

SEQ ID NO: 15712 - protein, 7 aa, synthetic construct
  REGION 1..7: note = Synthetic Construct
RSKENYK

SEQ ID NO: 15713 - protein, 7 aa, synthetic construct
  REGION 1..7: note = Synthetic Construct
RSKEQAK

SEQ ID NO: 15714 - protein, 7 aa, synthetic construct
  REGION 1..7: note = Synthetic Construct
RSKEQDK

SEQ ID NO: 15715 - protein, 7 aa, synthetic construct
  REGION 1..7: note = Synthetic Construct
RSKEQEK

SEQ ID NO: 15716 - protein, 7 aa, synthetic construct
  REGION 1..7: note = Synthetic Construct
RSKEQFK

SEQ ID NO: 15717 - protein, 7 aa, synthetic construct
  REGION 1..7: note = Synthetic Construct
RSKEQGK

SEQ ID NO: 15718 - protein, 7 aa, synthetic construct
  REGION 1..7: note = Synthetic Construct
RSKEQHK

SEQ ID NO: 15719 - protein, 7 aa, synthetic construct
  REGION 1..7: note = Synthetic Construct
RSKEQIK

SEQ ID NO: 15720 - protein, 7 aa, synthetic construct
  REGION 1..7: note = Synthetic Construct
RSKEQLK

SEQ ID NO: 15721 - protein, 7 aa, synthetic construct
  REGION 1..7: note = Synthetic Construct
RSKEQNK

SEQ ID NO: 15722 - protein, 7 aa, synthetic construct
  REGION 1..7: note = Synthetic Construct
RSKEQQK

SEQ ID NO: 15723 - protein, 7 aa, synthetic construct
  REGION 1..7: note = Synthetic Construct
RSKEQRK

SEQ ID NO: 15724 - protein, 7 aa, synthetic construct
  REGION 1..7: note = Synthetic Construct
RSKEQSK

SEQ ID NO: 15725 - protein, 7 aa, synthetic construct
  REGION 1..7: note = Synthetic Construct
RSKEQTK

SEQ ID NO: 15726 - protein, 7 aa, synthetic construct
  REGION 1..7: note = Synthetic Construct
RSKEQYK

SEQ ID NO: 15727 - protein, 7 aa, synthetic construct
  REGION 1..7: note = Synthetic Construct
RSKERAK

SEQ ID NO: 15728 - protein, 7 aa, synthetic construct
  REGION 1..7: note = Synthetic Construct
RSKERDK

SEQ ID NO: 15729 - protein, 7 aa, synthetic construct
  REGION 1..7: note = Synthetic Construct
RSKEREK

SEQ ID NO: 15730 - protein, 7 aa, synthetic construct
  REGION 1..7: note = Synthetic Construct
RSKERFK

SEQ ID NO: 15731 - protein, 7 aa, synthetic construct
  REGION 1..7: note = Synthetic Construct
RSKERGK

SEQ ID NO: 15732 - protein, 7 aa, synthetic construct
  REGION 1..7: note = Synthetic Construct
RSKERHK

SEQ ID NO: 15733 - protein, 7 aa, synthetic construct
  REGION 1..7: note = Synthetic Construct
RSKERIK

SEQ ID NO: 15734 - protein, 7 aa, synthetic construct
  REGION 1..7: note = Synthetic Construct
RSKERLK

SEQ ID NO: 15735 - protein, 7 aa, synthetic construct
  REGION 1..7: note = Synthetic Construct
RSKERNK

SEQ ID NO: 15736 - protein, 7 aa, synthetic construct
  REGION 1..7: note = Synthetic Construct
RSKERQK

SEQ ID NO: 15737 - protein, 7 aa, synthetic construct
  REGION 1..7: note = Synthetic Construct
RSKERRK

SEQ ID NO: 15738 - protein, 7 aa, synthetic construct
  REGION 1..7: note = Synthetic Construct
RSKERSK

SEQ ID NO: 15739 - protein, 7 aa, synthetic construct
  REGION 1..7: note = Synthetic Construct
RSKERTK

SEQ ID NO: 15740 - protein, 7 aa, synthetic construct
  REGION 1..7: note = Synthetic Construct
RSKERYK

SEQ ID NO: 15741 - protein, 7 aa, synthetic construct
  REGION 1..7: note = Synthetic Construct
RSKESAK

SEQ ID NO: 15742 - protein, 7 aa, synthetic construct
  REGION 1..7: note = Synthetic Construct
RSKESDK

SEQ ID NO: 15743 - protein, 7 aa, synthetic construct
  REGION 1..7: note = Synthetic Construct
RSKESEK

SEQ ID NO: 15744 - protein, 7 aa, synthetic construct
  REGION 1..7: note = Synthetic Construct
RSKESFK

SEQ ID NO: 15745 - protein, 7 aa, synthetic construct
  REGION 1..7: note = Synthetic Construct
RSKESGK

SEQ ID NO: 15746 - protein, 7 aa, synthetic construct
  REGION 1..7: note = Synthetic Construct
RSKESHK

SEQ ID NO: 15747 - protein, 7 aa, synthetic construct
  REGION 1..7: note = Synthetic Construct
RSKESIK

SEQ ID NO: 15748 - protein, 7 aa, synthetic construct
  REGION 1..7: note = Synthetic Construct
RSKESLK

SEQ ID NO: 15749 - protein, 7 aa, synthetic construct
  REGION 1..7: note = Synthetic Construct
RSKESNK

SEQ ID NO: 15750 - protein, 7 aa, synthetic construct
  REGION 1..7: note = Synthetic Construct
RSKESQK

SEQ ID NO: 15751 - protein, 7 aa, synthetic construct
  REGION 1..7: note = Synthetic Construct
RSKESRK

SEQ ID NO: 15752 - protein, 7 aa, synthetic construct
  REGION 1..7: note = Synthetic Construct
RSKESSK

SEQ ID NO: 15753 - protein, 7 aa, synthetic construct
  REGION 1..7: note = Synthetic Construct
RSKESTK

SEQ ID NO: 15754 - protein, 7 aa, synthetic construct
  REGION 1..7: note = Synthetic Construct
RSKESYK

SEQ ID NO: 15755 - protein, 7 aa, synthetic construct
  REGION 1..7: note = Synthetic Construct
RSKETAK

SEQ ID NO: 15756 - protein, 7 aa, synthetic construct
  REGION 1..7: note = Synthetic Construct
RSKETDK

SEQ ID NO: 15757 - protein, 7 aa, synthetic construct
  REGION 1..7: note = Synthetic Construct
RSKETEK

SEQ ID NO: 15758 - protein, 7 aa, synthetic construct
  REGION 1..7: note = Synthetic Construct
RSKETFK

SEQ ID NO: 15759 - protein, 7 aa, synthetic construct
  REGION 1..7: note = Synthetic Construct
RSKETGK

SEQ ID NO: 15760 - protein, 7 aa, synthetic construct
  REGION 1..7: note = Synthetic Construct
RSKETHK

SEQ ID NO: 15761 - protein, 7 aa, synthetic construct
  REGION 1..7: note = Synthetic Construct
RSKETIK

SEQ ID NO: 15762 - protein, 7 aa, synthetic construct
  REGION 1..7: note = Synthetic Construct
RSKETLK

SEQ ID NO: 15763 - protein, 7 aa, synthetic construct
  REGION 1..7: note = Synthetic Construct
RSKETNK

SEQ ID NO: 15764 - protein, 7 aa, synthetic construct
  REGION 1..7: note = Synthetic Construct
RSKETQK

SEQ ID NO: 15765 - protein, 7 aa, synthetic construct
  REGION 1..7: note = Synthetic Construct
RSKETRK

SEQ ID NO: 15766 - protein, 7 aa, synthetic construct
  REGION 1..7: note = Synthetic Construct
RSKETSK

SEQ ID NO: 15767 - protein, 7 aa, synthetic construct
  REGION 1..7: note = Synthetic Construct
RSKETTK

SEQ ID NO: 15768 - protein, 7 aa, synthetic construct
  REGION 1..7: note = Synthetic Construct
RSKETYK

SEQ ID NO: 15769 - protein, 7 aa, synthetic construct
  REGION 1..7: note = Synthetic Construct
RSKEYAK

SEQ ID NO: 15770 - protein, 7 aa, synthetic construct
  REGION 1..7: note = Synthetic Construct
RSKEYDK

SEQ ID NO: 15771 - protein, 7 aa, synthetic construct
  REGION 1..7: note = Synthetic Construct
RSKEYEK

SEQ ID NO: 15772 - protein, 7 aa, synthetic construct
  REGION 1..7: note = Synthetic Construct
RSKEYFK

SEQ ID NO: 15773 - protein, 7 aa, synthetic construct
  REGION 1..7: note = Synthetic Construct
RSKEYGK

SEQ ID NO: 15774 - protein, 7 aa, synthetic construct
  REGION 1..7: note = Synthetic Construct
RSKEYHK

SEQ ID NO: 15775 - protein, 7 aa, synthetic construct
  REGION 1..7: note = Synthetic Construct
RSKEYIK

SEQ ID NO: 15776 - protein, 7 aa, synthetic construct
  REGION 1..7: note = Synthetic Construct
RSKEYLK

SEQ ID NO: 15777 - protein, 7 aa, synthetic construct
  REGION 1..7: note = Synthetic Construct
RSKEYNK

SEQ ID NO: 15778 - protein, 7 aa, synthetic construct
  REGION 1..7: note = Synthetic Construct
RSKEYQK

SEQ ID NO: 15779 - protein, 7 aa, synthetic construct
  REGION 1..7: note = Synthetic Construct
RSKEYRK

SEQ ID NO: 15780 - protein, 7 aa, synthetic construct
  REGION 1..7: note = Synthetic Construct
RSKEYSK

SEQ ID NO: 15781 - protein, 7 aa, synthetic construct
  REGION 1..7: note = Synthetic Construct
RSKEYTK

SEQ ID NO: 15782 - protein, 7 aa, synthetic construct
  REGION 1..7: note = Synthetic Construct
RSKEYYK

SEQ ID NO: 15783 - protein, 7 aa, synthetic construct
  REGION 1..7: note = Synthetic Construct
RSKFAAK

SEQ ID NO: 15784 - protein, 7 aa, synthetic construct
  REGION 1..7: note = Synthetic Construct
RSKFADK

SEQ ID NO: 15785 - protein, 7 aa, synthetic construct
  REGION 1..7: note = Synthetic Construct
RSKFAEK

SEQ ID NO: 15786 - protein, 7 aa, synthetic construct
  REGION 1..7: note = Synthetic Construct
RSKFAFK

SEQ ID NO: 15787 - protein, 7 aa, synthetic construct
  REGION 1..7: note = Synthetic Construct
RSKFAGK

SEQ ID NO: 15788 - protein, 7 aa, synthetic construct
  REGION 1..7: note = Synthetic Construct
RSKFAHK

SEQ ID NO: 15789 - protein, 7 aa, synthetic construct
  REGION 1..7: note = Synthetic Construct
RSKFAIK

SEQ ID NO: 15790 - protein, 7 aa, synthetic construct
  REGION 1..7: note = Synthetic Construct
RSKFALK

SEQ ID NO: 15791 - protein, 7 aa, synthetic construct
  REGION 1..7: note = Synthetic Construct
RSKFANK

SEQ ID NO: 15792 - protein, 7 aa, synthetic construct
  REGION 1..7: note = Synthetic Construct
RSKFAQK

SEQ ID NO: 15793 - protein, 7 aa, synthetic construct
  REGION 1..7: note = Synthetic Construct
RSKFARK

SEQ ID NO: 15794 - protein, 7 aa, synthetic construct
  REGION 1..7: note = Synthetic Construct
RSKFASK

SEQ ID NO: 15795 - protein, 7 aa, synthetic construct
  REGION 1..7: note = Synthetic Construct
RSKFATK

SEQ ID NO: 15796 - protein, 7 aa, synthetic construct
  REGION 1..7: note = Synthetic Construct
RSKFAYK

SEQ ID NO: 15797 - protein, 7 aa, synthetic construct
  REGION 1..7: note = Synthetic Construct
RSKFDAK

SEQ ID NO: 15798 - protein, 7 aa, synthetic construct
  REGION 1..7: note = Synthetic Construct
RSKFDDK

SEQ ID NO: 15799 - protein, 7 aa, synthetic construct
  REGION 1..7: note = Synthetic Construct
RSKFDEK

SEQ ID NO: 15800 - protein, 7 aa, synthetic construct
  REGION 1..7: note = Synthetic Construct
RSKFDFK

SEQ ID NO: 15801 - protein, 7 aa, synthetic construct
  REGION 1..7: note = Synthetic Construct
RSKFDGK

SEQ ID NO: 15802 - protein, 7 aa, synthetic construct
  REGION 1..7: note = Synthetic Construct
RSKFDHK

SEQ ID NO: 15803 - protein, 7 aa, synthetic construct
  REGION 1..7: note = Synthetic Construct
RSKFDIK

SEQ ID NO: 15804 - protein, 7 aa, synthetic construct
  REGION 1..7: note = Synthetic Construct
RSKFDLK

SEQ ID NO: 15805 - protein, 7 aa, synthetic construct
  REGION 1..7: note = Synthetic Construct
RSKFDNK

SEQ ID NO: 15806 - protein, 7 aa, synthetic construct
  REGION 1..7: note = Synthetic Construct
RSKFDQK

SEQ ID NO: 15807 - protein, 7 aa, synthetic construct
  REGION 1..7: note = Synthetic Construct
RSKFDRK

SEQ ID NO: 15808 - protein, 7 aa, synthetic construct
  REGION 1..7: note = Synthetic Construct
RSKFDSK

SEQ ID NO: 15809 - protein, 7 aa, synthetic construct
  REGION 1..7: note = Synthetic Construct
RSKFDTK

SEQ ID NO: 15810 - protein, 7 aa, synthetic construct
  REGION 1..7: note = Synthetic Construct
RSKFDYK

SEQ ID NO: 15811 - protein, 7 aa, synthetic construct
  REGION 1..7: note = Synthetic Construct
RSKFEAK

SEQ ID NO: 15812 - protein, 7 aa, synthetic construct
  REGION 1..7: note = Synthetic Construct
RSKFEDK

SEQ ID NO: 15813 - protein, 7 aa, synthetic construct
  REGION 1..7: note = Synthetic Construct
RSKFEEK

SEQ ID NO: 15814 - protein, 7 aa, synthetic construct
  REGION 1..7: note = Synthetic Construct
RSKFEFK

SEQ ID NO: 15815 - protein, 7 aa, synthetic construct
  REGION 1..7: note = Synthetic Construct
RSKFEGK

SEQ ID NO: 15816 - protein, 7 aa, synthetic construct
  REGION 1..7: note = Synthetic Construct
RSKFEHK

SEQ ID NO: 15817 - protein, 7 aa, synthetic construct
  REGION 1..7: note = Synthetic Construct
RSKFEIK

SEQ ID NO: 15818 - protein, 7 aa, synthetic construct
  REGION 1..7: note = Synthetic Construct
RSKFELK

SEQ ID NO: 15819 - protein, 7 aa, synthetic construct
  REGION 1..7: note = Synthetic Construct
RSKFENK

SEQ ID NO: 15820 - protein, 7 aa, synthetic construct
  REGION 1..7: note = Synthetic Construct
RSKFEQK

SEQ ID NO: 15821 - protein, 7 aa, synthetic construct
  REGION 1..7: note = Synthetic Construct
RSKFERK

SEQ ID NO: 15822 - protein, 7 aa, synthetic construct
  REGION 1..7: note = Synthetic Construct
RSKFESK

SEQ ID NO: 15823 - protein, 7 aa, synthetic construct
  REGION 1..7: note = Synthetic Construct
RSKFETK

SEQ ID NO: 15824 - protein, 7 aa, synthetic construct
  REGION 1..7: note = Synthetic Construct
RSKFEYK

SEQ ID NO: 15825 - protein, 7 aa, synthetic construct
  REGION 1..7: note = Synthetic Construct
RSKFFAK

SEQ ID NO: 15826 - protein, 7 aa, synthetic construct
  REGION 1..7: note = Synthetic Construct
RSKFFDK

SEQ ID NO: 15827 - protein, 7 aa, synthetic construct
  REGION 1..7: note = Synthetic Construct
RSKFFEK

SEQ ID NO: 15828 - protein, 7 aa, synthetic construct
  REGION 1..7: note = Synthetic Construct
RSKFFFK

SEQ ID NO: 15829 - protein, 7 aa, synthetic construct
  REGION 1..7: note = Synthetic Construct
RSKFFGK

SEQ ID NO: 15830 - protein, 7 aa, synthetic construct
  REGION 1..7: note = Synthetic Construct
RSKFFHK

SEQ ID NO: 15831 - protein, 7 aa, synthetic construct
  REGION 1..7: note = Synthetic Construct
RSKFFIK

SEQ ID NO: 15832 - protein, 7 aa, synthetic construct
  REGION 1..7: note = Synthetic Construct
RSKFFLK

SEQ ID NO: 15833 - protein, 7 aa, synthetic construct
  REGION 1..7: note = Synthetic Construct
RSKFFNK

SEQ ID NO: 15834 - protein, 7 aa, synthetic construct
  REGION 1..7: note = Synthetic Construct
RSKFFQK

SEQ ID NO: 15835 - protein, 7 aa, synthetic construct
  REGION 1..7: note = Synthetic Construct
RSKFFRK

SEQ ID NO: 15836 - protein, 7 aa, synthetic construct
  REGION 1..7: note = Synthetic Construct
RSKFFSK

SEQ ID NO: 15837 - protein, 7 aa, synthetic construct
  REGION 1..7: note = Synthetic Construct
RSKFFTK

SEQ ID NO: 15838 - protein, 7 aa, synthetic construct
  REGION 1..7: note = Synthetic Construct
RSKFFYK

SEQ ID NO: 15839 - protein, 7 aa, synthetic construct
  REGION 1..7: note = Synthetic Construct
RSKFGAK

SEQ ID NO: 15840 - protein, 7 aa, synthetic construct
  REGION 1..7: note = Synthetic Construct
RSKFGDK

SEQ ID NO: 15841 - protein, 7 aa, synthetic construct
  REGION 1..7: note = Synthetic Construct
RSKFGEK

SEQ ID NO: 15842 - protein, 7 aa, synthetic construct
  REGION 1..7: note = Synthetic Construct
RSKFGFK

SEQ ID NO: 15843 - protein, 7 aa, synthetic construct
  REGION 1..7: note = Synthetic Construct
RSKFGGK

SEQ ID NO: 15844 - protein, 7 aa, synthetic construct
  REGION 1..7: note = Synthetic Construct
RSKFGHK

SEQ ID NO: 15845 - protein, 7 aa, synthetic construct
  REGION 1..7: note = Synthetic Construct
RSKFGIK

SEQ ID NO: 15846 - protein, 7 aa, synthetic construct
  REGION 1..7: note = Synthetic Construct
RSKFGLK

SEQ ID NO: 15847 - protein, 7 aa, synthetic construct
  REGION 1..7: note = Synthetic Construct
RSKFGNK

SEQ ID NO: 15848 - protein, 7 aa, synthetic construct
  REGION 1..7: note = Synthetic Construct
RSKFGQK

SEQ ID NO: 15849 - protein, 7 aa, synthetic construct
  REGION 1..7: note = Synthetic Construct
RSKFGRK

SEQ ID NO: 15850 - protein, 7 aa, synthetic construct
  REGION 1..7: note = Synthetic Construct
RSKFGSK

SEQ ID NO: 15851 - protein, 7 aa, synthetic construct
  REGION 1..7: note = Synthetic Construct
RSKFGTK

SEQ ID NO: 15852 - protein, 7 aa, synthetic construct
  REGION 1..7: note = Synthetic Construct
RSKFGYK

SEQ ID NO: 15853 - protein, 7 aa, synthetic construct
  REGION 1..7: note = Synthetic Construct
RSKFHAK

SEQ ID NO: 15854 - protein, 7 aa, synthetic construct
  REGION 1..7: note = Synthetic Construct
RSKFHDK

SEQ ID NO: 15855 - protein, 7 aa, synthetic construct
  REGION 1..7: note = Synthetic Construct
RSKFHEK

SEQ ID NO: 15856 - protein, 7 aa, synthetic construct
  REGION 1..7: note = Synthetic Construct
RSKFHFK

SEQ ID NO: 15857 - protein, 7 aa, synthetic construct
  REGION 1..7: note = Synthetic Construct
RSKFHGK

SEQ ID NO: 15858 - protein, 7 aa, synthetic construct
  REGION 1..7: note = Synthetic Construct
RSKFHHK

SEQ ID NO: 15859 - protein, 7 aa, synthetic construct
  REGION 1..7: note = Synthetic Construct
RSKFHIK

SEQ ID NO: 15860 - protein, 7 aa, synthetic construct
  REGION 1..7: note = Synthetic Construct
RSKFHLK

SEQ ID NO: 15861 - protein, 7 aa, synthetic construct
  REGION 1..7: note = Synthetic Construct
RSKFHNK

SEQ ID NO: 15862 - protein, 7 aa, synthetic construct
  REGION 1..7: note = Synthetic Construct
RSKFHQK

SEQ ID NO: 15863 - protein, 7 aa, synthetic construct
  REGION 1..7: note = Synthetic Construct
RSKFHRK

SEQ ID NO: 15864 - protein, 7 aa, synthetic construct
  REGION 1..7: note = Synthetic Construct
RSKFHSK

SEQ ID NO: 15865 - protein, 7 aa, synthetic construct
  REGION 1..7: note = Synthetic Construct
RSKFHTK

SEQ ID NO: 15866 - protein, 7 aa, synthetic construct
  REGION 1..7: note = Synthetic Construct
RSKFHYK

SEQ ID NO: 15867 - protein, 7 aa, synthetic construct
  REGION 1..7: note = Synthetic Construct
RSKFIAK

SEQ ID NO: 15868 - protein, 7 aa, synthetic construct
  REGION 1..7: note = Synthetic Construct
RSKFIDK

SEQ ID NO: 15869 - protein, 7 aa, synthetic construct
  REGION 1..7: note = Synthetic Construct
RSKFIEK

SEQ ID NO: 15870 - protein, 7 aa, synthetic construct
  REGION 1..7: note = Synthetic Construct
RSKFIFK

SEQ ID NO: 15871 - protein, 7 aa, synthetic construct
  REGION 1..7: note = Synthetic Construct
RSKFIGK

SEQ ID NO: 15872 - protein, 7 aa, synthetic construct
  REGION 1..7: note = Synthetic Construct
RSKFIHK

SEQ ID NO: 15873 - protein, 7 aa, synthetic construct
  REGION 1..7: note = Synthetic Construct
RSKFIIK

SEQ ID NO: 15874 - protein, 7 aa, synthetic construct
  REGION 1..7: note = Synthetic Construct
RSKFILK

SEQ ID NO: 15875 - protein, 7 aa, synthetic construct
  REGION 1..7: note = Synthetic Construct
RSKFINK

SEQ ID NO: 15876 - protein, 7 aa, synthetic construct
  REGION 1..7: note = Synthetic Construct
RSKFIQK

SEQ ID NO: 15877 - protein, 7 aa, synthetic construct
  REGION 1..7: note = Synthetic Construct
RSKFIRK

SEQ ID NO: 15878 - protein, 7 aa, synthetic construct
  REGION 1..7: note = Synthetic Construct
RSKFISK

SEQ ID NO: 15879 - protein, 7 aa, synthetic construct
  REGION 1..7: note = Synthetic Construct
RSKFITK

SEQ ID NO: 15880 - protein, 7 aa, synthetic construct
  REGION 1..7: note = Synthetic Construct
RSKFIYK

SEQ ID NO: 15881 - protein, 7 aa, synthetic construct
  REGION 1..7: note = Synthetic Construct
RSKFLAK

SEQ ID NO: 15882 - protein, 7 aa, synthetic construct
  REGION 1..7: note = Synthetic Construct
RSKFLDK

SEQ ID NO: 15883 - protein, 7 aa, synthetic construct
  REGION 1..7: note = Synthetic Construct
RSKFLEK

SEQ ID NO: 15884 - protein, 7 aa, synthetic construct
  REGION 1..7: note = Synthetic Construct
RSKFLFK

SEQ ID NO: 15885 - protein, 7 aa, synthetic construct
  REGION 1..7: note = Synthetic Construct
RSKFLGK

SEQ ID NO: 15886 - protein, 7 aa, synthetic construct
  REGION 1..7: note = Synthetic Construct
RSKFLHK

SEQ ID NO: 15887 - protein, 7 aa, synthetic construct
  REGION 1..7: note = Synthetic Construct
RSKFLIK

SEQ ID NO: 15888 - protein, 7 aa, synthetic construct
  REGION 1..7: note = Synthetic Construct
RSKFLLK

SEQ ID NO: 15889 - protein, 7 aa, synthetic construct
  REGION 1..7: note = Synthetic Construct
RSKFLNK

SEQ ID NO: 15890 - protein, 7 aa, synthetic construct
  REGION 1..7: note = Synthetic Construct
RSKFLQK

SEQ ID NO: 15891 - protein, 7 aa, synthetic construct
  REGION 1..7: note = Synthetic Construct
RSKFLRK

SEQ ID NO: 15892 - protein, 7 aa, synthetic construct
  REGION 1..7: note = Synthetic Construct
RSKFLSK

SEQ ID NO: 15893 - protein, 7 aa, synthetic construct
  REGION 1..7: note = Synthetic Construct
RSKFLTK

SEQ ID NO: 15894 - protein, 7 aa, synthetic construct
  REGION 1..7: note = Synthetic Construct
RSKFLYK

SEQ ID NO: 15895 - protein, 7 aa, synthetic construct
  REGION 1..7: note = Synthetic Construct
RSKFNAK

SEQ ID NO: 15896 - protein, 7 aa, synthetic construct
  REGION 1..7: note = Synthetic Construct
RSKFNDK

SEQ ID NO: 15897 - protein, 7 aa, synthetic construct
  REGION 1..7: note = Synthetic Construct
RSKFNEK

SEQ ID NO: 15898 - protein, 7 aa, synthetic construct
  REGION 1..7: note = Synthetic Construct
RSKFNFK

SEQ ID NO: 15899 - protein, 7 aa, synthetic construct
  REGION 1..7: note = Synthetic Construct
RSKFNGK

SEQ ID NO: 15900 - protein, 7 aa, synthetic construct
  REGION 1..7: note = Synthetic Construct
RSKFNHK

SEQ ID NO: 15901 - protein, 7 aa, synthetic construct
  REGION 1..7: note = Synthetic Construct
RSKFNIK

SEQ ID NO: 15902 - protein, 7 aa, synthetic construct
  REGION 1..7: note = Synthetic Construct
RSKFNLK

SEQ ID NO: 15903 - protein, 7 aa, synthetic construct
  REGION 1..7: note = Synthetic Construct
RSKFNNK

SEQ ID NO: 15904 - protein, 7 aa, synthetic construct
  REGION 1..7: note = Synthetic Construct
RSKFNQK

SEQ ID NO: 15905 - protein, 7 aa, synthetic construct
  REGION 1..7: note = Synthetic Construct
RSKFNRK

SEQ ID NO: 15906 - protein, 7 aa, synthetic construct
  REGION 1..7: note = Synthetic Construct
RSKFNSK

SEQ ID NO: 15907 - protein, 7 aa, synthetic construct
  REGION 1..7: note = Synthetic Construct
RSKFNTK

SEQ ID NO: 15908 - protein, 7 aa, synthetic construct
  REGION 1..7: note = Synthetic Construct
RSKFNYK

SEQ ID NO: 15909 - protein, 7 aa, synthetic construct
  REGION 1..7: note = Synthetic Construct
RSKFQAK

SEQ ID NO: 15910 - protein, 7 aa, synthetic construct
  REGION 1..7: note = Synthetic Construct
RSKFQDK

SEQ ID NO: 15911 - protein, 7 aa, synthetic construct
  REGION 1..7: note = Synthetic Construct
RSKFQEK

SEQ ID NO: 15912 - protein, 7 aa, synthetic construct
  REGION 1..7: note = Synthetic Construct
RSKFQFK

SEQ ID NO: 15913 - protein, 7 aa, synthetic construct
  REGION 1..7: note = Synthetic Construct
RSKFQGK

SEQ ID NO: 15914 - protein, 7 aa, synthetic construct
  REGION 1..7: note = Synthetic Construct
RSKFQHK

SEQ ID NO: 15915 - protein, 7 aa, synthetic construct
  REGION 1..7: note = Synthetic Construct
RSKFQIK

SEQ ID NO: 15916 - protein, 7 aa, synthetic construct
  REGION 1..7: note = Synthetic Construct
RSKFQLK

SEQ ID NO: 15917 - protein, 7 aa, synthetic construct
  REGION 1..7: note = Synthetic Construct
RSKFQNK

SEQ ID NO: 15918 - protein, 7 aa, synthetic construct
  REGION 1..7: note = Synthetic Construct
RSKFQQK

SEQ ID NO: 15919 - protein, 7 aa, synthetic construct
  REGION 1..7: note = Synthetic Construct
RSKFQRK

SEQ ID NO: 15920 - protein, 7 aa, synthetic construct
  REGION 1..7: note = Synthetic Construct
RSKFQSK

SEQ ID NO: 15921 - protein, 7 aa, synthetic construct
  REGION 1..7: note = Synthetic Construct
RSKFQTK

SEQ ID NO: 15922 - protein, 7 aa, synthetic construct
  REGION 1..7: note = Synthetic Construct
RSKFQYK

SEQ ID NO: 15923 - protein, 7 aa, synthetic construct
  REGION 1..7: note = Synthetic Construct
RSKFRAK

SEQ ID NO: 15924 - protein, 7 aa, synthetic construct
  REGION 1..7: note = Synthetic Construct
RSKFRDK

SEQ ID NO: 15925 - protein, 7 aa, synthetic construct
  REGION 1..7: note = Synthetic Construct
RSKFREK

SEQ ID NO: 15926 - protein, 7 aa, synthetic construct
  REGION 1..7: note = Synthetic Construct
RSKFRFK

SEQ ID NO: 15927 - protein, 7 aa, synthetic construct
  REGION 1..7: note = Synthetic Construct
RSKFRGK

SEQ ID NO: 15928 - protein, 7 aa, synthetic construct
  REGION 1..7: note = Synthetic Construct
RSKFRHK

SEQ ID NO: 15929 - protein, 7 aa, synthetic construct
  REGION 1..7: note = Synthetic Construct
RSKFRIK

SEQ ID NO: 15930 - protein, 7 aa, synthetic construct
  REGION 1..7: note = Synthetic Construct
RSKFRLK

SEQ ID NO: 15931 - protein, 7 aa, synthetic construct
  REGION 1..7: note = Synthetic Construct
RSKFRNK

SEQ ID NO: 15932 - protein, 7 aa, synthetic construct
  REGION 1..7: note = Synthetic Construct
RSKFRQK

SEQ ID NO: 15933 - protein, 7 aa, synthetic construct
  REGION 1..7: note = Synthetic Construct
RSKFRRK

SEQ ID NO: 15934 - protein, 7 aa, synthetic construct
  REGION 1..7: note = Synthetic Construct
RSKFRSK

SEQ ID NO: 15935 - protein, 7 aa, synthetic construct
  REGION 1..7: note = Synthetic Construct
RSKFRTK

SEQ ID NO: 15936 - protein, 7 aa, synthetic construct
  REGION 1..7: note = Synthetic Construct
RSKFRYK

SEQ ID NO: 15937 - protein, 7 aa, synthetic construct
  REGION 1..7: note = Synthetic Construct
RSKFSAK

SEQ ID NO: 15938 - protein, 7 aa, synthetic construct
  REGION 1..7: note = Synthetic Construct
RSKFSDK

SEQ ID NO: 15939 - protein, 7 aa, synthetic construct
  REGION 1..7: note = Synthetic Construct
RSKFSEK

SEQ ID NO: 15940 - protein, 7 aa, synthetic construct
  REGION 1..7: note = Synthetic Construct
RSKFSFK

SEQ ID NO: 15941 - protein, 7 aa, synthetic construct
  REGION 1..7: note = Synthetic Construct
RSKFSGK

SEQ ID NO: 15942 - protein, 7 aa, synthetic construct
  REGION 1..7: note = Synthetic Construct
RSKFSHK

SEQ ID NO: 15943 - protein, 7 aa, synthetic construct
  REGION 1..7: note = Synthetic Construct
RSKFSIK

SEQ ID NO: 15944 - protein, 7 aa, synthetic construct
  REGION 1..7: note = Synthetic Construct
RSKFSLK

SEQ ID NO: 15945 - protein, 7 aa, synthetic construct
  REGION 1..7: note = Synthetic Construct
RSKFSNK

SEQ ID NO: 15946 - protein, 7 aa, synthetic construct
  REGION 1..7: note = Synthetic Construct
RSKFSQK

SEQ ID NO: 15947 - protein, 7 aa, synthetic construct
  REGION 1..7: note = Synthetic Construct
RSKFSRK

SEQ ID NO: 15948 - protein, 7 aa, synthetic construct
  REGION 1..7: note = Synthetic Construct
RSKFSSK

SEQ ID NO: 15949 - protein, 7 aa, synthetic construct
  REGION 1..7: note = Synthetic Construct
RSKFSTK

SEQ ID NO: 15950 - protein, 7 aa, synthetic construct
  REGION 1..7: note = Synthetic Construct
RSKFSYK

SEQ ID NO: 15951 - protein, 7 aa, synthetic construct
  REGION 1..7: note = Synthetic Construct
RSKFTAK

SEQ ID NO: 15952 - protein, 7 aa, synthetic construct
  REGION 1..7: note = Synthetic Construct
RSKFTDK

SEQ ID NO: 15953 - protein, 7 aa, synthetic construct
  REGION 1..7: note = Synthetic Construct
RSKFTEK

SEQ ID NO: 15954 - protein, 7 aa, synthetic construct
  REGION 1..7: note = Synthetic Construct
RSKFTFK

SEQ ID NO: 15955 - protein, 7 aa, synthetic construct
  REGION 1..7: note = Synthetic Construct
RSKFTGK

SEQ ID NO: 15956 - protein, 7 aa, synthetic construct
  REGION 1..7: note = Synthetic Construct
RSKFTHK

SEQ ID NO: 15957 - protein, 7 aa, synthetic construct
  REGION 1..7: note = Synthetic Construct
RSKFTIK

SEQ ID NO: 15958 - protein, 7 aa, synthetic construct
  REGION 1..7: note = Synthetic Construct
RSKFTLK

SEQ ID NO: 15959 - protein, 7 aa, synthetic construct
  REGION 1..7: note = Synthetic Construct
RSKFTNK

SEQ ID NO: 15960 - protein, 7 aa, synthetic construct
  REGION 1..7: note = Synthetic Construct
RSKFTQK

SEQ ID NO: 15961 - protein, 7 aa, synthetic construct
  REGION 1..7: note = Synthetic Construct
RSKFTRK

SEQ ID NO: 15962 - protein, 7 aa, synthetic construct
  REGION 1..7: note = Synthetic Construct
RSKFTSK

SEQ ID NO: 15963 - protein, 7 aa, synthetic construct
  REGION 1..7: note = Synthetic Construct
RSKFTTK

SEQ ID NO: 15964 - protein, 7 aa, synthetic construct
  REGION 1..7: note = Synthetic Construct
RSKFTYK

SEQ ID NO: 15965 - protein, 7 aa, synthetic construct
  REGION 1..7: note = Synthetic Construct
RSKFYAK

SEQ ID NO: 15966 - protein, 7 aa, synthetic construct
  REGION 1..7: note = Synthetic Construct
RSKFYDK

SEQ ID NO: 15967 - protein, 7 aa, synthetic construct
  REGION 1..7: note = Synthetic Construct
RSKFYEK

SEQ ID NO: 15968 - protein, 7 aa, synthetic construct
  REGION 1..7: note = Synthetic Construct
RSKFYFK

SEQ ID NO: 15969 - protein, 7 aa, synthetic construct
  REGION 1..7: note = Synthetic Construct
RSKFYGK

SEQ ID NO: 15970 - protein, 7 aa, synthetic construct
  REGION 1..7: note = Synthetic Construct
RSKFYHK

SEQ ID NO: 15971 - protein, 7 aa, synthetic construct
  REGION 1..7: note = Synthetic Construct
RSKFYIK

SEQ ID NO: 15972 - protein, 7 aa, synthetic construct
  REGION 1..7: note = Synthetic Construct
RSKFYLK

SEQ ID NO: 15973 - protein, 7 aa, synthetic construct
  REGION 1..7: note = Synthetic Construct
RSKFYNK

SEQ ID NO: 15974 - protein, 7 aa, synthetic construct
  REGION 1..7: note = Synthetic Construct
RSKFYQK

SEQ ID NO: 15975 - protein, 7 aa, synthetic construct
  REGION 1..7: note = Synthetic Construct
RSKFYRK

SEQ ID NO: 15976 - protein, 7 aa, synthetic construct
  REGION 1..7: note = Synthetic Construct
RSKFYSK

SEQ ID NO: 15977 - protein, 7 aa, synthetic construct
  REGION 1..7: note = Synthetic Construct
RSKFYTK

SEQ ID NO: 15978 - protein, 7 aa, synthetic construct
  REGION 1..7: note = Synthetic Construct
RSKFYYK

SEQ ID NO: 15979 - protein, 7 aa, synthetic construct
  REGION 1..7: note = Synthetic Construct
RSKGAAK

SEQ ID NO: 15980 - protein, 7 aa, synthetic construct
  REGION 1..7: note = Synthetic Construct
RSKGADK

SEQ ID NO: 15981 - protein, 7 aa, synthetic construct
  REGION 1..7: note = Synthetic Construct
RSKGAEK

SEQ ID NO: 15982 - protein, 7 aa, synthetic construct
  REGION 1..7: note = Synthetic Construct
RSKGAFK

SEQ ID NO: 15983 - protein, 7 aa, synthetic construct
  REGION 1..7: note = Synthetic Construct
RSKGAGK

SEQ ID NO: 15984 - protein, 7 aa, synthetic construct
  REGION 1..7: note = Synthetic Construct
RSKGAHK

SEQ ID NO: 15985 - protein, 7 aa, synthetic construct
  REGION 1..7: note = Synthetic Construct
RSKGAIK

SEQ ID NO: 15986 - protein, 7 aa, synthetic construct
  REGION 1..7: note = Synthetic Construct
RSKGALK

SEQ ID NO: 15987 - protein, 7 aa, synthetic construct
  REGION 1..7: note = Synthetic Construct
RSKGANK

SEQ ID NO: 15988 - protein, 7 aa, synthetic construct
  REGION 1..7: note = Synthetic Construct
RSKGAQK

SEQ ID NO: 15989 - protein, 7 aa, synthetic construct
  REGION 1..7: note = Synthetic Construct
RSKGARK

SEQ ID NO: 15990 - protein, 7 aa, synthetic construct
  REGION 1..7: note = Synthetic Construct
RSKGASK

SEQ ID NO: 15991 - protein, 7 aa, synthetic construct
  REGION 1..7: note = Synthetic Construct
RSKGATK

SEQ ID NO: 15992 - protein, 7 aa, synthetic construct
  REGION 1..7: note = Synthetic Construct
RSKGAYK

SEQ ID NO: 15993 - protein, 7 aa, synthetic construct
  REGION 1..7: note = Synthetic Construct
RSKGDAK

SEQ ID NO: 15994 - protein, 7 aa, synthetic construct
  REGION 1..7: note = Synthetic Construct
RSKGDDK

SEQ ID NO: 15995 - protein, 7 aa, synthetic construct
  REGION 1..7: note = Synthetic Construct
RSKGDEK

SEQ ID NO: 15996 - protein, 7 aa, synthetic construct
  REGION 1..7: note = Synthetic Construct
RSKGDFK

SEQ ID NO: 15997 - protein, 7 aa, synthetic construct
  REGION 1..7: note = Synthetic Construct
RSKGDGK

SEQ ID NO: 15998 - protein, 7 aa, synthetic construct
  REGION 1..7: note = Synthetic Construct
RSKGDHK

SEQ ID NO: 15999 - protein, 7 aa, synthetic construct
  REGION 1..7: note = Synthetic Construct
RSKGDIK

SEQ ID NO: 16000 - protein, 7 aa, synthetic construct
  REGION 1..7: note = Synthetic Construct
RSKGDLK

SEQ ID NO: 16001 - protein, 7 aa, synthetic construct
  REGION 1..7: note = Synthetic Construct
RSKGDNK

SEQ ID NO: 16002 - protein, 7 aa, synthetic construct
  REGION 1..7: note = Synthetic Construct
RSKGDQK

SEQ ID NO: 16003 - protein, 7 aa, synthetic construct
  REGION 1..7: note = Synthetic Construct
RSKGDRK

SEQ ID NO: 16004 - protein, 7 aa, synthetic construct
  REGION 1..7: note = Synthetic Construct
RSKGDSK

SEQ ID NO: 16005 - protein, 7 aa, synthetic construct
  REGION 1..7: note = Synthetic Construct
RSKGDTK

SEQ ID NO: 16006 - protein, 7 aa, synthetic construct
  REGION 1..7: note = Synthetic Construct
RSKGDYK

SEQ ID NO: 16007 - protein, 7 aa, synthetic construct
  REGION 1..7: note = Synthetic Construct
RSKGEAK

SEQ ID NO: 16008 - protein, 7 aa, synthetic construct
  REGION 1..7: note = Synthetic Construct
RSKGEDK

SEQ ID NO: 16009 - protein, 7 aa, synthetic construct
  REGION 1..7: note = Synthetic Construct
RSKGEEK

SEQ ID NO: 16010 - protein, 7 aa, synthetic construct
  REGION 1..7: note = Synthetic Construct
RSKGEFK

SEQ ID NO: 16011 - protein, 7 aa, synthetic construct
  REGION 1..7: note = Synthetic Construct
RSKGEGK

SEQ ID NO: 16012 - protein, 7 aa, synthetic construct
  REGION 1..7: note = Synthetic Construct
RSKGEHK

SEQ ID NO: 16013 - protein, 7 aa, synthetic construct
  REGION 1..7: note = Synthetic Construct
RSKGEIK

SEQ ID NO: 16014 - protein, 7 aa, synthetic construct
  REGION 1..7: note = Synthetic Construct
RSKGELK

SEQ ID NO: 16015 - protein, 7 aa, synthetic construct
  REGION 1..7: note = Synthetic Construct
RSKGENK

SEQ ID NO: 16016 - protein, 7 aa, synthetic construct
  REGION 1..7: note = Synthetic Construct
RSKGEQK

SEQ ID NO: 16017 - protein, 7 aa, synthetic construct
  REGION 1..7: note = Synthetic Construct
RSKGERK

SEQ ID NO: 16018 - protein, 7 aa, synthetic construct
  REGION 1..7: note = Synthetic Construct
RSKGESK

SEQ ID NO: 16019 - protein, 7 aa, synthetic construct
  REGION 1..7: note = Synthetic Construct
RSKGETK

SEQ ID NO: 16020 - protein, 7 aa, synthetic construct
  REGION 1..7: note = Synthetic Construct
RSKGEYK

SEQ ID NO: 16021 - protein, 7 aa, synthetic construct
  REGION 1..7: note = Synthetic Construct
RSKGFAK

SEQ ID NO: 16022 - protein, 7 aa, synthetic construct
  REGION 1..7: note = Synthetic Construct
RSKGFDK

SEQ ID NO: 16023 - protein, 7 aa, synthetic construct
  REGION 1..7: note = Synthetic Construct
RSKGFEK

SEQ ID NO: 16024 - protein, 7 aa, synthetic construct
  REGION 1..7: note = Synthetic Construct
RSKGFFK

SEQ ID NO: 16025 - protein, 7 aa, synthetic construct
  REGION 1..7: note = Synthetic Construct
RSKGFGK

SEQ ID NO: 16026 - protein, 7 aa, synthetic construct
  REGION 1..7: note = Synthetic Construct
RSKGFHK

SEQ ID NO: 16027 - protein, 7 aa, synthetic construct
  REGION 1..7: note = Synthetic Construct
RSKGFIK

SEQ ID NO: 16028 - protein, 7 aa, synthetic construct
  REGION 1..7: note = Synthetic Construct
RSKGFLK

SEQ ID NO: 16029 - protein, 7 aa, synthetic construct
  REGION 1..7: note = Synthetic Construct
RSKGFNK

SEQ ID NO: 16030 - protein, 7 aa, synthetic construct
  REGION 1..7: note = Synthetic Construct
RSKGFQK

SEQ ID NO: 16031 - protein, 7 aa, synthetic construct
  REGION 1..7: note = Synthetic Construct
RSKGFRK

SEQ ID NO: 16032 - protein, 7 aa, synthetic construct
  REGION 1..7: note = Synthetic Construct
RSKGFSK

SEQ ID NO: 16033 - protein, 7 aa, synthetic construct
  REGION 1..7: note = Synthetic Construct
RSKGFTK

SEQ ID NO: 16034 - protein, 7 aa, synthetic construct
  REGION 1..7: note = Synthetic Construct
RSKGFYK

SEQ ID NO: 16035 - protein, 7 aa, synthetic construct
  REGION 1..7: note = Synthetic Construct
RSKGGAK

SEQ ID NO: 16036 - protein, 7 aa, synthetic construct
  REGION 1..7: note = Synthetic Construct
RSKGGDK

SEQ ID NO: 16037 - protein, 7 aa, synthetic construct
  REGION 1..7: note = Synthetic Construct
RSKGGEK

SEQ ID NO: 16038 - protein, 7 aa, synthetic construct
  REGION 1..7: note = Synthetic Construct
RSKGGFK

SEQ ID NO: 16039 - protein, 7 aa, synthetic construct
  REGION 1..7: note = Synthetic Construct
RSKGGGK

SEQ ID NO: 16040 - protein, 7 aa, synthetic construct
  REGION 1..7: note = Synthetic Construct
RSKGGHK

SEQ ID NO: 16041 - protein, 7 aa, synthetic construct
  REGION 1..7: note = Synthetic Construct
RSKGGIK

SEQ ID NO: 16042 - protein, 7 aa, synthetic construct
  REGION 1..7: note = Synthetic Construct
RSKGGLK

SEQ ID NO: 16043 - protein, 7 aa, synthetic construct
  REGION 1..7: note = Synthetic Construct
RSKGGNK

SEQ ID NO: 16044 - protein, 7 aa, synthetic construct
  REGION 1..7: note = Synthetic Construct
RSKGGQK

SEQ ID NO: 16045 - protein, 7 aa, synthetic construct
  REGION 1..7: note = Synthetic Construct
RSKGGRK

SEQ ID NO: 16046 - protein, 7 aa, synthetic construct
  REGION 1..7: note = Synthetic Construct
RSKGGSK

SEQ ID NO: 16047 - protein, 7 aa, synthetic construct
  REGION 1..7: note = Synthetic Construct
RSKGGTK

SEQ ID NO: 16048 - protein, 7 aa, synthetic construct
  REGION 1..7: note = Synthetic Construct
RSKGGYK

SEQ ID NO: 16049 - protein, 7 aa, synthetic construct
  REGION 1..7: note = Synthetic Construct
RSKGHAK

SEQ ID NO: 16050 - protein, 7 aa, synthetic construct
  REGION 1..7: note = Synthetic Construct
RSKGHDK

SEQ ID NO: 16051 - protein, 7 aa, synthetic construct
  REGION 1..7: note = Synthetic Construct
RSKGHEK

SEQ ID NO: 16052 - protein, 7 aa, synthetic construct
  REGION 1..7: note = Synthetic Construct
RSKGHFK

SEQ ID NO: 16053 - protein, 7 aa, synthetic construct
  REGION 1..7: note = Synthetic Construct
RSKGHGK

SEQ ID NO: 16054 - protein, 7 aa, synthetic construct
  REGION 1..7: note = Synthetic Construct
RSKGHHK

SEQ ID NO: 16055 - protein, 7 aa, synthetic construct
  REGION 1..7: note = Synthetic Construct
RSKGHIK

SEQ ID NO: 16056 - protein, 7 aa, synthetic construct
  REGION 1..7: note = Synthetic Construct
RSKGHLK

SEQ ID NO: 16057 - protein, 7 aa, synthetic construct
  REGION 1..7: note = Synthetic Construct
RSKGHNK

SEQ ID NO: 16058 - protein, 7 aa, synthetic construct
  REGION 1..7: note = Synthetic Construct
RSKGHQK

SEQ ID NO: 16059 - protein, 7 aa, synthetic construct
  REGION 1..7: note = Synthetic Construct
RSKGHRK

SEQ ID NO: 16060 - protein, 7 aa, synthetic construct
  REGION 1..7: note = Synthetic Construct
RSKGHSK

SEQ ID NO: 16061 - protein, 7 aa, synthetic construct
  REGION 1..7: note = Synthetic Construct
RSKGHTK

SEQ ID NO: 16062 - protein, 7 aa, synthetic construct
  REGION 1..7: note = Synthetic Construct
RSKGHYK

SEQ ID NO: 16063 - protein, 7 aa, synthetic construct
  REGION 1..7: note = Synthetic Construct
RSKGIAK

SEQ ID NO: 16064 - protein, 7 aa, synthetic construct
  REGION 1..7: note = Synthetic Construct
RSKGIDK

SEQ ID NO: 16065 - protein, 7 aa, synthetic construct
  REGION 1..7: note = Synthetic Construct
RSKGIEK

SEQ ID NO: 16066 - protein, 7 aa, synthetic construct
  REGION 1..7: note = Synthetic Construct
RSKGIFK

SEQ ID NO: 16067 - protein, 7 aa, synthetic construct
  REGION 1..7: note = Synthetic Construct
RSKGIGK

SEQ ID NO: 16068 - protein, 7 aa, synthetic construct
  REGION 1..7: note = Synthetic Construct
RSKGIHK

SEQ ID NO: 16069 - protein, 7 aa, synthetic construct
  REGION 1..7: note = Synthetic Construct
RSKGIIK

SEQ ID NO: 16070 - protein, 7 aa, synthetic construct
  REGION 1..7: note = Synthetic Construct
RSKGILK

SEQ ID NO: 16071 - protein, 7 aa, synthetic construct
  REGION 1..7: note = Synthetic Construct
RSKGINK

SEQ ID NO: 16072 - protein, 7 aa, synthetic construct
  REGION 1..7: note = Synthetic Construct
RSKGIQK

SEQ ID NO: 16073 - protein, 7 aa, synthetic construct
  REGION 1..7: note = Synthetic Construct
RSKGIRK

SEQ ID NO: 16074 - protein, 7 aa, synthetic construct
  REGION 1..7: note = Synthetic Construct
RSKGISK

SEQ ID NO: 16075 - protein, 7 aa, synthetic construct
  REGION 1..7: note = Synthetic Construct
RSKGITK

SEQ ID NO: 16076 - protein, 7 aa, synthetic construct
  REGION 1..7: note = Synthetic Construct
RSKGIYK

SEQ ID NO: 16077 - protein, 7 aa, synthetic construct
  REGION 1..7: note = Synthetic Construct
RSKGLAK

SEQ ID NO: 16078 - protein, 7 aa, synthetic construct
  REGION 1..7: note = Synthetic Construct
RSKGLDK

SEQ ID NO: 16079 - protein, 7 aa, synthetic construct
  REGION 1..7: note = Synthetic Construct
RSKGLEK

SEQ ID NO: 16080 - protein, 7 aa, synthetic construct
  REGION 1..7: note = Synthetic Construct
RSKGLFK

SEQ ID NO: 16081 - protein, 7 aa, synthetic construct
  REGION 1..7: note = Synthetic Construct
RSKGLGK

SEQ ID NO: 16082 - protein, 7 aa, synthetic construct
  REGION 1..7: note = Synthetic Construct
RSKGLHK

SEQ ID NO: 16083 - protein, 7 aa, synthetic construct
  REGION 1..7: note = Synthetic Construct
RSKGLIK

SEQ ID NO: 16084 - protein, 7 aa, synthetic construct
  REGION 1..7: note = Synthetic Construct
RSKGLLK

SEQ ID NO: 16085 - protein, 7 aa, synthetic construct
  REGION 1..7: note = Synthetic Construct
RSKGLNK

SEQ ID NO: 16086 - protein, 7 aa, synthetic construct
  REGION 1..7: note = Synthetic Construct
RSKGLQK

SEQ ID NO: 16087 - protein, 7 aa, synthetic construct
  REGION 1..7: note = Synthetic Construct
RSKGLRK

SEQ ID NO: 16088 - protein, 7 aa, synthetic construct
  REGION 1..7: note = Synthetic Construct
RSKGLSK

SEQ ID NO: 16089 - protein, 7 aa, synthetic construct
  REGION 1..7: note = Synthetic Construct
RSKGLTK

SEQ ID NO: 16090 - protein, 7 aa, synthetic construct
  REGION 1..7: note = Synthetic Construct
RSKGLYK

SEQ ID NO: 16091 - protein, 7 aa, synthetic construct
  REGION 1..7: note = Synthetic Construct
RSKGNAK

SEQ ID NO: 16092 - protein, 7 aa, synthetic construct
  REGION 1..7: note = Synthetic Construct
RSKGNDK

SEQ ID NO: 16093 - protein, 7 aa, synthetic construct
  REGION 1..7: note = Synthetic Construct
RSKGNEK

SEQ ID NO: 16094 - protein, 7 aa, synthetic construct
  REGION 1..7: note = Synthetic Construct
RSKGNFK

SEQ ID NO: 16095 - protein, 7 aa, synthetic construct
  REGION 1..7: note = Synthetic Construct
RSKGNGK

SEQ ID NO: 16096 - protein, 7 aa, synthetic construct
  REGION 1..7: note = Synthetic Construct
RSKGNHK

SEQ ID NO: 16097 - protein, 7 aa, synthetic construct
  REGION 1..7: note = Synthetic Construct
RSKGNIK

SEQ ID NO: 16098 - protein, 7 aa, synthetic construct
  REGION 1..7: note = Synthetic Construct
RSKGNLK

SEQ ID NO: 16099 - protein, 7 aa, synthetic construct
  REGION 1..7: note = Synthetic Construct
RSKGNNK

SEQ ID NO: 16100 - protein, 7 aa, synthetic construct
  REGION 1..7: note = Synthetic Construct
RSKGNQK

SEQ ID NO: 16101 - protein, 7 aa, synthetic construct
  REGION 1..7: note = Synthetic Construct
RSKGNRK

SEQ ID NO: 16102 - protein, 7 aa, synthetic construct
  REGION 1..7: note = Synthetic Construct
RSKGNSK

SEQ ID NO: 16103 - protein, 7 aa, synthetic construct
  REGION 1..7: note = Synthetic Construct
RSKGNTK

SEQ ID NO: 16104 - protein, 7 aa, synthetic construct
  REGION 1..7: note = Synthetic Construct
RSKGNYK

SEQ ID NO: 16105 - protein, 7 aa, synthetic construct
  REGION 1..7: note = Synthetic Construct
RSKGQAK

SEQ ID NO: 16106 - protein, 7 aa, synthetic construct
  REGION 1..7: note = Synthetic Construct
RSKGQDK

SEQ ID NO: 16107 - protein, 7 aa, synthetic construct
  REGION 1..7: note = Synthetic Construct
RSKGQEK

SEQ ID NO: 16108 - protein, 7 aa, synthetic construct
  REGION 1..7: note = Synthetic Construct
RSKGQFK

SEQ ID NO: 16109 - protein, 7 aa, synthetic construct
  REGION 1..7: note = Synthetic Construct
RSKGQGK

SEQ ID NO: 16110 - protein, 7 aa, synthetic construct
  REGION 1..7: note = Synthetic Construct
RSKGQHK

SEQ ID NO: 16111 - protein, 7 aa, synthetic construct
  REGION 1..7: note = Synthetic Construct
RSKGQIK

SEQ ID NO: 16112 - protein, 7 aa, synthetic construct
  REGION 1..7: note = Synthetic Construct
RSKGQLK

SEQ ID NO: 16113 - protein, 7 aa, synthetic construct
  REGION 1..7: note = Synthetic Construct
RSKGQNK

SEQ ID NO: 16114 - protein, 7 aa, synthetic construct
  REGION 1..7: note = Synthetic Construct
RSKGQQK

SEQ ID NO: 16115 - protein, 7 aa, synthetic construct
  REGION 1..7: note = Synthetic Construct
RSKGQRK

SEQ ID NO: 16116 - protein, 7 aa, synthetic construct
  REGION 1..7: note = Synthetic Construct
RSKGQSK

SEQ ID NO: 16117 - protein, 7 aa, synthetic construct
  REGION 1..7: note = Synthetic Construct
RSKGQTK

SEQ ID NO: 16118 - protein, 7 aa, synthetic construct
  REGION 1..7: note = Synthetic Construct
RSKGQYK

SEQ ID NO: 16119 - protein, 7 aa, synthetic construct
  REGION 1..7: note = Synthetic Construct
RSKGRAK

SEQ ID NO: 16120 - protein, 7 aa, synthetic construct
  REGION 1..7: note = Synthetic Construct
RSKGRDK

SEQ ID NO: 16121 - protein, 7 aa, synthetic construct
  REGION 1..7: note = Synthetic Construct
RSKGREK

SEQ ID NO: 16122 - protein, 7 aa, synthetic construct
  REGION 1..7: note = Synthetic Construct
RSKGRFK

SEQ ID NO: 16123 - protein, 7 aa, synthetic construct
  REGION 1..7: note = Synthetic Construct
RSKGRGK

SEQ ID NO: 16124 - protein, 7 aa, synthetic construct
  REGION 1..7: note = Synthetic Construct
RSKGRHK

SEQ ID NO: 16125 - protein, 7 aa, synthetic construct
  REGION 1..7: note = Synthetic Construct
RSKGRIK

SEQ ID NO: 16126 - protein, 7 aa, synthetic construct
  REGION 1..7: note = Synthetic Construct
RSKGRLK

SEQ ID NO: 16127 - protein, 7 aa, synthetic construct
  REGION 1..7: note = Synthetic Construct
RSKGRNK

SEQ ID NO: 16128 - protein, 7 aa, synthetic construct
  REGION 1..7: note = Synthetic Construct
RSKGRQK

SEQ ID NO: 16129 - protein, 7 aa, synthetic construct
  REGION 1..7: note = Synthetic Construct
RSKGRRK

SEQ ID NO: 16130 - protein, 7 aa, synthetic construct
  REGION 1..7: note = Synthetic Construct
RSKGRSK

SEQ ID NO: 16131 - protein, 7 aa, synthetic construct
  REGION 1..7: note = Synthetic Construct
RSKGRTK

SEQ ID NO: 16132 - protein, 7 aa, synthetic construct
  REGION 1..7: note = Synthetic Construct
RSKGRYK

SEQ ID NO: 16133 - protein, 7 aa, synthetic construct
  REGION 1..7: note = Synthetic Construct
RSKGSAK

SEQ ID NO: 16134 - protein, 7 aa, synthetic construct
  REGION 1..7: note = Synthetic Construct
RSKGSDK

SEQ ID NO: 16135 - protein, 7 aa, synthetic construct
  REGION 1..7: note = Synthetic Construct
RSKGSEK

SEQ ID NO: 16136 - protein, 7 aa, synthetic construct
  REGION 1..7: note = Synthetic Construct
RSKGSFK

SEQ ID NO: 16137 - protein, 7 aa, synthetic construct
  REGION 1..7: note = Synthetic Construct
RSKGSGK

SEQ ID NO: 16138 - protein, 7 aa, synthetic construct
  REGION 1..7: note = Synthetic Construct
RSKGSHK

SEQ ID NO: 16139 - protein, 7 aa, synthetic construct
  REGION 1..7: note = Synthetic Construct
RSKGSIK

SEQ ID NO: 16140 - protein, 7 aa, synthetic construct
  REGION 1..7: note = Synthetic Construct
RSKGSLK

SEQ ID NO: 16141 - protein, 7 aa, synthetic construct
  REGION 1..7: note = Synthetic Construct
RSKGSNK

SEQ ID NO: 16142 - protein, 7 aa, synthetic construct
  REGION 1..7: note = Synthetic Construct
RSKGSQK

SEQ ID NO: 16143 - protein, 7 aa, synthetic construct
  REGION 1..7: note = Synthetic Construct
RSKGSRK

SEQ ID NO: 16144 - protein, 7 aa, synthetic construct
  REGION 1..7: note = Synthetic Construct
RSKGSSK

SEQ ID NO: 16145 - protein, 7 aa, synthetic construct
  REGION 1..7: note = Synthetic Construct
RSKGSTK

SEQ ID NO: 16146 - protein, 7 aa, synthetic construct
  REGION 1..7: note = Synthetic Construct
RSKGSYK

SEQ ID NO: 16147 - protein, 7 aa, synthetic construct
  REGION 1..7: note = Synthetic Construct
RSKGTAK

SEQ ID NO: 16148 - protein, 7 aa, synthetic construct
  REGION 1..7: note = Synthetic Construct
RSKGTDK

SEQ ID NO: 16149 - protein, 7 aa, synthetic construct
  REGION 1..7: note = Synthetic Construct
RSKGTEK

SEQ ID NO: 16150 - protein, 7 aa, synthetic construct
  REGION 1..7: note = Synthetic Construct
RSKGTFK

SEQ ID NO: 16151 - protein, 7 aa, synthetic construct
  REGION 1..7: note = Synthetic Construct
RSKGTGK

SEQ ID NO: 16152 - protein, 7 aa, synthetic construct
  REGION 1..7: note = Synthetic Construct
RSKGTHK

SEQ ID NO: 16153 - protein, 7 aa, synthetic construct
  REGION 1..7: note = Synthetic Construct
RSKGTIK

SEQ ID NO: 16154 - protein, 7 aa, synthetic construct
  REGION 1..7: note = Synthetic Construct
RSKGTLK

SEQ ID NO: 16155 - protein, 7 aa, synthetic construct
  REGION 1..7: note = Synthetic Construct
RSKGTNK

SEQ ID NO: 16156 - protein, 7 aa, synthetic construct
  REGION 1..7: note = Synthetic Construct
RSKGTQK

SEQ ID NO: 16157 - protein, 7 aa, synthetic construct
  REGION 1..7: note = Synthetic Construct
RSKGTRK

SEQ ID NO: 16158 - protein, 7 aa, synthetic construct
  REGION 1..7: note = Synthetic Construct
RSKGTSK

SEQ ID NO: 16159 - protein, 7 aa, synthetic construct
  REGION 1..7: note = Synthetic Construct
RSKGTTK

SEQ ID NO: 16160 - protein, 7 aa, synthetic construct
  REGION 1..7: note = Synthetic Construct
RSKGTYK

SEQ ID NO: 16161 - protein, 7 aa, synthetic construct
  REGION 1..7: note = Synthetic Construct
RSKGYAK

SEQ ID NO: 16162 - protein, 7 aa, synthetic construct
  REGION 1..7: note = Synthetic Construct
RSKGYDK

SEQ ID NO: 16163 - protein, 7 aa, synthetic construct
  REGION 1..7: note = Synthetic Construct
RSKGYEK

SEQ ID NO: 16164 - protein, 7 aa, synthetic construct
  REGION 1..7: note = Synthetic Construct
RSKGYFK

SEQ ID NO: 16165 - protein, 7 aa, synthetic construct
  REGION 1..7: note = Synthetic Construct
RSKGYGK

SEQ ID NO: 16166 - protein, 7 aa, synthetic construct
  REGION 1..7: note = Synthetic Construct
RSKGYHK

SEQ ID NO: 16167 - protein, 7 aa, synthetic construct
  REGION 1..7: note = Synthetic Construct
RSKGYIK

SEQ ID NO: 16168 - protein, 7 aa, synthetic construct
  REGION 1..7: note = Synthetic Construct
RSKGYLK

SEQ ID NO: 16169 - protein, 7 aa, synthetic construct
  REGION 1..7: note = Synthetic Construct
RSKGYNK

SEQ ID NO: 16170 - protein, 7 aa, synthetic construct
  REGION 1..7: note = Synthetic Construct
RSKGYQK

SEQ ID NO: 16171 - protein, 7 aa, synthetic construct
  REGION 1..7: note = Synthetic Construct
RSKGYRK

SEQ ID NO: 16172 - protein, 7 aa, synthetic construct
  REGION 1..7: note = Synthetic Construct
RSKGYSK

SEQ ID NO: 16173 - protein, 7 aa, synthetic construct
  REGION 1..7: note = Synthetic Construct
RSKGYTK

SEQ ID NO: 16174 - protein, 7 aa, synthetic construct
  REGION 1..7: note = Synthetic Construct
RSKGYYK

SEQ ID NO: 16175 - protein, 7 aa, synthetic construct
  REGION 1..7: note = Synthetic Construct
RSKHAAK

SEQ ID NO: 16176 - protein, 7 aa, synthetic construct
  REGION 1..7: note = Synthetic Construct
RSKHADK

SEQ ID NO: 16177 - protein, 7 aa, synthetic construct
  REGION 1..7: note = Synthetic Construct
RSKHAEK

SEQ ID NO: 16178 - protein, 7 aa, synthetic construct
  REGION 1..7: note = Synthetic Construct
RSKHAFK

SEQ ID NO: 16179 - protein, 7 aa, synthetic construct
  REGION 1..7: note = Synthetic Construct
RSKHAGK

SEQ ID NO: 16180 - protein, 7 aa, synthetic construct
  REGION 1..7: note = Synthetic Construct
RSKHAHK

SEQ ID NO: 16181 - protein, 7 aa, synthetic construct
  REGION 1..7: note = Synthetic Construct
RSKHAIK

SEQ ID NO: 16182 - protein, 7 aa, synthetic construct
  REGION 1..7: note = Synthetic Construct
RSKHALK

SEQ ID NO: 16183 - protein, 7 aa, synthetic construct
  REGION 1..7: note = Synthetic Construct
RSKHANK

SEQ ID NO: 16184 - protein, 7 aa, synthetic construct
  REGION 1..7: note = Synthetic Construct
RSKHAQK

SEQ ID NO: 16185 - protein, 7 aa, synthetic construct
  REGION 1..7: note = Synthetic Construct
RSKHARK

SEQ ID NO: 16186 - protein, 7 aa, synthetic construct
  REGION 1..7: note = Synthetic Construct
RSKHASK

SEQ ID NO: 16187 - protein, 7 aa, synthetic construct
  REGION 1..7: note = Synthetic Construct
RSKHATK

SEQ ID NO: 16188 - protein, 7 aa, synthetic construct
  REGION 1..7: note = Synthetic Construct
RSKHAYK

SEQ ID NO: 16189 - protein, 7 aa, synthetic construct
  REGION 1..7: note = Synthetic Construct
RSKHDAK

SEQ ID NO: 16190 - protein, 7 aa, synthetic construct
  REGION 1..7: note = Synthetic Construct
RSKHDDK

SEQ ID NO: 16191 - protein, 7 aa, synthetic construct
  REGION 1..7: note = Synthetic Construct
RSKHDEK

SEQ ID NO: 16192 - protein, 7 aa, synthetic construct
  REGION 1..7: note = Synthetic Construct
RSKHDFK

SEQ ID NO: 16193 - protein, 7 aa, synthetic construct
  REGION 1..7: note = Synthetic Construct
RSKHDGK

SEQ ID NO: 16194 - protein, 7 aa, synthetic construct
  REGION 1..7: note = Synthetic Construct
RSKHDHK

SEQ ID NO: 16195 - protein, 7 aa, synthetic construct
  REGION 1..7: note = Synthetic Construct
RSKHDIK

SEQ ID NO: 16196 - protein, 7 aa, synthetic construct
  REGION 1..7: note = Synthetic Construct
RSKHDLK

SEQ ID NO: 16197 - protein, 7 aa, synthetic construct
  REGION 1..7: note = Synthetic Construct
RSKHDNK

SEQ ID NO: 16198 - protein, 7 aa, synthetic construct
  REGION 1..7: note = Synthetic Construct
RSKHDQK

SEQ ID NO: 16199 - protein, 7 aa, synthetic construct
  REGION 1..7: note = Synthetic Construct
RSKHDRK

SEQ ID NO: 16200 - protein, 7 aa, synthetic construct
  REGION 1..7: note = Synthetic Construct
RSKHDSK

SEQ ID NO: 16201 - protein, 7 aa, synthetic construct
  REGION 1..7: note = Synthetic Construct
RSKHDTK

SEQ ID NO: 16202 - protein, 7 aa, synthetic construct
  REGION 1..7: note = Synthetic Construct
RSKHDYK

SEQ ID NO: 16203 - protein, 7 aa, synthetic construct
  REGION 1..7: note = Synthetic Construct
RSKHEAK

SEQ ID NO: 16204 - protein, 7 aa, synthetic construct
  REGION 1..7: note = Synthetic Construct
RSKHEDK

SEQ ID NO: 16205 - protein, 7 aa, synthetic construct
  REGION 1..7: note = Synthetic Construct
RSKHEEK

SEQ ID NO: 16206 - protein, 7 aa, synthetic construct
  REGION 1..7: note = Synthetic Construct
RSKHEFK

SEQ ID NO: 16207 - protein, 7 aa, synthetic construct
  REGION 1..7: note = Synthetic Construct
RSKHEGK

SEQ ID NO: 16208 - protein, 7 aa, synthetic construct
  REGION 1..7: note = Synthetic Construct
RSKHEHK

SEQ ID NO: 16209 - protein, 7 aa, synthetic construct
  REGION 1..7: note = Synthetic Construct
RSKHEIK

SEQ ID NO: 16210 - protein, 7 aa, synthetic construct
  REGION 1..7: note = Synthetic Construct
RSKHELK

SEQ ID NO: 16211 - protein, 7 aa, synthetic construct
  REGION 1..7: note = Synthetic Construct
RSKHENK

SEQ ID NO: 16212 - protein, 7 aa, synthetic construct
  REGION 1..7: note = Synthetic Construct
RSKHEQK

SEQ ID NO: 16213 - protein, 7 aa, synthetic construct
  REGION 1..7: note = Synthetic Construct
RSKHERK

SEQ ID NO: 16214 - protein, 7 aa, synthetic construct
  REGION 1..7: note = Synthetic Construct
RSKHESK

SEQ ID NO: 16215 - protein, 7 aa, synthetic construct
  REGION 1..7: note = Synthetic Construct
RSKHETK

SEQ ID NO: 16216 - protein, 7 aa, synthetic construct
  REGION 1..7: note = Synthetic Construct
RSKHEYK

SEQ ID NO: 16217 - protein, 7 aa, synthetic construct
  REGION 1..7: note = Synthetic Construct
RSKHFAK

SEQ ID NO: 16218 - protein, 7 aa, synthetic construct
  REGION 1..7: note = Synthetic Construct
RSKHFDK

SEQ ID NO: 16219 - protein, 7 aa, synthetic construct
  REGION 1..7: note = Synthetic Construct
RSKHFEK

SEQ ID NO: 16220 - protein, 7 aa, synthetic construct
  REGION 1..7: note = Synthetic Construct
RSKHFFK

SEQ ID NO: 16221 - protein, 7 aa, synthetic construct
  REGION 1..7: note = Synthetic Construct
RSKHFGK

SEQ ID NO: 16222 - protein, 7 aa, synthetic construct
  REGION 1..7: note = Synthetic Construct
RSKHFHK

SEQ ID NO: 16223 - protein, 7 aa, synthetic construct
  REGION 1..7: note = Synthetic Construct
RSKHFIK

SEQ ID NO: 16224 - protein, 7 aa, synthetic construct
  REGION 1..7: note = Synthetic Construct
RSKHFLK

SEQ ID NO: 16225 - protein, 7 aa, synthetic construct
  REGION 1..7: note = Synthetic Construct
RSKHFNK

SEQ ID NO: 16226 - protein, 7 aa, synthetic construct
  REGION 1..7: note = Synthetic Construct
RSKHFQK

SEQ ID NO: 16227 - protein, 7 aa, synthetic construct
  REGION 1..7: note = Synthetic Construct
RSKHFRK

SEQ ID NO: 16228 - protein, 7 aa, synthetic construct
  REGION 1..7: note = Synthetic Construct
RSKHFSK

SEQ ID NO: 16229 - protein, 7 aa, synthetic construct
  REGION 1..7: note = Synthetic Construct
RSKHFTK

SEQ ID NO: 16230 - protein, 7 aa, synthetic construct
  REGION 1..7: note = Synthetic Construct
RSKHFYK

SEQ ID NO: 16231 - protein, 7 aa, synthetic construct
  REGION 1..7: note = Synthetic Construct
RSKHGAK

SEQ ID NO: 16232 - protein, 7 aa, synthetic construct
  REGION 1..7: note = Synthetic Construct
RSKHGDK

SEQ ID NO: 16233 - protein, 7 aa, synthetic construct
  REGION 1..7: note = Synthetic Construct
RSKHGEK

SEQ ID NO: 16234 - protein, 7 aa, synthetic construct
  REGION 1..7: note = Synthetic Construct
RSKHGFK

SEQ ID NO: 16235 - protein, 7 aa, synthetic construct
  REGION 1..7: note = Synthetic Construct
RSKHGGK

SEQ ID NO: 16236 - protein, 7 aa, synthetic construct
  REGION 1..7: note = Synthetic Construct
RSKHGHK

SEQ ID NO: 16237 - protein, 7 aa, synthetic construct
  REGION 1..7: note = Synthetic Construct
RSKHGIK

SEQ ID NO: 16238 - protein, 7 aa, synthetic construct
  REGION 1..7: note = Synthetic Construct
RSKHGLK

SEQ ID NO: 16239 - protein, 7 aa, synthetic construct
  REGION 1..7: note = Synthetic Construct
RSKHGNK

SEQ ID NO: 16240 - protein, 7 aa, synthetic construct
  REGION 1..7: note = Synthetic Construct
RSKHGQK

SEQ ID NO: 16241 - protein, 7 aa, synthetic construct
  REGION 1..7: note = Synthetic Construct
RSKHGRK

SEQ ID NO: 16242 - protein, 7 aa, synthetic construct
  REGION 1..7: note = Synthetic Construct
RSKHGSK

SEQ ID NO: 16243 - protein, 7 aa, synthetic construct
  REGION 1..7: note = Synthetic Construct
RSKHGTK

SEQ ID NO: 16244 - protein, 7 aa, synthetic construct
  REGION 1..7: note = Synthetic Construct
RSKHGYK

SEQ ID NO: 16245 - protein, 7 aa, synthetic construct
  REGION 1..7: note = Synthetic Construct
RSKHHAK

SEQ ID NO: 16246 - protein, 7 aa, synthetic construct
  REGION 1..7: note = Synthetic Construct
RSKHHDK

SEQ ID NO: 16247 - protein, 7 aa, synthetic construct
  REGION 1..7: note = Synthetic Construct
RSKHHEK

SEQ ID NO: 16248 - protein, 7 aa, synthetic construct
  REGION 1..7: note = Synthetic Construct
RSKHHFK

SEQ ID NO: 16249 - protein, 7 aa, synthetic construct
  REGION 1..7: note = Synthetic Construct
RSKHHGK

SEQ ID NO: 16250 - protein, 7 aa, synthetic construct
  REGION 1..7: note = Synthetic Construct
RSKHHHK

SEQ ID NO: 16251 - protein, 7 aa, synthetic construct
  REGION 1..7: note = Synthetic Construct
RSKHHIK

SEQ ID NO: 16252 - protein, 7 aa, synthetic construct
  REGION 1..7: note = Synthetic Construct
RSKHHLK

SEQ ID NO: 16253 - protein, 7 aa, synthetic construct
  REGION 1..7: note = Synthetic Construct
RSKHHNK

SEQ ID NO: 16254 - protein, 7 aa, synthetic construct
  REGION 1..7: note = Synthetic Construct
RSKHHQK

SEQ ID NO: 16255 - protein, 7 aa, synthetic construct
  REGION 1..7: note = Synthetic Construct
RSKHHRK

SEQ ID NO: 16256 - protein, 7 aa, synthetic construct
  REGION 1..7: note = Synthetic Construct
RSKHHSK

SEQ ID NO: 16257 - protein, 7 aa, synthetic construct
  REGION 1..7: note = Synthetic Construct
RSKHHTK

SEQ ID NO: 16258 - protein, 7 aa, synthetic construct
  REGION 1..7: note = Synthetic Construct
RSKHHYK

SEQ ID NO: 16259 - protein, 7 aa, synthetic construct
  REGION 1..7: note = Synthetic Construct
RSKHIAK

SEQ ID NO: 16260 - protein, 7 aa, synthetic construct
  REGION 1..7: note = Synthetic Construct
RSKHIDK

SEQ ID NO: 16261 - protein, 7 aa, synthetic construct
  REGION 1..7: note = Synthetic Construct
RSKHIEK

SEQ ID NO: 16262 - protein, 7 aa, synthetic construct
  REGION 1..7: note = Synthetic Construct
RSKHIFK

SEQ ID NO: 16263 - protein, 7 aa, synthetic construct
  REGION 1..7: note = Synthetic Construct
RSKHIGK

SEQ ID NO: 16264 - protein, 7 aa, synthetic construct
  REGION 1..7: note = Synthetic Construct
RSKHIHK

SEQ ID NO: 16265 - protein, 7 aa, synthetic construct
  REGION 1..7: note = Synthetic Construct
RSKHIIK

SEQ ID NO: 16266 - protein, 7 aa, synthetic construct
  REGION 1..7: note = Synthetic Construct
RSKHILK

SEQ ID NO: 16267 - protein, 7 aa, synthetic construct
  REGION 1..7: note = Synthetic Construct
RSKHINK

SEQ ID NO: 16268 - protein, 7 aa, synthetic construct
  REGION 1..7: note = Synthetic Construct
RSKHIQK

SEQ ID NO: 16269 - protein, 7 aa, synthetic construct
  REGION 1..7: note = Synthetic Construct
RSKHIRK

SEQ ID NO: 16270 - protein, 7 aa, synthetic construct
  REGION 1..7: note = Synthetic Construct
RSKHISK

SEQ ID NO: 16271 - protein, 7 aa, synthetic construct
  REGION 1..7: note = Synthetic Construct
RSKHITK

SEQ ID NO: 16272 - protein, 7 aa, synthetic construct
  REGION 1..7: note = Synthetic Construct
RSKHIYK

SEQ ID NO: 16273 - protein, 7 aa, synthetic construct
  REGION 1..7: note = Synthetic Construct
RSKHLAK

SEQ ID NO: 16274 - protein, 7 aa, synthetic construct
  REGION 1..7: note = Synthetic Construct
RSKHLDK

SEQ ID NO: 16275 - protein, 7 aa, synthetic construct
  REGION 1..7: note = Synthetic Construct
RSKHLEK

SEQ ID NO: 16276 - protein, 7 aa, synthetic construct
  REGION 1..7: note = Synthetic Construct
RSKHLFK

SEQ ID NO: 16277 - protein, 7 aa, synthetic construct
  REGION 1..7: note = Synthetic Construct
RSKHLGK

SEQ ID NO: 16278 - protein, 7 aa, synthetic construct
  REGION 1..7: note = Synthetic Construct
RSKHLHK

SEQ ID NO: 16279 - protein, 7 aa, synthetic construct
  REGION 1..7: note = Synthetic Construct
RSKHLIK

SEQ ID NO: 16280 - protein, 7 aa, synthetic construct
  REGION 1..7: note = Synthetic Construct
RSKHLLK

SEQ ID NO: 16281 - protein, 7 aa, synthetic construct
  REGION 1..7: note = Synthetic Construct
RSKHLNK

SEQ ID NO: 16282 - protein, 7 aa, synthetic construct
  REGION 1..7: note = Synthetic Construct
RSKHLQK

SEQ ID NO: 16283 - protein, 7 aa, synthetic construct
  REGION 1..7: note = Synthetic Construct
RSKHLRK

SEQ ID NO: 16284 - protein, 7 aa, synthetic construct
  REGION 1..7: note = Synthetic Construct
RSKHLSK

SEQ ID NO: 16285 - protein, 7 aa, synthetic construct
  REGION 1..7: note = Synthetic Construct
RSKHLTK

SEQ ID NO: 16286 - protein, 7 aa, synthetic construct
  REGION 1..7: note = Synthetic Construct
RSKHLYK

SEQ ID NO: 16287 - protein, 7 aa, synthetic construct
  REGION 1..7: note = Synthetic Construct
RSKHNAK

SEQ ID NO: 16288 - protein, 7 aa, synthetic construct
  REGION 1..7: note = Synthetic Construct
RSKHNDK

SEQ ID NO: 16289 - protein, 7 aa, synthetic construct
  REGION 1..7: note = Synthetic Construct
RSKHNEK

SEQ ID NO: 16290 - protein, 7 aa, synthetic construct
  REGION 1..7: note = Synthetic Construct
RSKHNFK

SEQ ID NO: 16291 - protein, 7 aa, synthetic construct
  REGION 1..7: note = Synthetic Construct
RSKHNGK

SEQ ID NO: 16292 - protein, 7 aa, synthetic construct
  REGION 1..7: note = Synthetic Construct
RSKHNHK

SEQ ID NO: 16293 - protein, 7 aa, synthetic construct
  REGION 1..7: note = Synthetic Construct
RSKHNIK

SEQ ID NO: 16294 - protein, 7 aa, synthetic construct
  REGION 1..7: note = Synthetic Construct
RSKHNLK

SEQ ID NO: 16295 - protein, 7 aa, synthetic construct
  REGION 1..7: note = Synthetic Construct
RSKHNNK

SEQ ID NO: 16296 - protein, 7 aa, synthetic construct
  REGION 1..7: note = Synthetic Construct
RSKHNQK

SEQ ID NO: 16297 - protein, 7 aa, synthetic construct
  REGION 1..7: note = Synthetic Construct
RSKHNRK

SEQ ID NO: 16298 - protein, 7 aa, synthetic construct
  REGION 1..7: note = Synthetic Construct
RSKHNSK

SEQ ID NO: 16299 - protein, 7 aa, synthetic construct
  REGION 1..7: note = Synthetic Construct
RSKHNTK

SEQ ID NO: 16300 - protein, 7 aa, synthetic construct
  REGION 1..7: note = Synthetic Construct
RSKHNYK

SEQ ID NO: 16301 - protein, 7 aa, synthetic construct
  REGION 1..7: note = Synthetic Construct
RSKHQAK

SEQ ID NO: 16302 - protein, 7 aa, synthetic construct
  REGION 1..7: note = Synthetic Construct
RSKHQDK

SEQ ID NO: 16303 - protein, 7 aa, synthetic construct
  REGION 1..7: note = Synthetic Construct
RSKHQEK

SEQ ID NO: 16304 - protein, 7 aa, synthetic construct
  REGION 1..7: note = Synthetic Construct
RSKHQFK

SEQ ID NO: 16305 - protein, 7 aa, synthetic construct
  REGION 1..7: note = Synthetic Construct
RSKHQGK

SEQ ID NO: 16306 - protein, 7 aa, synthetic construct
  REGION 1..7: note = Synthetic Construct
RSKHQHK

SEQ ID NO: 16307 - protein, 7 aa, synthetic construct
  REGION 1..7: note = Synthetic Construct
RSKHQIK

SEQ ID NO: 16308 - protein, 7 aa, synthetic construct
  REGION 1..7: note = Synthetic Construct
RSKHQLK

SEQ ID NO: 16309 - protein, 7 aa, synthetic construct
  REGION 1..7: note = Synthetic Construct
RSKHQNK

SEQ ID NO: 16310 - protein, 7 aa, synthetic construct
  REGION 1..7: note = Synthetic Construct
RSKHQQK

SEQ ID NO: 16311 - protein, 7 aa, synthetic construct
  REGION 1..7: note = Synthetic Construct
RSKHQRK

SEQ ID NO: 16312 - protein, 7 aa, synthetic construct
  REGION 1..7: note = Synthetic Construct
RSKHQSK

SEQ ID NO: 16313 - protein, 7 aa, synthetic construct
  REGION 1..7: note = Synthetic Construct
RSKHQTK

SEQ ID NO: 16314 - protein, 7 aa, synthetic construct
  REGION 1..7: note = Synthetic Construct
RSKHQYK

SEQ ID NO: 16315 - protein, 7 aa, synthetic construct
  REGION 1..7: note = Synthetic Construct
RSKHRAK

SEQ ID NO: 16316 - protein, 7 aa, synthetic construct
  REGION 1..7: note = Synthetic Construct
RSKHRDK

SEQ ID NO: 16317 - protein, 7 aa, synthetic construct
  REGION 1..7: note = Synthetic Construct
RSKHREK

SEQ ID NO: 16318 - protein, 7 aa, synthetic construct
  REGION 1..7: note = Synthetic Construct
RSKHRFK

SEQ ID NO: 16319 - protein, 7 aa, synthetic construct
  REGION 1..7: note = Synthetic Construct
RSKHRGK

SEQ ID NO: 16320 - protein, 7 aa, synthetic construct
  REGION 1..7: note = Synthetic Construct
RSKHRHK

SEQ ID NO: 16321 - protein, 7 aa, synthetic construct
  REGION 1..7: note = Synthetic Construct
RSKHRIK

SEQ ID NO: 16322 - protein, 7 aa, synthetic construct
  REGION 1..7: note = Synthetic Construct
RSKHRLK

SEQ ID NO: 16323 - protein, 7 aa, synthetic construct
  REGION 1..7: note = Synthetic Construct
RSKHRNK

SEQ ID NO: 16324 - protein, 7 aa, synthetic construct
  REGION 1..7: note = Synthetic Construct
RSKHRQK

SEQ ID NO: 16325 - protein, 7 aa, synthetic construct
  REGION 1..7: note = Synthetic Construct
RSKHRRK

SEQ ID NO: 16326 - protein, 7 aa, synthetic construct
  REGION 1..7: note = Synthetic Construct
RSKHRSK

SEQ ID NO: 16327 - protein, 7 aa, synthetic construct
  REGION 1..7: note = Synthetic Construct
RSKHRTK

SEQ ID NO: 16328 - protein, 7 aa, synthetic construct
  REGION 1..7: note = Synthetic Construct
RSKHRYK

SEQ ID NO: 16329 - protein, 7 aa, synthetic construct
  REGION 1..7: note = Synthetic Construct
RSKHSAK

SEQ ID NO: 16330 - protein, 7 aa, synthetic construct
  REGION 1..7: note = Synthetic Construct
RSKHSDK

SEQ ID NO: 16331 - protein, 7 aa, synthetic construct
  REGION 1..7: note = Synthetic Construct
RSKHSEK

SEQ ID NO: 16332 - protein, 7 aa, synthetic construct
  REGION 1..7: note = Synthetic Construct
RSKHSFK

SEQ ID NO: 16333 - protein, 7 aa, synthetic construct
  REGION 1..7: note = Synthetic Construct
RSKHSGK

SEQ ID NO: 16334 - protein, 7 aa, synthetic construct
  REGION 1..7: note = Synthetic Construct
RSKHSHK

SEQ ID NO: 16335 - protein, 7 aa, synthetic construct
  REGION 1..7: note = Synthetic Construct
RSKHSIK

SEQ ID NO: 16336 - protein, 7 aa, synthetic construct
  REGION 1..7: note = Synthetic Construct
RSKHSLK

SEQ ID NO: 16337 - protein, 7 aa, synthetic construct
  REGION 1..7: note = Synthetic Construct
RSKHSNK

SEQ ID NO: 16338 - protein, 7 aa, synthetic construct
  REGION 1..7: note = Synthetic Construct
RSKHSQK

SEQ ID NO: 16339 - protein, 7 aa, synthetic construct
  REGION 1..7: note = Synthetic Construct
RSKHSRK

SEQ ID NO: 16340 - protein, 7 aa, synthetic construct
  REGION 1..7: note = Synthetic Construct
RSKHSSK

SEQ ID NO: 16341 - protein, 7 aa, synthetic construct
  REGION 1..7: note = Synthetic Construct
RSKHSTK

SEQ ID NO: 16342 - protein, 7 aa, synthetic construct
  REGION 1..7: note = Synthetic Construct
RSKHSYK

SEQ ID NO: 16343 - protein, 7 aa, synthetic construct
  REGION 1..7: note = Synthetic Construct
RSKHTAK

SEQ ID NO: 16344 - protein, 7 aa, synthetic construct
  REGION 1..7: note = Synthetic Construct
RSKHTDK

SEQ ID NO: 16345 - protein, 7 aa, synthetic construct
  REGION 1..7: note = Synthetic Construct
RSKHTEK

SEQ ID NO: 16346 - protein, 7 aa, synthetic construct
  REGION 1..7: note = Synthetic Construct
RSKHTFK

SEQ ID NO: 16347 - protein, 7 aa, synthetic construct
  REGION 1..7: note = Synthetic Construct
RSKHTGK

SEQ ID NO: 16348 - protein, 7 aa, synthetic construct
  REGION 1..7: note = Synthetic Construct
RSKHTHK

SEQ ID NO: 16349 - protein, 7 aa, synthetic construct
  REGION 1..7: note = Synthetic Construct
RSKHTIK

SEQ ID NO: 16350 - protein, 7 aa, synthetic construct
  REGION 1..7: note = Synthetic Construct
RSKHTLK

SEQ ID NO: 16351 - protein, 7 aa, synthetic construct
  REGION 1..7: note = Synthetic Construct
RSKHTNK

SEQ ID NO: 16352 - protein, 7 aa, synthetic construct
  REGION 1..7: note = Synthetic Construct
RSKHTQK

SEQ ID NO: 16353 - protein, 7 aa, synthetic construct
  REGION 1..7: note = Synthetic Construct
RSKHTRK

SEQ ID NO: 16354 - protein, 7 aa, synthetic construct
  REGION 1..7: note = Synthetic Construct
RSKHTSK

SEQ ID NO: 16355 - protein, 7 aa, synthetic construct
  REGION 1..7: note = Synthetic Construct
RSKHTTK

SEQ ID NO: 16356 - protein, 7 aa, synthetic construct
  REGION 1..7: note = Synthetic Construct
RSKHTYK

SEQ ID NO: 16357 - protein, 7 aa, synthetic construct
  REGION 1..7: note = Synthetic Construct
RSKHYAK

SEQ ID NO: 16358 - protein, 7 aa, synthetic construct
  REGION 1..7: note = Synthetic Construct
RSKHYDK

SEQ ID NO: 16359 - protein, 7 aa, synthetic construct
  REGION 1..7: note = Synthetic Construct
RSKHYEK

SEQ ID NO: 16360 - protein, 7 aa, synthetic construct
  REGION 1..7: note = Synthetic Construct
RSKHYFK

SEQ ID NO: 16361 - protein, 7 aa, synthetic construct
  REGION 1..7: note = Synthetic Construct
RSKHYGK

SEQ ID NO: 16362 - protein, 7 aa, synthetic construct
  REGION 1..7: note = Synthetic Construct
RSKHYHK

SEQ ID NO: 16363 - protein, 7 aa, synthetic construct
  REGION 1..7: note = Synthetic Construct
RSKHYIK

SEQ ID NO: 16364 - protein, 7 aa, synthetic construct
  REGION 1..7: note = Synthetic Construct
RSKHYLK

SEQ ID NO: 16365 - protein, 7 aa, synthetic construct
  REGION 1..7: note = Synthetic Construct
RSKHYNK

SEQ ID NO: 16366 - protein, 7 aa, synthetic construct
  REGION 1..7: note = Synthetic Construct
RSKHYQK

SEQ ID NO: 16367 - protein, 7 aa, synthetic construct
  REGION 1..7: note = Synthetic Construct
RSKHYRK

SEQ ID NO: 16368 - protein, 7 aa, synthetic construct
  REGION 1..7: note = Synthetic Construct
RSKHYSK

SEQ ID NO: 16369 - protein, 7 aa, synthetic construct
  REGION 1..7: note = Synthetic Construct
RSKHYTK

SEQ ID NO: 16370 - protein, 7 aa, synthetic construct
  REGION 1..7: note = Synthetic Construct
RSKHYYK

SEQ ID NO: 16371 - protein, 7 aa, synthetic construct
  REGION 1..7: note = Synthetic Construct
RSKIAAK

SEQ ID NO: 16372 - protein, 7 aa, synthetic construct
  REGION 1..7: note = Synthetic Construct
RSKIADK

SEQ ID NO: 16373 - protein, 7 aa, synthetic construct
  REGION 1..7: note = Synthetic Construct
RSKIAEK

SEQ ID NO: 16374 - protein, 7 aa, synthetic construct
  REGION 1..7: note = Synthetic Construct
RSKIAFK

SEQ ID NO: 16375 - protein, 7 aa, synthetic construct
  REGION 1..7: note = Synthetic Construct
RSKIAGK

SEQ ID NO: 16376 - protein, 7 aa, synthetic construct
  REGION 1..7: note = Synthetic Construct
RSKIAHK

SEQ ID NO: 16377 - protein, 7 aa, synthetic construct
  REGION 1..7: note = Synthetic Construct
RSKIAIK

SEQ ID NO: 16378 - protein, 7 aa, synthetic construct
  REGION 1..7: note = Synthetic Construct
RSKIALK

SEQ ID NO: 16379 - protein, 7 aa, synthetic construct
  REGION 1..7: note = Synthetic Construct
RSKIANK

SEQ ID NO: 16380 - protein, 7 aa, synthetic construct
  REGION 1..7: note = Synthetic Construct
RSKIAQK

SEQ ID NO: 16381 - protein, 7 aa, synthetic construct
  REGION 1..7: note = Synthetic Construct
RSKIARK

SEQ ID NO: 16382 - protein, 7 aa, synthetic construct
  REGION 1..7: note = Synthetic Construct
RSKIASK

SEQ ID NO: 16383 - protein, 7 aa, synthetic construct
  REGION 1..7: note = Synthetic Construct
RSKIATK

SEQ ID NO: 16384 - protein, 7 aa, synthetic construct
  REGION 1..7: note = Synthetic Construct
RSKIAYK

SEQ ID NO: 16385 - protein, 7 aa, synthetic construct
  REGION 1..7: note = Synthetic Construct
RSKIDAK

SEQ ID NO: 16386 - protein, 7 aa, synthetic construct
  REGION 1..7: note = Synthetic Construct
RSKIDDK

SEQ ID NO: 16387 - protein, 7 aa, synthetic construct
  REGION 1..7: note = Synthetic Construct
RSKIDEK

SEQ ID NO: 16388 - protein, 7 aa, synthetic construct
  REGION 1..7: note = Synthetic Construct
RSKIDFK

SEQ ID NO: 16389 - protein, 7 aa, synthetic construct
  REGION 1..7: note = Synthetic Construct
RSKIDGK

SEQ ID NO: 16390 - protein, 7 aa, synthetic construct
  REGION 1..7: note = Synthetic Construct
RSKIDHK

SEQ ID NO: 16391 - protein, 7 aa, synthetic construct
  REGION 1..7: note = Synthetic Construct
RSKIDIK

SEQ ID NO: 16392 - protein, 7 aa, synthetic construct
  REGION 1..7: note = Synthetic Construct
RSKIDLK

SEQ ID NO: 16393 - protein, 7 aa, synthetic construct
  REGION 1..7: note = Synthetic Construct
RSKIDNK

SEQ ID NO: 16394 - protein, 7 aa, synthetic construct
  REGION 1..7: note = Synthetic Construct
RSKIDQK

SEQ ID NO: 16395 - protein, 7 aa, synthetic construct
  REGION 1..7: note = Synthetic Construct
RSKIDRK

SEQ ID NO: 16396 - protein, 7 aa, synthetic construct
  REGION 1..7: note = Synthetic Construct
RSKIDSK

SEQ ID NO: 16397 - protein, 7 aa, synthetic construct
  REGION 1..7: note = Synthetic Construct
RSKIDTK

SEQ ID NO: 16398 - protein, 7 aa, synthetic construct
  REGION 1..7: note = Synthetic Construct
RSKIDYK

SEQ ID NO: 16399 - protein, 7 aa, synthetic construct
  REGION 1..7: note = Synthetic Construct
RSKIEAK

SEQ ID NO: 16400 - protein, 7 aa, synthetic construct
  REGION 1..7: note = Synthetic Construct
RSKIEDK

SEQ ID NO: 16401 - protein, 7 aa, synthetic construct
  REGION 1..7: note = Synthetic Construct
RSKIEEK

SEQ ID NO: 16402 - protein, 7 aa, synthetic construct
  REGION 1..7: note = Synthetic Construct
RSKIEFK

SEQ ID NO: 16403 - protein, 7 aa, synthetic construct
  REGION 1..7: note = Synthetic Construct
RSKIEGK

SEQ ID NO: 16404 - protein, 7 aa, synthetic construct
  REGION 1..7: note = Synthetic Construct
RSKIEHK

SEQ ID NO: 16405 - protein, 7 aa, synthetic construct
  REGION 1..7: note = Synthetic Construct
RSKIEIK

SEQ ID NO: 16406 - protein, 7 aa, synthetic construct
  REGION 1..7: note = Synthetic Construct
RSKIELK

SEQ ID NO: 16407 - protein, 7 aa, synthetic construct
  REGION 1..7: note = Synthetic Construct
RSKIENK

SEQ ID NO: 16408 - protein, 7 aa, synthetic construct
  REGION 1..7: note = Synthetic Construct
RSKIEQK

SEQ ID NO: 16409 - protein, 7 aa, synthetic construct
  REGION 1..7: note = Synthetic Construct
RSKIERK

SEQ ID NO: 16410 - protein, 7 aa, synthetic construct
  REGION 1..7: note = Synthetic Construct
RSKIESK

SEQ ID NO: 16411 - protein, 7 aa, synthetic construct
  REGION 1..7: note = Synthetic Construct
RSKIETK

SEQ ID NO: 16412 - protein, 7 aa, synthetic construct
  REGION 1..7: note = Synthetic Construct
RSKIEYK

SEQ ID NO: 16413 - protein, 7 aa, synthetic construct
  REGION 1..7: note = Synthetic Construct
RSKIFAK

SEQ ID NO: 16414 - protein, 7 aa, synthetic construct
  REGION 1..7: note = Synthetic Construct
RSKIFDK

SEQ ID NO: 16415 - protein, 7 aa, synthetic construct
  REGION 1..7: note = Synthetic Construct
RSKIFEK

SEQ ID NO: 16416 - protein, 7 aa, synthetic construct
  REGION 1..7: note = Synthetic Construct
RSKIFFK

SEQ ID NO: 16417 - protein, 7 aa, synthetic construct
  REGION 1..7: note = Synthetic Construct
RSKIFGK

SEQ ID NO: 16418 - protein, 7 aa, synthetic construct
  REGION 1..7: note = Synthetic Construct
RSKIFHK

SEQ ID NO: 16419 - protein, 7 aa, synthetic construct
  REGION 1..7: note = Synthetic Construct
RSKIFIK

SEQ ID NO: 16420 - protein, 7 aa, synthetic construct
  REGION 1..7: note = Synthetic Construct
RSKIFLK

SEQ ID NO: 16421 - protein, 7 aa, synthetic construct
  REGION 1..7: note = Synthetic Construct
RSKIFNK

SEQ ID NO: 16422 - protein, 7 aa, synthetic construct
  REGION 1..7: note = Synthetic Construct
RSKIFQK

SEQ ID NO: 16423 - protein, 7 aa, synthetic construct
  REGION 1..7: note = Synthetic Construct
RSKIFRK

SEQ ID NO: 16424 - protein, 7 aa, synthetic construct
  REGION 1..7: note = Synthetic Construct
RSKIFSK

SEQ ID NO: 16425 - protein, 7 aa, synthetic construct
  REGION 1..7: note = Synthetic Construct
RSKIFTK

SEQ ID NO: 16426 - protein, 7 aa, synthetic construct
  REGION 1..7: note = Synthetic Construct
RSKIFYK

SEQ ID NO: 16427 - protein, 7 aa, synthetic construct
  REGION 1..7: note = Synthetic Construct
RSKIGAK

SEQ ID NO: 16428 - protein, 7 aa, synthetic construct
  REGION 1..7: note = Synthetic Construct
RSKIGDK

SEQ ID NO: 16429 - protein, 7 aa, synthetic construct
  REGION 1..7: note = Synthetic Construct
RSKIGEK

SEQ ID NO: 16430 - protein, 7 aa, synthetic construct
  REGION 1..7: note = Synthetic Construct
RSKIGFK

SEQ ID NO: 16431 - protein, 7 aa, synthetic construct
  REGION 1..7: note = Synthetic Construct
RSKIGGK

SEQ ID NO: 16432 - protein, 7 aa, synthetic construct
  REGION 1..7: note = Synthetic Construct
RSKIGHK

SEQ ID NO: 16433 - protein, 7 aa, synthetic construct
  REGION 1..7: note = Synthetic Construct
RSKIGIK

SEQ ID NO: 16434 - protein, 7 aa, synthetic construct
  REGION 1..7: note = Synthetic Construct
RSKIGLK

SEQ ID NO: 16435 - protein, 7 aa, synthetic construct
  REGION 1..7: note = Synthetic Construct
RSKIGNK

SEQ ID NO: 16436 - protein, 7 aa, synthetic construct
  REGION 1..7: note = Synthetic Construct
RSKIGQK

SEQ ID NO: 16437 - protein, 7 aa, synthetic construct
  REGION 1..7: note = Synthetic Construct
RSKIGRK

SEQ ID NO: 16438 - protein, 7 aa, synthetic construct
  REGION 1..7: note = Synthetic Construct
RSKIGSK

SEQ ID NO: 16439 - protein, 7 aa, synthetic construct
  REGION 1..7: note = Synthetic Construct
RSKIGTK

SEQ ID NO: 16440 - protein, 7 aa, synthetic construct
  REGION 1..7: note = Synthetic Construct
RSKIGYK

SEQ ID NO: 16441 - protein, 7 aa, synthetic construct
  REGION 1..7: note = Synthetic Construct
RSKIHAK

SEQ ID NO: 16442 - protein, 7 aa, synthetic construct
  REGION 1..7: note = Synthetic Construct
RSKIHDK

SEQ ID NO: 16443 - protein, 7 aa, synthetic construct
  REGION 1..7: note = Synthetic Construct
RSKIHEK

SEQ ID NO: 16444 - protein, 7 aa, synthetic construct
  REGION 1..7: note = Synthetic Construct
RSKIHFK

SEQ ID NO: 16445 - protein, 7 aa, synthetic construct
  REGION 1..7: note = Synthetic Construct
RSKIHGK

SEQ ID NO: 16446 - protein, 7 aa, synthetic construct
  REGION 1..7: note = Synthetic Construct
RSKIHHK

SEQ ID NO: 16447 - protein, 7 aa, synthetic construct
  REGION 1..7: note = Synthetic Construct
RSKIHIK

SEQ ID NO: 16448 - protein, 7 aa, synthetic construct
  REGION 1..7: note = Synthetic Construct
RSKIHLK

SEQ ID NO: 16449 - protein, 7 aa, synthetic construct
  REGION 1..7: note = Synthetic Construct
RSKIHNK

SEQ ID NO: 16450 - protein, 7 aa, synthetic construct
  REGION 1..7: note = Synthetic Construct
RSKIHQK

SEQ ID NO: 16451 - protein, 7 aa, synthetic construct
  REGION 1..7: note = Synthetic Construct
RSKIHRK

SEQ ID NO: 16452 - protein, 7 aa, synthetic construct
  REGION 1..7: note = Synthetic Construct
RSKIHSK

SEQ ID NO: 16453 - protein, 7 aa, synthetic construct
  REGION 1..7: note = Synthetic Construct
RSKIHTK

SEQ ID NO: 16454 - protein, 7 aa, synthetic construct
  REGION 1..7: note = Synthetic Construct
RSKIHYK

SEQ ID NO: 16455 - protein, 7 aa, synthetic construct
  REGION 1..7: note = Synthetic Construct
RSKIIAK

SEQ ID NO: 16456 - protein, 7 aa, synthetic construct
  REGION 1..7: note = Synthetic Construct
RSKIIDK

SEQ ID NO: 16457 - protein, 7 aa, synthetic construct
  REGION 1..7: note = Synthetic Construct
RSKIIEK

SEQ ID NO: 16458 - protein, 7 aa, synthetic construct
  REGION 1..7: note = Synthetic Construct
RSKIIFK

SEQ ID NO: 16459 - protein, 7 aa, synthetic construct
  REGION 1..7: note = Synthetic Construct
RSKIIGK

SEQ ID NO: 16460 - protein, 7 aa, synthetic construct
  REGION 1..7: note = Synthetic Construct
RSKIIHK

SEQ ID NO: 16461 - protein, 7 aa, synthetic construct
  REGION 1..7: note = Synthetic Construct
RSKIIIK

SEQ ID NO: 16462 - protein, 7 aa, synthetic construct
  REGION 1..7: note = Synthetic Construct
RSKIILK

SEQ ID NO: 16463 - protein, 7 aa, synthetic construct
  REGION 1..7: note = Synthetic Construct
RSKIINK

SEQ ID NO: 16464 - protein, 7 aa, synthetic construct
  REGION 1..7: note = Synthetic Construct
RSKIIQK

SEQ ID NO: 16465 - protein, 7 aa, synthetic construct
  REGION 1..7: note = Synthetic Construct
RSKIIRK

SEQ ID NO: 16466 - protein, 7 aa, synthetic construct
  REGION 1..7: note = Synthetic Construct
RSKIISK

SEQ ID NO: 16467 - protein, 7 aa, synthetic construct
  REGION 1..7: note = Synthetic Construct
RSKIITK

SEQ ID NO: 16468 - protein, 7 aa, synthetic construct
  REGION 1..7: note = Synthetic Construct
RSKIIYK

SEQ ID NO: 16469 - protein, 7 aa, synthetic construct
  REGION 1..7: note = Synthetic Construct
RSKILAK

SEQ ID NO: 16470 - protein, 7 aa, synthetic construct
  REGION 1..7: note = Synthetic Construct
RSKILDK

SEQ ID NO: 16471 - protein, 7 aa, synthetic construct
  REGION 1..7: note = Synthetic Construct
RSKILEK

SEQ ID NO: 16472 - protein, 7 aa, synthetic construct
  REGION 1..7: note = Synthetic Construct
RSKILFK

SEQ ID NO: 16473 - protein, 7 aa, synthetic construct
  REGION 1..7: note = Synthetic Construct
RSKILGK

SEQ ID NO: 16474 - protein, 7 aa, synthetic construct
  REGION 1..7: note = Synthetic Construct
RSKILHK

SEQ ID NO: 16475 - protein, 7 aa, synthetic construct
  REGION 1..7: note = Synthetic Construct
RSKILIK

SEQ ID NO: 16476 - protein, 7 aa, synthetic construct
  REGION 1..7: note = Synthetic Construct
RSKILLK

SEQ ID NO: 16477 - protein, 7 aa, synthetic construct
  REGION 1..7: note = Synthetic Construct
RSKILNK

SEQ ID NO: 16478 - protein, 7 aa, synthetic construct
  REGION 1..7: note = Synthetic Construct
RSKILQK

SEQ ID NO: 16479 - protein, 7 aa, synthetic construct
  REGION 1..7: note = Synthetic Construct
RSKILRK

SEQ ID NO: 16480 - protein, 7 aa, synthetic construct
  REGION 1..7: note = Synthetic Construct
RSKILSK

SEQ ID NO: 16481 - protein, 7 aa, synthetic construct
  REGION 1..7: note = Synthetic Construct
RSKILTK

SEQ ID NO: 16482 - protein, 7 aa, synthetic construct
  REGION 1..7: note = Synthetic Construct
RSKILYK

SEQ ID NO: 16483 - protein, 7 aa, synthetic construct
  REGION 1..7: note = Synthetic Construct
RSKINAK

SEQ ID NO: 16484 - protein, 7 aa, synthetic construct
  REGION 1..7: note = Synthetic Construct
RSKINDK

SEQ ID NO: 16485 - protein, 7 aa, synthetic construct
  REGION 1..7: note = Synthetic Construct
RSKINEK

SEQ ID NO: 16486 - protein, 7 aa, synthetic construct
  REGION 1..7: note = Synthetic Construct
RSKINFK

SEQ ID NO: 16487 - protein, 7 aa, synthetic construct
  REGION 1..7: note = Synthetic Construct
RSKINGK

SEQ ID NO: 16488 - protein, 7 aa, synthetic construct
  REGION 1..7: note = Synthetic Construct
RSKINHK

SEQ ID NO: 16489 - protein, 7 aa, synthetic construct
  REGION 1..7: note = Synthetic Construct
RSKINIK

SEQ ID NO: 16490 - protein, 7 aa, synthetic construct
  REGION 1..7: note = Synthetic Construct
RSKINLK

SEQ ID NO: 16491 - protein, 7 aa, synthetic construct
  REGION 1..7: note = Synthetic Construct
RSKINNK

SEQ ID NO: 16492 - protein, 7 aa, synthetic construct
  REGION 1..7: note = Synthetic Construct
RSKINQK

SEQ ID NO: 16493 - protein, 7 aa, synthetic construct
  REGION 1..7: note = Synthetic Construct
RSKINRK

SEQ ID NO: 16494 - protein, 7 aa, synthetic construct
  REGION 1..7: note = Synthetic Construct
RSKINSK

SEQ ID NO: 16495 - protein, 7 aa, synthetic construct
  REGION 1..7: note = Synthetic Construct
RSKINTK

SEQ ID NO: 16496 - protein, 7 aa, synthetic construct
  REGION 1..7: note = Synthetic Construct
RSKINYK

SEQ ID NO: 16497 - protein, 7 aa, synthetic construct
  REGION 1..7: note = Synthetic Construct
RSKIQAK

SEQ ID NO: 16498 - protein, 7 aa, synthetic construct
  REGION 1..7: note = Synthetic Construct
RSKIQDK

SEQ ID NO: 16499 - protein, 7 aa, synthetic construct
  REGION 1..7: note = Synthetic Construct
RSKIQEK

SEQ ID NO: 16500 - protein, 7 aa, synthetic construct
  REGION 1..7: note = Synthetic Construct
RSKIQFK

SEQ ID NO: 16501 - protein, 7 aa, synthetic construct
  REGION 1..7: note = Synthetic Construct
RSKIQGK

SEQ ID NO: 16502 - protein, 7 aa, synthetic construct
  REGION 1..7: note = Synthetic Construct
RSKIQHK

SEQ ID NO: 16503 - protein, 7 aa, synthetic construct
  REGION 1..7: note = Synthetic Construct
RSKIQIK

SEQ ID NO: 16504 - protein, 7 aa, synthetic construct
  REGION 1..7: note = Synthetic Construct
RSKIQLK

SEQ ID NO: 16505 - protein, 7 aa, synthetic construct
  REGION 1..7: note = Synthetic Construct
RSKIQNK

SEQ ID NO: 16506 - protein, 7 aa, synthetic construct
  REGION 1..7: note = Synthetic Construct
RSKIQQK

SEQ ID NO: 16507 - protein, 7 aa, synthetic construct
  REGION 1..7: note = Synthetic Construct
RSKIQRK

SEQ ID NO: 16508 - protein, 7 aa, synthetic construct
  REGION 1..7: note = Synthetic Construct
RSKIQSK

SEQ ID NO: 16509 - protein, 7 aa, synthetic construct
  REGION 1..7: note = Synthetic Construct
RSKIQTK

SEQ ID NO: 16510 - protein, 7 aa, synthetic construct
  REGION 1..7: note = Synthetic Construct
RSKIQYK

SEQ ID NO: 16511 - protein, 7 aa, synthetic construct
  REGION 1..7: note = Synthetic Construct
RSKIRAK

SEQ ID NO: 16512 - protein, 7 aa, synthetic construct
  REGION 1..7: note = Synthetic Construct
RSKIRDK

SEQ ID NO: 16513 - protein, 7 aa, synthetic construct
  REGION 1..7: note = Synthetic Construct
RSKIREK

SEQ ID NO: 16514 - protein, 7 aa, synthetic construct
  REGION 1..7: note = Synthetic Construct
RSKIRFK

SEQ ID NO: 16515 - protein, 7 aa, synthetic construct
  REGION 1..7: note = Synthetic Construct
RSKIRGK

SEQ ID NO: 16516 - protein, 7 aa, synthetic construct
  REGION 1..7: note = Synthetic Construct
RSKIRHK

SEQ ID NO: 16517 - protein, 7 aa, synthetic construct
  REGION 1..7: note = Synthetic Construct
RSKIRIK

SEQ ID NO: 16518 - protein, 7 aa, synthetic construct
  REGION 1..7: note = Synthetic Construct
RSKIRLK

SEQ ID NO: 16519 - protein, 7 aa, synthetic construct
  REGION 1..7: note = Synthetic Construct
RSKIRNK

SEQ ID NO: 16520 - protein, 7 aa, synthetic construct
  REGION 1..7: note = Synthetic Construct
RSKIRQK

SEQ ID NO: 16521 - protein, 7 aa, synthetic construct
  REGION 1..7: note = Synthetic Construct
RSKIRRK

SEQ ID NO: 16522 - protein, 7 aa, synthetic construct
  REGION 1..7: note = Synthetic Construct
RSKIRSK

SEQ ID NO: 16523 - protein, 7 aa, synthetic construct
  REGION 1..7: note = Synthetic Construct
RSKIRTK

SEQ ID NO: 16524 - protein, 7 aa, synthetic construct
  REGION 1..7: note = Synthetic Construct
RSKIRYK

SEQ ID NO: 16525 - protein, 7 aa, synthetic construct
  REGION 1..7: note = Synthetic Construct
RSKISAK

SEQ ID NO: 16526 - protein, 7 aa, synthetic construct
  REGION 1..7: note = Synthetic Construct
RSKISDK

SEQ ID NO: 16527 - protein, 7 aa, synthetic construct
  REGION 1..7: note = Synthetic Construct
RSKISEK

SEQ ID NO: 16528 - protein, 7 aa, synthetic construct
  REGION 1..7: note = Synthetic Construct
RSKISFK

SEQ ID NO: 16529 - protein, 7 aa, synthetic construct
  REGION 1..7: note = Synthetic Construct
RSKISGK

SEQ ID NO: 16530 - protein, 7 aa, synthetic construct
  REGION 1..7: note = Synthetic Construct
RSKISHK

SEQ ID NO: 16531 - protein, 7 aa, synthetic construct
  REGION 1..7: note = Synthetic Construct
RSKISIK

SEQ ID NO: 16532 - protein, 7 aa, synthetic construct
  REGION 1..7: note = Synthetic Construct
RSKISLK

SEQ ID NO: 16533 - protein, 7 aa, synthetic construct
  REGION 1..7: note = Synthetic Construct
RSKISNK

SEQ ID NO: 16534 - protein, 7 aa, synthetic construct
  REGION 1..7: note = Synthetic Construct
RSKISQK

SEQ ID NO: 16535 - protein, 7 aa, synthetic construct
  REGION 1..7: note = Synthetic Construct
RSKISRK

SEQ ID NO: 16536 - protein, 7 aa, synthetic construct
  REGION 1..7: note = Synthetic Construct
RSKISSK

SEQ ID NO: 16537 - protein, 7 aa, synthetic construct
  REGION 1..7: note = Synthetic Construct
RSKISTK

SEQ ID NO: 16538 - protein, 7 aa, synthetic construct
  REGION 1..7: note = Synthetic Construct
RSKISYK

SEQ ID NO: 16539 - protein, 7 aa, synthetic construct
  REGION 1..7: note = Synthetic Construct
RSKITAK

SEQ ID NO: 16540 - protein, 7 aa, synthetic construct
  REGION 1..7: note = Synthetic Construct
RSKITDK

SEQ ID NO: 16541 - protein, 7 aa, synthetic construct
  REGION 1..7: note = Synthetic Construct
RSKITEK

SEQ ID NO: 16542 - protein, 7 aa, synthetic construct
  REGION 1..7: note = Synthetic Construct
RSKITFK

SEQ ID NO: 16543 - protein, 7 aa, synthetic construct
  REGION 1..7: note = Synthetic Construct
RSKITGK

SEQ ID NO: 16544 - protein, 7 aa, synthetic construct
  REGION 1..7: note = Synthetic Construct
RSKITHK

SEQ ID NO: 16545 - protein, 7 aa, synthetic construct
  REGION 1..7: note = Synthetic Construct
RSKITIK

SEQ ID NO: 16546 - protein, 7 aa, synthetic construct
  REGION 1..7: note = Synthetic Construct
RSKITLK

SEQ ID NO: 16547 - protein, 7 aa, synthetic construct
  REGION 1..7: note = Synthetic Construct
RSKITNK

SEQ ID NO: 16548 - protein, 7 aa, synthetic construct
  REGION 1..7: note = Synthetic Construct
RSKITQK

SEQ ID NO: 16549 - protein, 7 aa, synthetic construct
  REGION 1..7: note = Synthetic Construct
RSKITRK

SEQ ID NO: 16550 - protein, 7 aa, synthetic construct
  REGION 1..7: note = Synthetic Construct
RSKITSK

SEQ ID NO: 16551 - protein, 7 aa, synthetic construct
  REGION 1..7: note = Synthetic Construct
RSKITTK

SEQ ID NO: 16552 - protein, 7 aa, synthetic construct
  REGION 1..7: note = Synthetic Construct
RSKITYK

SEQ ID NO: 16553 - protein, 7 aa, synthetic construct
  REGION 1..7: note = Synthetic Construct
RSKIYAK

SEQ ID NO: 16554 - protein, 7 aa, synthetic construct
  REGION 1..7: note = Synthetic Construct
RSKIYDK

SEQ ID NO: 16555 - protein, 7 aa, synthetic construct
  REGION 1..7: note = Synthetic Construct
RSKIYEK

SEQ ID NO: 16556 - protein, 7 aa, synthetic construct
  REGION 1..7: note = Synthetic Construct
RSKIYFK

SEQ ID NO: 16557 - protein, 7 aa, synthetic construct
  REGION 1..7: note = Synthetic Construct
RSKIYGK

SEQ ID NO: 16558 - protein, 7 aa, synthetic construct
  REGION 1..7: note = Synthetic Construct
RSKIYHK

SEQ ID NO: 16559 - protein, 7 aa, synthetic construct
  REGION 1..7: note = Synthetic Construct
RSKIYIK

SEQ ID NO: 16560 - protein, 7 aa, synthetic construct
  REGION 1..7: note = Synthetic Construct
RSKIYLK

SEQ ID NO: 16561 - protein, 7 aa, synthetic construct
  REGION 1..7: note = Synthetic Construct
RSKIYNK

SEQ ID NO: 16562 - protein, 7 aa, synthetic construct
  REGION 1..7: note = Synthetic Construct
RSKIYQK

SEQ ID NO: 16563 - protein, 7 aa, synthetic construct
  REGION 1..7: note = Synthetic Construct
RSKIYRK

SEQ ID NO: 16564 - protein, 7 aa, synthetic construct
  REGION 1..7: note = Synthetic Construct
RSKIYSK

SEQ ID NO: 16565 - protein, 7 aa, synthetic construct
  REGION 1..7: note = Synthetic Construct
RSKIYTK

SEQ ID NO: 16566 - protein, 7 aa, synthetic construct
  REGION 1..7: note = Synthetic Construct
RSKIYYK

SEQ ID NO: 16567 - protein, 7 aa, synthetic construct
  REGION 1..7: note = Synthetic Construct
RSKLAAK

SEQ ID NO: 16568 - protein, 7 aa, synthetic construct
  REGION 1..7: note = Synthetic Construct
RSKLADK

SEQ ID NO: 16569 - protein, 7 aa, synthetic construct
  REGION 1..7: note = Synthetic Construct
RSKLAEK

SEQ ID NO: 16570 - protein, 7 aa, synthetic construct
  REGION 1..7: note = Synthetic Construct
RSKLAFK

SEQ ID NO: 16571 - protein, 7 aa, synthetic construct
  REGION 1..7: note = Synthetic Construct
RSKLAGK

SEQ ID NO: 16572 - protein, 7 aa, synthetic construct
  REGION 1..7: note = Synthetic Construct
RSKLAHK

SEQ ID NO: 16573 - protein, 7 aa, synthetic construct
  REGION 1..7: note = Synthetic Construct
RSKLAIK

SEQ ID NO: 16574 - protein, 7 aa, synthetic construct
  REGION 1..7: note = Synthetic Construct
RSKLALK

SEQ ID NO: 16575 - protein, 7 aa, synthetic construct
  REGION 1..7: note = Synthetic Construct
RSKLANK

SEQ ID NO: 16576 - protein, 7 aa, synthetic construct
  REGION 1..7: note = Synthetic Construct
RSKLAQK

SEQ ID NO: 16577 - protein, 7 aa, synthetic construct
  REGION 1..7: note = Synthetic Construct
RSKLARK

SEQ ID NO: 16578 - protein, 7 aa, synthetic construct
  REGION 1..7: note = Synthetic Construct
RSKLASK

SEQ ID NO: 16579 - protein, 7 aa, synthetic construct
  REGION 1..7: note = Synthetic Construct
RSKLATK

SEQ ID NO: 16580 - protein, 7 aa, synthetic construct
  REGION 1..7: note = Synthetic Construct
RSKLAYK

SEQ ID NO: 16581 - protein, 7 aa, synthetic construct
  REGION 1..7: note = Synthetic Construct
RSKLDAK

SEQ ID NO: 16582 - protein, 7 aa, synthetic construct
  REGION 1..7: note = Synthetic Construct
RSKLDDK

SEQ ID NO: 16583 - protein, 7 aa, synthetic construct
  REGION 1..7: note = Synthetic Construct
RSKLDEK

SEQ ID NO: 16584 - protein, 7 aa, synthetic construct
  REGION 1..7: note = Synthetic Construct
RSKLDFK

SEQ ID NO: 16585 - protein, 7 aa, synthetic construct
  REGION 1..7: note = Synthetic Construct
RSKLDGK

SEQ ID NO: 16586 - protein, 7 aa, synthetic construct
  REGION 1..7: note = Synthetic Construct
RSKLDHK

SEQ ID NO: 16587 - protein, 7 aa, synthetic construct
  REGION 1..7: note = Synthetic Construct
RSKLDIK

SEQ ID NO: 16588 - protein, 7 aa, synthetic construct
  REGION 1..7: note = Synthetic Construct
RSKLDLK

SEQ ID NO: 16589 - protein, 7 aa, synthetic construct
  REGION 1..7: note = Synthetic Construct
RSKLDNK

SEQ ID NO: 16590 - protein, 7 aa, synthetic construct
  REGION 1..7: note = Synthetic Construct
RSKLDQK

SEQ ID NO: 16591 - protein, 7 aa, synthetic construct
  REGION 1..7: note = Synthetic Construct
RSKLDRK

SEQ ID NO: 16592 - protein, 7 aa, synthetic construct
  REGION 1..7: note = Synthetic Construct
RSKLDSK

SEQ ID NO: 16593 - protein, 7 aa, synthetic construct
  REGION 1..7: note = Synthetic Construct
RSKLDTK

SEQ ID NO: 16594 - protein, 7 aa, synthetic construct
  REGION 1..7: note = Synthetic Construct
RSKLDYK

SEQ ID NO: 16595 - protein, 7 aa, synthetic construct
  REGION 1..7: note = Synthetic Construct
RSKLEAK

SEQ ID NO: 16596 - protein, 7 aa, synthetic construct
  REGION 1..7: note = Synthetic Construct
RSKLEDK

SEQ ID NO: 16597 - protein, 7 aa, synthetic construct
  REGION 1..7: note = Synthetic Construct
RSKLEEK

SEQ ID NO: 16598 - protein, 7 aa, synthetic construct
  REGION 1..7: note = Synthetic Construct
RSKLEFK

SEQ ID NO: 16599 - protein, 7 aa, synthetic construct
  REGION 1..7: note = Synthetic Construct
RSKLEGK

SEQ ID NO: 16600 - protein, 7 aa, synthetic construct
  REGION 1..7: note = Synthetic Construct
RSKLEHK

SEQ ID NO: 16601 - protein, 7 aa, synthetic construct
  REGION 1..7: note = Synthetic Construct
RSKLEIK

SEQ ID NO: 16602 - protein, 7 aa, synthetic construct
  REGION 1..7: note = Synthetic Construct
RSKLELK

SEQ ID NO: 16603 - protein, 7 aa, synthetic construct
  REGION 1..7: note = Synthetic Construct
RSKLENK

SEQ ID NO: 16604 - protein, 7 aa, synthetic construct
  REGION 1..7: note = Synthetic Construct
RSKLEQK

SEQ ID NO: 16605 - protein, 7 aa, synthetic construct
  REGION 1..7: note = Synthetic Construct
RSKLERK

SEQ ID NO: 16606 - protein, 7 aa, synthetic construct
  REGION 1..7: note = Synthetic Construct
RSKLESK

SEQ ID NO: 16607 - protein, 7 aa, synthetic construct
  REGION 1..7: note = Synthetic Construct
RSKLETK

SEQ ID NO: 16608 - protein, 7 aa, synthetic construct
  REGION 1..7: note = Synthetic Construct
RSKLEYK

SEQ ID NO: 16609 - protein, 7 aa, synthetic construct
  REGION 1..7: note = Synthetic Construct
RSKLFAK

SEQ ID NO: 16610 - protein, 7 aa, synthetic construct
  REGION 1..7: note = Synthetic Construct
RSKLFDK

SEQ ID NO: 16611 - protein, 7 aa, synthetic construct
  REGION 1..7: note = Synthetic Construct
RSKLFEK

SEQ ID NO: 16612 - protein, 7 aa, synthetic construct
  REGION 1..7: note = Synthetic Construct
RSKLFFK

SEQ ID NO: 16613 - protein, 7 aa, synthetic construct
  REGION 1..7: note = Synthetic Construct
RSKLFGK

SEQ ID NO: 16614 - protein, 7 aa, synthetic construct
  REGION 1..7: note = Synthetic Construct
RSKLFHK

SEQ ID NO: 16615 - protein, 7 aa, synthetic construct
  REGION 1..7: note = Synthetic Construct
RSKLFIK

SEQ ID NO: 16616 - protein, 7 aa, synthetic construct
  REGION 1..7: note = Synthetic Construct
RSKLFLK

SEQ ID NO: 16617 - protein, 7 aa, synthetic construct
  REGION 1..7: note = Synthetic Construct
RSKLFNK

SEQ ID NO: 16618 - protein, 7 aa, synthetic construct
  REGION 1..7: note = Synthetic Construct
RSKLFQK

SEQ ID NO: 16619 - protein, 7 aa, synthetic construct
  REGION 1..7: note = Synthetic Construct
RSKLFRK

SEQ ID NO: 16620 - protein, 7 aa, synthetic construct
  REGION 1..7: note = Synthetic Construct
RSKLFSK

SEQ ID NO: 16621 - protein, 7 aa, synthetic construct
  REGION 1..7: note = Synthetic Construct
RSKLFTK

SEQ ID NO: 16622 - protein, 7 aa, synthetic construct
  REGION 1..7: note = Synthetic Construct
RSKLFYK

SEQ ID NO: 16623 - protein, 7 aa, synthetic construct
  REGION 1..7: note = Synthetic Construct
RSKLGAK

SEQ ID NO: 16624 - protein, 7 aa, synthetic construct
  REGION 1..7: note = Synthetic Construct
RSKLGDK

SEQ ID NO: 16625 - protein, 7 aa, synthetic construct
  REGION 1..7: note = Synthetic Construct
RSKLGEK

SEQ ID NO: 16626 - protein, 7 aa, synthetic construct
  REGION 1..7: note = Synthetic Construct
RSKLGFK

SEQ ID NO: 16627 - protein, 7 aa, synthetic construct
  REGION 1..7: note = Synthetic Construct
RSKLGGK

SEQ ID NO: 16628 - protein, 7 aa, synthetic construct
  REGION 1..7: note = Synthetic Construct
RSKLGHK

SEQ ID NO: 16629 - protein, 7 aa, synthetic construct
  REGION 1..7: note = Synthetic Construct
RSKLGIK

SEQ ID NO: 16630 - protein, 7 aa, synthetic construct
  REGION 1..7: note = Synthetic Construct
RSKLGLK

SEQ ID NO: 16631 - protein, 7 aa, synthetic construct
  REGION 1..7: note = Synthetic Construct
RSKLGNK

SEQ ID NO: 16632 - protein, 7 aa, synthetic construct
  REGION 1..7: note = Synthetic Construct
RSKLGQK

SEQ ID NO: 16633 - protein, 7 aa, synthetic construct
  REGION 1..7: note = Synthetic Construct
RSKLGRK

SEQ ID NO: 16634 - protein, 7 aa, synthetic construct
  REGION 1..7: note = Synthetic Construct
RSKLGSK

SEQ ID NO: 16635 - protein, 7 aa, synthetic construct
  REGION 1..7: note = Synthetic Construct
RSKLGTK

SEQ ID NO: 16636 - protein, 7 aa, synthetic construct
  REGION 1..7: note = Synthetic Construct
RSKLGYK

SEQ ID NO: 16637 - protein, 7 aa, synthetic construct
  REGION 1..7: note = Synthetic Construct
RSKLHAK

SEQ ID NO: 16638 - protein, 7 aa, synthetic construct
  REGION 1..7: note = Synthetic Construct
RSKLHDK

SEQ ID NO: 16639 - protein, 7 aa, synthetic construct
  REGION 1..7: note = Synthetic Construct
RSKLHEK

SEQ ID NO: 16640 - protein, 7 aa, synthetic construct
  REGION 1..7: note = Synthetic Construct
RSKLHFK

SEQ ID NO: 16641 - protein, 7 aa, synthetic construct
  REGION 1..7: note = Synthetic Construct
RSKLHGK

SEQ ID NO: 16642 - protein, 7 aa, synthetic construct
  REGION 1..7: note = Synthetic Construct
RSKLHHK

SEQ ID NO: 16643 - protein, 7 aa, synthetic construct
  REGION 1..7: note = Synthetic Construct
RSKLHIK

SEQ ID NO: 16644 - protein, 7 aa, synthetic construct
  REGION 1..7: note = Synthetic Construct
RSKLHLK

SEQ ID NO: 16645 - protein, 7 aa, synthetic construct
  REGION 1..7: note = Synthetic Construct
RSKLHNK

SEQ ID NO: 16646 - protein, 7 aa, synthetic construct
  REGION 1..7: note = Synthetic Construct
RSKLHQK

SEQ ID NO: 16647 - protein, 7 aa, synthetic construct
  REGION 1..7: note = Synthetic Construct
RSKLHRK

SEQ ID NO: 16648 - protein, 7 aa, synthetic construct
  REGION 1..7: note = Synthetic Construct
RSKLHSK

SEQ ID NO: 16649 - protein, 7 aa, synthetic construct
  REGION 1..7: note = Synthetic Construct
RSKLHTK

SEQ ID NO: 16650 - protein, 7 aa, synthetic construct
  REGION 1..7: note = Synthetic Construct
RSKLHYK

SEQ ID NO: 16651 - protein, 7 aa, synthetic construct
  REGION 1..7: note = Synthetic Construct
RSKLIAK

SEQ ID NO: 16652 - protein, 7 aa, synthetic construct
  REGION 1..7: note = Synthetic Construct
RSKLIDK

SEQ ID NO: 16653 - protein, 7 aa, synthetic construct
  REGION 1..7: note = Synthetic Construct
RSKLIEK

SEQ ID NO: 16654 - protein, 7 aa, synthetic construct
  REGION 1..7: note = Synthetic Construct
RSKLIFK

SEQ ID NO: 16655 - protein, 7 aa, synthetic construct
  REGION 1..7: note = Synthetic Construct
RSKLIGK

SEQ ID NO: 16656 - protein, 7 aa, synthetic construct
  REGION 1..7: note = Synthetic Construct
RSKLIHK

SEQ ID NO: 16657 - protein, 7 aa, synthetic construct
  REGION 1..7: note = Synthetic Construct
RSKLIIK

SEQ ID NO: 16658 - protein, 7 aa, synthetic construct
  REGION 1..7: note = Synthetic Construct
RSKLILK

SEQ ID NO: 16659 - protein, 7 aa, synthetic construct
  REGION 1..7: note = Synthetic Construct
RSKLINK

SEQ ID NO: 16660 - protein, 7 aa, synthetic construct
  REGION 1..7: note = Synthetic Construct
RSKLIQK

SEQ ID NO: 16661 - protein, 7 aa, synthetic construct
  REGION 1..7: note = Synthetic Construct
RSKLIRK

SEQ ID NO: 16662 - protein, 7 aa, synthetic construct
  REGION 1..7: note = Synthetic Construct
RSKLISK

SEQ ID NO: 16663 - protein, 7 aa, synthetic construct
  REGION 1..7: note = Synthetic Construct
RSKLITK

SEQ ID NO: 16664 - protein, 7 aa, synthetic construct
  REGION 1..7: note = Synthetic Construct
RSKLIYK

SEQ ID NO: 16665 - protein, 7 aa, synthetic construct
  REGION 1..7: note = Synthetic Construct
RSKLLAK

SEQ ID NO: 16666 - protein, 7 aa, synthetic construct
  REGION 1..7: note = Synthetic Construct
RSKLLDK

SEQ ID NO: 16667 - protein, 7 aa, synthetic construct
  REGION 1..7: note = Synthetic Construct
RSKLLEK

SEQ ID NO: 16668 - protein, 7 aa, synthetic construct
  REGION 1..7: note = Synthetic Construct
RSKLLFK

SEQ ID NO: 16669 - protein, 7 aa, synthetic construct
  REGION 1..7: note = Synthetic Construct
RSKLLGK

SEQ ID NO: 16670 - protein, 7 aa, synthetic construct
  REGION 1..7: note = Synthetic Construct
RSKLLHK

SEQ ID NO: 16671 - protein, 7 aa, synthetic construct
  REGION 1..7: note = Synthetic Construct
RSKLLIK

SEQ ID NO: 16672 - protein, 7 aa, synthetic construct
  REGION 1..7: note = Synthetic Construct
RSKLLLK

SEQ ID NO: 16673 - protein, 7 aa, synthetic construct
  REGION 1..7: note = Synthetic Construct
RSKLLNK

SEQ ID NO: 16674 - protein, 7 aa, synthetic construct
  REGION 1..7: note = Synthetic Construct
RSKLLQK

SEQ ID NO: 16675 - protein, 7 aa, synthetic construct
  REGION 1..7: note = Synthetic Construct
RSKLLRK

SEQ ID NO: 16676 - protein, 7 aa, synthetic construct
  REGION 1..7: note = Synthetic Construct
RSKLLSK

SEQ ID NO: 16677 - protein, 7 aa, synthetic construct
  REGION 1..7: note = Synthetic Construct
RSKLLTK

SEQ ID NO: 16678 - protein, 7 aa, synthetic construct
  REGION 1..7: note = Synthetic Construct
RSKLLYK

SEQ ID NO: 16679 - protein, 7 aa, synthetic construct
  REGION 1..7: note = Synthetic Construct
RSKLNAK

SEQ ID NO: 16680 - protein, 7 aa, synthetic construct
  REGION 1..7: note = Synthetic Construct
RSKLNDK

SEQ ID NO: 16681 - protein, 7 aa, synthetic construct
  REGION 1..7: note = Synthetic Construct
RSKLNEK

SEQ ID NO: 16682 - protein, 7 aa, synthetic construct
  REGION 1..7: note = Synthetic Construct
RSKLNFK

SEQ ID NO: 16683 - protein, 7 aa, synthetic construct
  REGION 1..7: note = Synthetic Construct
RSKLNGK

SEQ ID NO: 16684 - protein, 7 aa, synthetic construct
  REGION 1..7: note = Synthetic Construct
RSKLNHK

SEQ ID NO: 16685 - protein, 7 aa, synthetic construct
  REGION 1..7: note = Synthetic Construct
RSKLNIK

SEQ ID NO: 16686 - protein, 7 aa, synthetic construct
  REGION 1..7: note = Synthetic Construct
RSKLNLK

SEQ ID NO: 16687 - protein, 7 aa, synthetic construct
  REGION 1..7: note = Synthetic Construct
RSKLNNK

SEQ ID NO: 16688 - protein, 7 aa, synthetic construct
  REGION 1..7: note = Synthetic Construct
RSKLNQK

SEQ ID NO: 16689 - protein, 7 aa, synthetic construct
  REGION 1..7: note = Synthetic Construct
RSKLNRK

SEQ ID NO: 16690 - protein, 7 aa, synthetic construct
  REGION 1..7: note = Synthetic Construct
RSKLNSK

SEQ ID NO: 16691 - protein, 7 aa, synthetic construct
  REGION 1..7: note = Synthetic Construct
RSKLNTK

SEQ ID NO: 16692 - protein, 7 aa, synthetic construct
  REGION 1..7: note = Synthetic Construct
RSKLNYK

SEQ ID NO: 16693 - protein, 7 aa, synthetic construct
  REGION 1..7: note = Synthetic Construct
RSKLQAK

SEQ ID NO: 16694 - protein, 7 aa, synthetic construct
  REGION 1..7: note = Synthetic Construct
RSKLQDK

SEQ ID NO: 16695 - protein, 7 aa, synthetic construct
  REGION 1..7: note = Synthetic Construct
RSKLQEK

SEQ ID NO: 16696 - protein, 7 aa, synthetic construct
  REGION 1..7: note = Synthetic Construct
RSKLQFK

SEQ ID NO: 16697 - protein, 7 aa, synthetic construct
  REGION 1..7: note = Synthetic Construct
RSKLQGK

SEQ ID NO: 16698 - protein, 7 aa, synthetic construct
  REGION 1..7: note = Synthetic Construct
RSKLQHK

SEQ ID NO: 16699 - protein, 7 aa, synthetic construct
  REGION 1..7: note = Synthetic Construct
RSKLQIK

SEQ ID NO: 16700 - protein, 7 aa, synthetic construct
  REGION 1..7: note = Synthetic Construct
RSKLQLK

SEQ ID NO: 16701 - protein, 7 aa, synthetic construct
  REGION 1..7: note = Synthetic Construct
RSKLQNK

SEQ ID NO: 16702 - protein, 7 aa, synthetic construct
  REGION 1..7: note = Synthetic Construct
RSKLQQK

SEQ ID NO: 16703 - protein, 7 aa, synthetic construct
  REGION 1..7: note = Synthetic Construct
RSKLQRK

SEQ ID NO: 16704 - protein, 7 aa, synthetic construct
  REGION 1..7: note = Synthetic Construct
RSKLQSK

SEQ ID NO: 16705 - protein, 7 aa, synthetic construct
  REGION 1..7: note = Synthetic Construct
RSKLQTK

SEQ ID NO: 16706 - protein, 7 aa, synthetic construct
  REGION 1..7: note = Synthetic Construct
RSKLQYK

SEQ ID NO: 16707 - protein, 7 aa, synthetic construct
  REGION 1..7: note = Synthetic Construct
RSKLRAK

SEQ ID NO: 16708 - protein, 7 aa, synthetic construct
  REGION 1..7: note = Synthetic Construct
RSKLRDK

SEQ ID NO: 16709 - protein, 7 aa, synthetic construct
  REGION 1..7: note = Synthetic Construct
RSKLREK

SEQ ID NO: 16710 - protein, 7 aa, synthetic construct
  REGION 1..7: note = Synthetic Construct
RSKLRFK

SEQ ID NO: 16711 - protein, 7 aa, synthetic construct
  REGION 1..7: note = Synthetic Construct
RSKLRGK

SEQ ID NO: 16712 - protein, 7 aa, synthetic construct
  REGION 1..7: note = Synthetic Construct
RSKLRHK

SEQ ID NO: 16713 - protein, 7 aa, synthetic construct
  REGION 1..7: note = Synthetic Construct
RSKLRIK

SEQ ID NO: 16714 - protein, 7 aa, synthetic construct
  REGION 1..7: note = Synthetic Construct
RSKLRLK

SEQ ID NO: 16715 - protein, 7 aa, synthetic construct
  REGION 1..7: note = Synthetic Construct
RSKLRNK

SEQ ID NO: 16716 - protein, 7 aa, synthetic construct
  REGION 1..7: note = Synthetic Construct
RSKLRQK

SEQ ID NO: 16717 - protein, 7 aa, synthetic construct
  REGION 1..7: note = Synthetic Construct
RSKLRRK

SEQ ID NO: 16718 - protein, 7 aa, synthetic construct
  REGION 1..7: note = Synthetic Construct
RSKLRSK

SEQ ID NO: 16719 - protein, 7 aa, synthetic construct
  REGION 1..7: note = Synthetic Construct
RSKLRTK

SEQ ID NO: 16720 - protein, 7 aa, synthetic construct
  REGION 1..7: note = Synthetic Construct
RSKLRYK

SEQ ID NO: 16721 - protein, 7 aa, synthetic construct
  REGION 1..7: note = Synthetic Construct
RSKLSAK

SEQ ID NO: 16722 - protein, 7 aa, synthetic construct
  REGION 1..7: note = Synthetic Construct
RSKLSDK

SEQ ID NO: 16723 - protein, 7 aa, synthetic construct
  REGION 1..7: note = Synthetic Construct
RSKLSEK

SEQ ID NO: 16724 - protein, 7 aa, synthetic construct
  REGION 1..7: note = Synthetic Construct
RSKLSFK

SEQ ID NO: 16725 - protein, 7 aa, synthetic construct
  REGION 1..7: note = Synthetic Construct
RSKLSGK

SEQ ID NO: 16726 - protein, 7 aa, synthetic construct
  REGION 1..7: note = Synthetic Construct
RSKLSHK

SEQ ID NO: 16727 - protein, 7 aa, synthetic construct
  REGION 1..7: note = Synthetic Construct
RSKLSIK

SEQ ID NO: 16728 - protein, 7 aa, synthetic construct
  REGION 1..7: note = Synthetic Construct
RSKLSLK

SEQ ID NO: 16729 - protein, 7 aa, synthetic construct
  REGION 1..7: note = Synthetic Construct
RSKLSNK

SEQ ID NO: 16730 - protein, 7 aa, synthetic construct
  REGION 1..7: note = Synthetic Construct
RSKLSQK

SEQ ID NO: 16731 - protein, 7 aa, synthetic construct
  REGION 1..7: note = Synthetic Construct
RSKLSRK

SEQ ID NO: 16732 - protein, 7 aa, synthetic construct
  REGION 1..7: note = Synthetic Construct
RSKLSSK

SEQ ID NO: 16733 - protein, 7 aa, synthetic construct
  REGION 1..7: note = Synthetic Construct
RSKLSTK

SEQ ID NO: 16734 - protein, 7 aa, synthetic construct
  REGION 1..7: note = Synthetic Construct
RSKLSYK

SEQ ID NO: 16735 - protein, 7 aa, synthetic construct
  REGION 1..7: note = Synthetic Construct
RSKLTAK

SEQ ID NO: 16736 - protein, 7 aa, synthetic construct
  REGION 1..7: note = Synthetic Construct
RSKLTDK

SEQ ID NO: 16737 - protein, 7 aa, synthetic construct
  REGION 1..7: note = Synthetic Construct
RSKLTEK

SEQ ID NO: 16738 - protein, 7 aa, synthetic construct
  REGION 1..7: note = Synthetic Construct
RSKLTFK

SEQ ID NO: 16739 - protein, 7 aa, synthetic construct
  REGION 1..7: note = Synthetic Construct
RSKLTGK

SEQ ID NO: 16740 - protein, 7 aa, synthetic construct
  REGION 1..7: note = Synthetic Construct
RSKLTHK

SEQ ID NO: 16741 - protein, 7 aa, synthetic construct
  REGION 1..7: note = Synthetic Construct
RSKLTIK

SEQ ID NO: 16742 - protein, 7 aa, synthetic construct
  REGION 1..7: note = Synthetic Construct
RSKLTLK

SEQ ID NO: 16743 - protein, 7 aa, synthetic construct
  REGION 1..7: note = Synthetic Construct
RSKLTNK

SEQ ID NO: 16744 - protein, 7 aa, synthetic construct
  REGION 1..7: note = Synthetic Construct
RSKLTQK

SEQ ID NO: 16745 - protein, 7 aa, synthetic construct
  REGION 1..7: note = Synthetic Construct
RSKLTRK

SEQ ID NO: 16746 - protein, 7 aa, synthetic construct
  REGION 1..7: note = Synthetic Construct
RSKLTSK

SEQ ID NO: 16747 - protein, 7 aa, synthetic construct
  REGION 1..7: note = Synthetic Construct
RSKLTTK

SEQ ID NO: 16748 - protein, 7 aa, synthetic construct
  REGION 1..7: note = Synthetic Construct
RSKLTYK

SEQ ID NO: 16749 - protein, 7 aa, synthetic construct
  REGION 1..7: note = Synthetic Construct
RSKLYAK

SEQ ID NO: 16750 - protein, 7 aa, synthetic construct
  REGION 1..7: note = Synthetic Construct
RSKLYDK

SEQ ID NO: 16751 - protein, 7 aa, synthetic construct
  REGION 1..7: note = Synthetic Construct
RSKLYEK

SEQ ID NO: 16752 - protein, 7 aa, synthetic construct
  REGION 1..7: note = Synthetic Construct
RSKLYFK

SEQ ID NO: 16753 - protein, 7 aa, synthetic construct
  REGION 1..7: note = Synthetic Construct
RSKLYGK

SEQ ID NO: 16754 - protein, 7 aa, synthetic construct
  REGION 1..7: note = Synthetic Construct
RSKLYHK

SEQ ID NO: 16755 - protein, 7 aa, synthetic construct
  REGION 1..7: note = Synthetic Construct
RSKLYIK

SEQ ID NO: 16756 - protein, 7 aa, synthetic construct
  REGION 1..7: note = Synthetic Construct
RSKLYLK

SEQ ID NO: 16757 - protein, 7 aa, synthetic construct
  REGION 1..7: note = Synthetic Construct
RSKLYNK

SEQ ID NO: 16758 - protein, 7 aa, synthetic construct
  REGION 1..7: note = Synthetic Construct
RSKLYQK

SEQ ID NO: 16759 - protein, 7 aa, synthetic construct
  REGION 1..7: note = Synthetic Construct
RSKLYRK

SEQ ID NO: 16760 - protein, 7 aa, synthetic construct
  REGION 1..7: note = Synthetic Construct
RSKLYSK

SEQ ID NO: 16761 - protein, 7 aa, synthetic construct
  REGION 1..7: note = Synthetic Construct
RSKLYTK

SEQ ID NO: 16762 - protein, 7 aa, synthetic construct
  REGION 1..7: note = Synthetic Construct
RSKLYYK

SEQ ID NO: 16763 - protein, 7 aa, synthetic construct
  REGION 1..7: note = Synthetic Construct
RSKNAAK

SEQ ID NO: 16764 - protein, 7 aa, synthetic construct
  REGION 1..7: note = Synthetic Construct
RSKNADK

SEQ ID NO: 16765 - protein, 7 aa, synthetic construct
  REGION 1..7: note = Synthetic Construct
RSKNAEK

SEQ ID NO: 16766 - protein, 7 aa, synthetic construct
  REGION 1..7: note = Synthetic Construct
RSKNAFK

SEQ ID NO: 16767 - protein, 7 aa, synthetic construct
  REGION 1..7: note = Synthetic Construct
RSKNAGK

SEQ ID NO: 16768 - protein, 7 aa, synthetic construct
  REGION 1..7: note = Synthetic Construct
RSKNAHK

SEQ ID NO: 16769 - protein, 7 aa, synthetic construct
  REGION 1..7: note = Synthetic Construct
RSKNAIK

SEQ ID NO: 16770 - protein, 7 aa, synthetic construct
  REGION 1..7: note = Synthetic Construct
RSKNALK

SEQ ID NO: 16771 - protein, 7 aa, synthetic construct
  REGION 1..7: note = Synthetic Construct
RSKNANK

SEQ ID NO: 16772 - protein, 7 aa, synthetic construct
  REGION 1..7: note = Synthetic Construct
RSKNAQK

SEQ ID NO: 16773 - protein, 7 aa, synthetic construct
  REGION 1..7: note = Synthetic Construct
RSKNARK

SEQ ID NO: 16774 - protein, 7 aa, synthetic construct
  REGION 1..7: note = Synthetic Construct
RSKNASK

SEQ ID NO: 16775 - protein, 7 aa, synthetic construct
  REGION 1..7: note = Synthetic Construct
RSKNATK

SEQ ID NO: 16776 - protein, 7 aa, synthetic construct
  REGION 1..7: note = Synthetic Construct
RSKNAYK

SEQ ID NO: 16777 - protein, 7 aa, synthetic construct
  REGION 1..7: note = Synthetic Construct
RSKNDAK

SEQ ID NO: 16778 - protein, 7 aa, synthetic construct
  REGION 1..7: note = Synthetic Construct
RSKNDDK

SEQ ID NO: 16779 - protein, 7 aa, synthetic construct
  REGION 1..7: note = Synthetic Construct
RSKNDEK

SEQ ID NO: 16780 - protein, 7 aa, synthetic construct
  REGION 1..7: note = Synthetic Construct
RSKNDFK

SEQ ID NO: 16781 - protein, 7 aa, synthetic construct
  REGION 1..7: note = Synthetic Construct
RSKNDGK

SEQ ID NO: 16782 - protein, 7 aa, synthetic construct
  REGION 1..7: note = Synthetic Construct
RSKNDHK

SEQ ID NO: 16783 - protein, 7 aa, synthetic construct
  REGION 1..7: note = Synthetic Construct
RSKNDIK

SEQ ID NO: 16784 - protein, 7 aa, synthetic construct
  REGION 1..7: note = Synthetic Construct
RSKNDLK

SEQ ID NO: 16785 - protein, 7 aa, synthetic construct
  REGION 1..7: note = Synthetic Construct
RSKNDNK

SEQ ID NO: 16786 - protein, 7 aa, synthetic construct
  REGION 1..7: note = Synthetic Construct
RSKNDQK

SEQ ID NO: 16787 - protein, 7 aa, synthetic construct
  REGION 1..7: note = Synthetic Construct
RSKNDRK

SEQ ID NO: 16788 - protein, 7 aa, synthetic construct
  REGION 1..7: note = Synthetic Construct
RSKNDSK

SEQ ID NO: 16789 - protein, 7 aa, synthetic construct
  REGION 1..7: note = Synthetic Construct
RSKNDTK

SEQ ID NO: 16790 - protein, 7 aa, synthetic construct
  REGION 1..7: note = Synthetic Construct
RSKNDYK

SEQ ID NO: 16791 - protein, 7 aa, synthetic construct
  REGION 1..7: note = Synthetic Construct
RSKNEAK

SEQ ID NO: 16792 - protein, 7 aa, synthetic construct
  REGION 1..7: note = Synthetic Construct
RSKNEDK

SEQ ID NO: 16793 - protein, 7 aa, synthetic construct
  REGION 1..7: note = Synthetic Construct
RSKNEEK

SEQ ID NO: 16794 - protein, 7 aa, synthetic construct
  REGION 1..7: note = Synthetic Construct
RSKNEFK

SEQ ID NO: 16795 - protein, 7 aa, synthetic construct
  REGION 1..7: note = Synthetic Construct
RSKNEGK

SEQ ID NO: 16796 - protein, 7 aa, synthetic construct
  REGION 1..7: note = Synthetic Construct
RSKNEHK

SEQ ID NO: 16797 - protein, 7 aa, synthetic construct
  REGION 1..7: note = Synthetic Construct
RSKNEIK

SEQ ID NO: 16798 - protein, 7 aa, synthetic construct
  REGION 1..7: note = Synthetic Construct
RSKNELK

SEQ ID NO: 16799 - protein, 7 aa, synthetic construct
  REGION 1..7: note = Synthetic Construct
RSKNENK

SEQ ID NO: 16800 - protein, 7 aa, synthetic construct
  REGION 1..7: note = Synthetic Construct
RSKNEQK

SEQ ID NO: 16801 - protein, 7 aa, synthetic construct
  REGION 1..7: note = Synthetic Construct
RSKNERK

SEQ ID NO: 16802 - protein, 7 aa, synthetic construct
  REGION 1..7: note = Synthetic Construct
RSKNESK

SEQ ID NO: 16803 - protein, 7 aa, synthetic construct
  REGION 1..7: note = Synthetic Construct
RSKNETK

SEQ ID NO: 16804 - protein, 7 aa, synthetic construct
  REGION 1..7: note = Synthetic Construct
RSKNEYK

SEQ ID NO: 16805 - protein, 7 aa, synthetic construct
  REGION 1..7: note = Synthetic Construct
RSKNFAK

SEQ ID NO: 16806 - protein, 7 aa, synthetic construct
  REGION 1..7: note = Synthetic Construct
RSKNFDK

SEQ ID NO: 16807 - protein, 7 aa, synthetic construct
  REGION 1..7: note = Synthetic Construct
RSKNFEK

SEQ ID NO: 16808 - protein, 7 aa, synthetic construct
  REGION 1..7: note = Synthetic Construct
RSKNFFK

SEQ ID NO: 16809 - protein, 7 aa, synthetic construct
  REGION 1..7: note = Synthetic Construct
RSKNFGK

SEQ ID NO: 16810 - protein, 7 aa, synthetic construct
  REGION 1..7: note = Synthetic Construct
RSKNFHK

SEQ ID NO: 16811 - protein, 7 aa, synthetic construct
  REGION 1..7: note = Synthetic Construct
RSKNFIK

SEQ ID NO: 16812 - protein, 7 aa, synthetic construct
  REGION 1..7: note = Synthetic Construct
RSKNFLK

SEQ ID NO: 16813 - protein, 7 aa, synthetic construct
  REGION 1..7: note = Synthetic Construct
RSKNFNK

SEQ ID NO: 16814 - protein, 7 aa, synthetic construct
  REGION 1..7: note = Synthetic Construct
RSKNFQK

SEQ ID NO: 16815 - protein, 7 aa, synthetic construct
  REGION 1..7: note = Synthetic Construct
RSKNFRK

SEQ ID NO: 16816 - protein, 7 aa, synthetic construct
  REGION 1..7: note = Synthetic Construct
RSKNFSK

SEQ ID NO: 16817 - protein, 7 aa, synthetic construct
  REGION 1..7: note = Synthetic Construct
RSKNFTK

SEQ ID NO: 16818 - protein, 7 aa, synthetic construct
  REGION 1..7: note = Synthetic Construct
RSKNFYK

SEQ ID NO: 16819 - protein, 7 aa, synthetic construct
  REGION 1..7: note = Synthetic Construct
RSKNGAK

SEQ ID NO: 16820 - protein, 7 aa, synthetic construct
  REGION 1..7: note = Synthetic Construct
RSKNGDK

SEQ ID NO: 16821 - protein, 7 aa, synthetic construct
  REGION 1..7: note = Synthetic Construct
RSKNGEK

SEQ ID NO: 16822 - protein, 7 aa, synthetic construct
  REGION 1..7: note = Synthetic Construct
RSKNGFK

SEQ ID NO: 16823 - protein, 7 aa, synthetic construct
  REGION 1..7: note = Synthetic Construct
RSKNGGK

SEQ ID NO: 16824 - protein, 7 aa, synthetic construct
  REGION 1..7: note = Synthetic Construct
RSKNGHK

SEQ ID NO: 16825 - protein, 7 aa, synthetic construct
  REGION 1..7: note = Synthetic Construct
RSKNGIK

SEQ ID NO: 16826 - protein, 7 aa, synthetic construct
  REGION 1..7: note = Synthetic Construct
RSKNGLK

SEQ ID NO: 16827 - protein, 7 aa, synthetic construct
  REGION 1..7: note = Synthetic Construct
RSKNGNK

SEQ ID NO: 16828 - protein, 7 aa, synthetic construct
  REGION 1..7: note = Synthetic Construct
RSKNGQK

SEQ ID NO: 16829 - protein, 7 aa, synthetic construct
  REGION 1..7: note = Synthetic Construct
RSKNGRK

SEQ ID NO: 16830 - protein, 7 aa, synthetic construct
  REGION 1..7: note = Synthetic Construct
RSKNGSK

SEQ ID NO: 16831 - protein, 7 aa, synthetic construct
  REGION 1..7: note = Synthetic Construct
RSKNGTK

SEQ ID NO: 16832 - protein, 7 aa, synthetic construct
  REGION 1..7: note = Synthetic Construct
RSKNGYK

SEQ ID NO: 16833 - protein, 7 aa, synthetic construct
  REGION 1..7: note = Synthetic Construct
RSKNHAK

SEQ ID NO: 16834 - protein, 7 aa, synthetic construct
  REGION 1..7: note = Synthetic Construct
RSKNHDK

SEQ ID NO: 16835 - protein, 7 aa, synthetic construct
  REGION 1..7: note = Synthetic Construct
RSKNHEK

SEQ ID NO: 16836 - protein, 7 aa, synthetic construct
  REGION 1..7: note = Synthetic Construct
RSKNHFK

SEQ ID NO: 16837 - protein, 7 aa, synthetic construct
  REGION 1..7: note = Synthetic Construct
RSKNHGK

SEQ ID NO: 16838 - protein, 7 aa, synthetic construct
  REGION 1..7: note = Synthetic Construct
RSKNHHK

SEQ ID NO: 16839 - protein, 7 aa, synthetic construct
  REGION 1..7: note = Synthetic Construct
RSKNHIK

SEQ ID NO: 16840 - protein, 7 aa, synthetic construct
  REGION 1..7: note = Synthetic Construct
RSKNHLK

SEQ ID NO: 16841 - protein, 7 aa, synthetic construct
  REGION 1..7: note = Synthetic Construct
RSKNHNK

SEQ ID NO: 16842 - protein, 7 aa, synthetic construct
  REGION 1..7: note = Synthetic Construct
RSKNHQK

SEQ ID NO: 16843 - protein, 7 aa, synthetic construct
  REGION 1..7: note = Synthetic Construct
RSKNHRK

SEQ ID NO: 16844 - protein, 7 aa, synthetic construct
  REGION 1..7: note = Synthetic Construct
RSKNHSK

SEQ ID NO: 16845 - protein, 7 aa, synthetic construct
  REGION 1..7: note = Synthetic Construct
RSKNHTK

SEQ ID NO: 16846 - protein, 7 aa, synthetic construct
  REGION 1..7: note = Synthetic Construct
RSKNHYK

SEQ ID NO: 16847 - protein, 7 aa, synthetic construct
  REGION 1..7: note = Synthetic Construct
RSKNIAK

SEQ ID NO: 16848 - protein, 7 aa, synthetic construct
  REGION 1..7: note = Synthetic Construct
RSKNIDK

SEQ ID NO: 16849 - protein, 7 aa, synthetic construct
  REGION 1..7: note = Synthetic Construct
RSKNIEK

SEQ ID NO: 16850 - protein, 7 aa, synthetic construct
  REGION 1..7: note = Synthetic Construct
RSKNIFK

SEQ ID NO: 16851 - protein, 7 aa, synthetic construct
  REGION 1..7: note = Synthetic Construct
RSKNIGK

SEQ ID NO: 16852 - protein, 7 aa, synthetic construct
  REGION 1..7: note = Synthetic Construct
RSKNIHK

SEQ ID NO: 16853 - protein, 7 aa, synthetic construct
  REGION 1..7: note = Synthetic Construct
RSKNIIK

SEQ ID NO: 16854 - protein, 7 aa, synthetic construct
  REGION 1..7: note = Synthetic Construct
RSKNILK

SEQ ID NO: 16855 - protein, 7 aa, synthetic construct
  REGION 1..7: note = Synthetic Construct
RSKNINK

SEQ ID NO: 16856 - protein, 7 aa, synthetic construct
  REGION 1..7: note = Synthetic Construct
RSKNIQK

SEQ ID NO: 16857 - protein, 7 aa, synthetic construct
  REGION 1..7: note = Synthetic Construct
RSKNIRK

SEQ ID NO: 16858 - protein, 7 aa, synthetic construct
  REGION 1..7: note = Synthetic Construct
RSKNISK

SEQ ID NO: 16859 - protein, 7 aa, synthetic construct
  REGION 1..7: note = Synthetic Construct
RSKNITK

SEQ ID NO: 16860 - protein, 7 aa, synthetic construct
  REGION 1..7: note = Synthetic Construct
RSKNIYK

SEQ ID NO: 16861 - protein, 7 aa, synthetic construct
  REGION 1..7: note = Synthetic Construct
RSKNLAK

SEQ ID NO: 16862 - protein, 7 aa, synthetic construct
  REGION 1..7: note = Synthetic Construct
RSKNLDK

SEQ ID NO: 16863 - protein, 7 aa, synthetic construct
  REGION 1..7: note = Synthetic Construct
RSKNLEK

SEQ ID NO: 16864 - protein, 7 aa, synthetic construct
  REGION 1..7: note = Synthetic Construct
RSKNLFK

SEQ ID NO: 16865 - protein, 7 aa, synthetic construct
  REGION 1..7: note = Synthetic Construct
RSKNLGK

SEQ ID NO: 16866 - protein, 7 aa, synthetic construct
  REGION 1..7: note = Synthetic Construct
RSKNLHK

SEQ ID NO: 16867 - protein, 7 aa, synthetic construct
  REGION 1..7: note = Synthetic Construct
RSKNLIK

SEQ ID NO: 16868 - protein, 7 aa, synthetic construct
  REGION 1..7: note = Synthetic Construct
RSKNLLK

SEQ ID NO: 16869 - protein, 7 aa, synthetic construct
  REGION 1..7: note = Synthetic Construct
RSKNLNK

SEQ ID NO: 16870 - protein, 7 aa, synthetic construct
  REGION 1..7: note = Synthetic Construct
RSKNLQK

SEQ ID NO: 16871 - protein, 7 aa, synthetic construct
  REGION 1..7: note = Synthetic Construct
RSKNLRK

SEQ ID NO: 16872 - protein, 7 aa, synthetic construct
  REGION 1..7: note = Synthetic Construct
RSKNLSK

SEQ ID NO: 16873 - protein, 7 aa, synthetic construct
  REGION 1..7: note = Synthetic Construct
RSKNLTK

SEQ ID NO: 16874 - protein, 7 aa, synthetic construct
  REGION 1..7: note = Synthetic Construct
RSKNLYK

SEQ ID NO: 16875 - protein, 7 aa, synthetic construct
  REGION 1..7: note = Synthetic Construct
RSKNNAK

SEQ ID NO: 16876 - protein, 7 aa, synthetic construct
  REGION 1..7: note = Synthetic Construct
RSKNNDK

SEQ ID NO: 16877 - protein, 7 aa, synthetic construct
  REGION 1..7: note = Synthetic Construct
RSKNNEK

SEQ ID NO: 16878 - protein, 7 aa, synthetic construct
  REGION 1..7: note = Synthetic Construct
RSKNNFK

SEQ ID NO: 16879 - protein, 7 aa, synthetic construct
  REGION 1..7: note = Synthetic Construct
RSKNNGK

SEQ ID NO: 16880 - protein, 7 aa, synthetic construct
  REGION 1..7: note = Synthetic Construct
RSKNNHK

SEQ ID NO: 16881 - protein, 7 aa, synthetic construct
  REGION 1..7: note = Synthetic Construct
RSKNNIK

SEQ ID NO: 16882 - protein, 7 aa, synthetic construct
  REGION 1..7: note = Synthetic Construct
RSKNNLK

SEQ ID NO: 16883 - protein, 7 aa, synthetic construct
  REGION 1..7: note = Synthetic Construct
RSKNNNK

SEQ ID NO: 16884 - protein, 7 aa, synthetic construct
  REGION 1..7: note = Synthetic Construct
RSKNNQK

SEQ ID NO: 16885 - protein, 7 aa, synthetic construct
  REGION 1..7: note = Synthetic Construct
RSKNNRK

SEQ ID NO: 16886 - protein, 7 aa, synthetic construct
  REGION 1..7: note = Synthetic Construct
RSKNNSK

SEQ ID NO: 16887 - protein, 7 aa, synthetic construct
  REGION 1..7: note = Synthetic Construct
RSKNNTK

SEQ ID NO: 16888 - protein, 7 aa, synthetic construct
  REGION 1..7: note = Synthetic Construct
RSKNNYK

SEQ ID NO: 16889 - protein, 7 aa, synthetic construct
  REGION 1..7: note = Synthetic Construct
RSKNQAK

SEQ ID NO: 16890 - protein, 7 aa, synthetic construct
  REGION 1..7: note = Synthetic Construct
RSKNQDK

SEQ ID NO: 16891 - protein, 7 aa, synthetic construct
  REGION 1..7: note = Synthetic Construct
RSKNQEK

SEQ ID NO: 16892 - protein, 7 aa, synthetic construct
  REGION 1..7: note = Synthetic Construct
RSKNQFK

SEQ ID NO: 16893 - protein, 7 aa, synthetic construct
  REGION 1..7: note = Synthetic Construct
RSKNQGK

SEQ ID NO: 16894 - protein, 7 aa, synthetic construct
  REGION 1..7: note = Synthetic Construct
RSKNQHK

SEQ ID NO: 16895 - protein, 7 aa, synthetic construct
  REGION 1..7: note = Synthetic Construct
RSKNQIK

SEQ ID NO: 16896 - protein, 7 aa, synthetic construct
  REGION 1..7: note = Synthetic Construct
RSKNQLK

SEQ ID NO: 16897 - protein, 7 aa, synthetic construct
  REGION 1..7: note = Synthetic Construct
RSKNQNK

SEQ ID NO: 16898 - protein, 7 aa, synthetic construct
  REGION 1..7: note = Synthetic Construct
RSKNQQK

SEQ ID NO: 16899 - protein, 7 aa, synthetic construct
  REGION 1..7: note = Synthetic Construct
RSKNQRK

SEQ ID NO: 16900 - protein, 7 aa, synthetic construct
  REGION 1..7: note = Synthetic Construct
RSKNQSK

SEQ ID NO: 16901 - protein, 7 aa, synthetic construct
  REGION 1..7: note = Synthetic Construct
RSKNQTK

SEQ ID NO: 16902 - protein, 7 aa, synthetic construct
  REGION 1..7: note = Synthetic Construct
RSKNQYK

SEQ ID NO: 16903 - protein, 7 aa, synthetic construct
  REGION 1..7: note = Synthetic Construct
RSKNRAK

SEQ ID NO: 16904 - protein, 7 aa, synthetic construct
  REGION 1..7: note = Synthetic Construct
RSKNRDK

SEQ ID NO: 16905 - protein, 7 aa, synthetic construct
  REGION 1..7: note = Synthetic Construct
RSKNREK

SEQ ID NO: 16906 - protein, 7 aa, synthetic construct
  REGION 1..7: note = Synthetic Construct
RSKNRFK

SEQ ID NO: 16907 - protein, 7 aa, synthetic construct
  REGION 1..7: note = Synthetic Construct
RSKNRGK

SEQ ID NO: 16908 - protein, 7 aa, synthetic construct
  REGION 1..7: note = Synthetic Construct
RSKNRHK

SEQ ID NO: 16909 - protein, 7 aa, synthetic construct
  REGION 1..7: note = Synthetic Construct
RSKNRIK

SEQ ID NO: 16910 - protein, 7 aa, synthetic construct
  REGION 1..7: note = Synthetic Construct
RSKNRLK

SEQ ID NO: 16911 - protein, 7 aa, synthetic construct
  REGION 1..7: note = Synthetic Construct
RSKNRNK

SEQ ID NO: 16912 - protein, 7 aa, synthetic construct
  REGION 1..7: note = Synthetic Construct
RSKNRQK

SEQ ID NO: 16913 - protein, 7 aa, synthetic construct
  REGION 1..7: note = Synthetic Construct
RSKNRRK

SEQ ID NO: 16914 - protein, 7 aa, synthetic construct
  REGION 1..7: note = Synthetic Construct
RSKNRSK

SEQ ID NO: 16915 - protein, 7 aa, synthetic construct
  REGION 1..7: note = Synthetic Construct
RSKNRTK

SEQ ID NO: 16916 - protein, 7 aa, synthetic construct
  REGION 1..7: note = Synthetic Construct
RSKNRYK

SEQ ID NO: 16917 - protein, 7 aa, synthetic construct
  REGION 1..7: note = Synthetic Construct
RSKNSAK

SEQ ID NO: 16918 - protein, 7 aa, synthetic construct
  REGION 1..7: note = Synthetic Construct
RSKNSDK

SEQ ID NO: 16919 - protein, 7 aa, synthetic construct
  REGION 1..7: note = Synthetic Construct
RSKNSEK

SEQ ID NO: 16920 - protein, 7 aa, synthetic construct
  REGION 1..7: note = Synthetic Construct
RSKNSFK

SEQ ID NO: 16921 - protein, 7 aa, synthetic construct
  REGION 1..7: note = Synthetic Construct
RSKNSGK

SEQ ID NO: 16922 - protein, 7 aa, synthetic construct
  REGION 1..7: note = Synthetic Construct
RSKNSHK

SEQ ID NO: 16923 - protein, 7 aa, synthetic construct
  REGION 1..7: note = Synthetic Construct
RSKNSIK

SEQ ID NO: 16924 - protein, 7 aa, synthetic construct
  REGION 1..7: note = Synthetic Construct
RSKNSLK

SEQ ID NO: 16925 - protein, 7 aa, synthetic construct
  REGION 1..7: note = Synthetic Construct
RSKNSNK

SEQ ID NO: 16926 - protein, 7 aa, synthetic construct
  REGION 1..7: note = Synthetic Construct
RSKNSQK

SEQ ID NO: 16927 - protein, 7 aa, synthetic construct
  REGION 1..7: note = Synthetic Construct
RSKNSRK

SEQ ID NO: 16928 - protein, 7 aa, synthetic construct
  REGION 1..7: note = Synthetic Construct
RSKNSSK

SEQ ID NO: 16929 - protein, 7 aa, synthetic construct
  REGION 1..7: note = Synthetic Construct
RSKNSTK

SEQ ID NO: 16930 - protein, 7 aa, synthetic construct
  REGION 1..7: note = Synthetic Construct
RSKNSYK

SEQ ID NO: 16931 - protein, 7 aa, synthetic construct
  REGION 1..7: note = Synthetic Construct
RSKNTAK

SEQ ID NO: 16932 - protein, 7 aa, synthetic construct
  REGION 1..7: note = Synthetic Construct
RSKNTDK

SEQ ID NO: 16933 - protein, 7 aa, synthetic construct
  REGION 1..7: note = Synthetic Construct
RSKNTEK

SEQ ID NO: 16934 - protein, 7 aa, synthetic construct
  REGION 1..7: note = Synthetic Construct
RSKNTFK

SEQ ID NO: 16935 - protein, 7 aa, synthetic construct
  REGION 1..7: note = Synthetic Construct
RSKNTGK

SEQ ID NO: 16936 - protein, 7 aa, synthetic construct
  REGION 1..7: note = Synthetic Construct
RSKNTHK

SEQ ID NO: 16937 - protein, 7 aa, synthetic construct
  REGION 1..7: note = Synthetic Construct
RSKNTIK

SEQ ID NO: 16938 - protein, 7 aa, synthetic construct
  REGION 1..7: note = Synthetic Construct
RSKNTLK

SEQ ID NO: 16939 - protein, 7 aa, synthetic construct
  REGION 1..7: note = Synthetic Construct
RSKNTNK

SEQ ID NO: 16940 - protein, 7 aa, synthetic construct
  REGION 1..7: note = Synthetic Construct
RSKNTQK

SEQ ID NO: 16941 - protein, 7 aa, synthetic construct
  REGION 1..7: note = Synthetic Construct
RSKNTRK

SEQ ID NO: 16942 - protein, 7 aa, synthetic construct
  REGION 1..7: note = Synthetic Construct
RSKNTSK

SEQ ID NO: 16943 - protein, 7 aa, synthetic construct
  REGION 1..7: note = Synthetic Construct
RSKNTTK

SEQ ID NO: 16944 - protein, 7 aa, synthetic construct
  REGION 1..7: note = Synthetic Construct
RSKNTYK

SEQ ID NO: 16945 - protein, 7 aa, synthetic construct
  REGION 1..7: note = Synthetic Construct
RSKNYAK

SEQ ID NO: 16946 - protein, 7 aa, synthetic construct
  REGION 1..7: note = Synthetic Construct
RSKNYDK

SEQ ID NO: 16947 - protein, 7 aa, synthetic construct
  REGION 1..7: note = Synthetic Construct
RSKNYEK

SEQ ID NO: 16948 - protein, 7 aa, synthetic construct
  REGION 1..7: note = Synthetic Construct
RSKNYFK

SEQ ID NO: 16949 - protein, 7 aa, synthetic construct
  REGION 1..7: note = Synthetic Construct
RSKNYGK

SEQ ID NO: 16950 - protein, 7 aa, synthetic construct
  REGION 1..7: note = Synthetic Construct
RSKNYHK

SEQ ID NO: 16951 - protein, 7 aa, synthetic construct
  REGION 1..7: note = Synthetic Construct
RSKNYIK

SEQ ID NO: 16952 - protein, 7 aa, synthetic construct
  REGION 1..7: note = Synthetic Construct
RSKNYLK

SEQ ID NO: 16953 - protein, 7 aa, synthetic construct
  REGION 1..7: note = Synthetic Construct
RSKNYNK

SEQ ID NO: 16954 - protein, 7 aa, synthetic construct
  REGION 1..7: note = Synthetic Construct
RSKNYQK

SEQ ID NO: 16955 - protein, 7 aa, synthetic construct
  REGION 1..7: note = Synthetic Construct
RSKNYRK

SEQ ID NO: 16956 - protein, 7 aa, synthetic construct
  REGION 1..7: note = Synthetic Construct
RSKNYSK

SEQ ID NO: 16957 - protein, 7 aa, synthetic construct
  REGION 1..7: note = Synthetic Construct
RSKNYTK

SEQ ID NO: 16958 - protein, 7 aa, synthetic construct
  REGION 1..7: note = Synthetic Construct
RSKNYYK

SEQ ID NO: 16959 - protein, 7 aa, synthetic construct
  REGION 1..7: note = Synthetic Construct
RSKPAAK

SEQ ID NO: 16960 - protein, 7 aa, synthetic construct
  REGION 1..7: note = Synthetic Construct
RSKPADK

SEQ ID NO: 16961 - protein, 7 aa, synthetic construct
  REGION 1..7: note = Synthetic Construct
RSKPAEK

SEQ ID NO: 16962 - protein, 7 aa, synthetic construct
  REGION 1..7: note = Synthetic Construct
RSKPAFK

SEQ ID NO: 16963 - protein, 7 aa, synthetic construct
  REGION 1..7: note = Synthetic Construct
RSKPAGK

SEQ ID NO: 16964 - protein, 7 aa, synthetic construct
  REGION 1..7: note = Synthetic Construct
RSKPAHK

SEQ ID NO: 16965 - protein, 7 aa, synthetic construct
  REGION 1..7: note = Synthetic Construct
RSKPAIK

SEQ ID NO: 16966 - protein, 7 aa, synthetic construct
  REGION 1..7: note = Synthetic Construct
RSKPALK

SEQ ID NO: 16967 - protein, 7 aa, synthetic construct
  REGION 1..7: note = Synthetic Construct
RSKPANK

SEQ ID NO: 16968 - protein, 7 aa, synthetic construct
  REGION 1..7: note = Synthetic Construct
RSKPAQK

SEQ ID NO: 16969 - protein, 7 aa, synthetic construct
  REGION 1..7: note = Synthetic Construct
RSKPARK

SEQ ID NO: 16970 - protein, 7 aa, synthetic construct
  REGION 1..7: note = Synthetic Construct
RSKPASK

SEQ ID NO: 16971 - protein, 7 aa, synthetic construct
  REGION 1..7: note = Synthetic Construct
RSKPATK

SEQ ID NO: 16972 - protein, 7 aa, synthetic construct
  REGION 1..7: note = Synthetic Construct
RSKPAYK

SEQ ID NO: 16973 - protein, 7 aa, synthetic construct
  REGION 1..7: note = Synthetic Construct
RSKPDAK

SEQ ID NO: 16974 - protein, 7 aa, synthetic construct
  REGION 1..7: note = Synthetic Construct
RSKPDDK

SEQ ID NO: 16975 - protein, 7 aa, synthetic construct
  REGION 1..7: note = Synthetic Construct
RSKPDEK

SEQ ID NO: 16976 - protein, 7 aa, synthetic construct
  REGION 1..7: note = Synthetic Construct
RSKPDFK

SEQ ID NO: 16977 - protein, 7 aa, synthetic construct
  REGION 1..7: note = Synthetic Construct
RSKPDGK

SEQ ID NO: 16978 - protein, 7 aa, synthetic construct
  REGION 1..7: note = Synthetic Construct
RSKPDHK

SEQ ID NO: 16979 - protein, 7 aa, synthetic construct
  REGION 1..7: note = Synthetic Construct
RSKPDIK

SEQ ID NO: 16980 - protein, 7 aa, synthetic construct
  REGION 1..7: note = Synthetic Construct
RSKPDLK

SEQ ID NO: 16981 - protein, 7 aa, synthetic construct
  REGION 1..7: note = Synthetic Construct
RSKPDNK

SEQ ID NO: 16982 - protein, 7 aa, synthetic construct
  REGION 1..7: note = Synthetic Construct
RSKPDQK

SEQ ID NO: 16983 - protein, 7 aa, synthetic construct
  REGION 1..7: note = Synthetic Construct
RSKPDRK

SEQ ID NO: 16984 - protein, 7 aa, synthetic construct
  REGION 1..7: note = Synthetic Construct
RSKPDSK

SEQ ID NO: 16985 - protein, 7 aa, synthetic construct
  REGION 1..7: note = Synthetic Construct
RSKPDTK

SEQ ID NO: 16986 - protein, 7 aa, synthetic construct
  REGION 1..7: note = Synthetic Construct
RSKPDYK

SEQ ID NO: 16987 - protein, 7 aa, synthetic construct
  REGION 1..7: note = Synthetic Construct
RSKPEAK

SEQ ID NO: 16988 - protein, 7 aa, synthetic construct
  REGION 1..7: note = Synthetic Construct
RSKPEDK

SEQ ID NO: 16989 - protein, 7 aa, synthetic construct
  REGION 1..7: note = Synthetic Construct
RSKPEEK

SEQ ID NO: 16990 - protein, 7 aa, synthetic construct
  REGION 1..7: note = Synthetic Construct
RSKPEFK

SEQ ID NO: 16991 - protein, 7 aa, synthetic construct
  REGION 1..7: note = Synthetic Construct
RSKPEGK

SEQ ID NO: 16992 - protein, 7 aa, synthetic construct
  REGION 1..7: note = Synthetic Construct
RSKPEHK

SEQ ID NO: 16993 - protein, 7 aa, synthetic construct
  REGION 1..7: note = Synthetic Construct
RSKPEIK

SEQ ID NO: 16994 - protein, 7 aa, synthetic construct
  REGION 1..7: note = Synthetic Construct
RSKPELK

SEQ ID NO: 16995 - protein, 7 aa, synthetic construct
  REGION 1..7: note = Synthetic Construct
RSKPENK

SEQ ID NO: 16996 - protein, 7 aa, synthetic construct
  REGION 1..7: note = Synthetic Construct
RSKPEQK

SEQ ID NO: 16997 - protein, 7 aa, synthetic construct
  REGION 1..7: note = Synthetic Construct
RSKPERK

SEQ ID NO: 16998 - protein, 7 aa, synthetic construct
  REGION 1..7: note = Synthetic Construct
RSKPESK

SEQ ID NO: 16999 - protein, 7 aa, synthetic construct
  REGION 1..7: note = Synthetic Construct
RSKPETK

SEQ ID NO: 17000 - protein, 7 aa, synthetic construct
  REGION 1..7: note = Synthetic Construct
RSKPEYK

SEQ ID NO: 17001 - protein, 7 aa, synthetic construct
  REGION 1..7: note = Synthetic Construct
RSKPFAK

SEQ ID NO: 17002 - protein, 7 aa, synthetic construct
  REGION 1..7: note = Synthetic Construct
RSKPFDK

SEQ ID NO: 17003 - protein, 7 aa, synthetic construct
  REGION 1..7: note = Synthetic Construct
RSKPFEK

SEQ ID NO: 17004 - protein, 7 aa, synthetic construct
  REGION 1..7: note = Synthetic Construct
RSKPFFK

SEQ ID NO: 17005 - protein, 7 aa, synthetic construct
  REGION 1..7: note = Synthetic Construct
RSKPFGK

SEQ ID NO: 17006 - protein, 7 aa, synthetic construct
  REGION 1..7: note = Synthetic Construct
RSKPFHK

SEQ ID NO: 17007 - protein, 7 aa, synthetic construct
  REGION 1..7: note = Synthetic Construct
RSKPFIK

SEQ ID NO: 17008 - protein, 7 aa, synthetic construct
  REGION 1..7: note = Synthetic Construct
RSKPFLK

SEQ ID NO: 17009 - protein, 7 aa, synthetic construct
  REGION 1..7: note = Synthetic Construct
RSKPFNK

SEQ ID NO: 17010 - protein, 7 aa, synthetic construct
  REGION 1..7: note = Synthetic Construct
RSKPFQK

SEQ ID NO: 17011 - protein, 7 aa, synthetic construct
  REGION 1..7: note = Synthetic Construct
RSKPFRK

SEQ ID NO: 17012 - protein, 7 aa, synthetic construct
  REGION 1..7: note = Synthetic Construct
RSKPFSK

SEQ ID NO: 17013 - protein, 7 aa, synthetic construct
  REGION 1..7: note = Synthetic Construct
RSKPFTK

SEQ ID NO: 17014 - protein, 7 aa, synthetic construct
  REGION 1..7: note = Synthetic Construct
RSKPFYK

SEQ ID NO: 17015 - protein, 7 aa, synthetic construct
  REGION 1..7: note = Synthetic Construct
RSKPGAK

SEQ ID NO: 17016 - protein, 7 aa, synthetic construct
  REGION 1..7: note = Synthetic Construct
RSKPGDK

SEQ ID NO: 17017 - protein, 7 aa, synthetic construct
  REGION 1..7: note = Synthetic Construct
RSKPGEK

SEQ ID NO: 17018 - protein, 7 aa, synthetic construct
  REGION 1..7: note = Synthetic Construct
RSKPGFK

SEQ ID NO: 17019 - protein, 7 aa, synthetic construct
  REGION 1..7: note = Synthetic Construct
RSKPGGK

SEQ ID NO: 17020 - protein, 7 aa, synthetic construct
  REGION 1..7: note = Synthetic Construct
RSKPGHK

SEQ ID NO: 17021 - protein, 7 aa, synthetic construct
  REGION 1..7: note = Synthetic Construct
RSKPGIK

SEQ ID NO: 17022 - protein, 7 aa, synthetic construct
  REGION 1..7: note = Synthetic Construct
RSKPGLK

SEQ ID NO: 17023 - protein, 7 aa, synthetic construct
  REGION 1..7: note = Synthetic Construct
RSKPGNK

SEQ ID NO: 17024 - protein, 7 aa, synthetic construct
  REGION 1..7: note = Synthetic Construct
RSKPGQK

SEQ ID NO: 17025 - protein, 7 aa, synthetic construct
  REGION 1..7: note = Synthetic Construct
RSKPGRK

SEQ ID NO: 17026 - protein, 7 aa, synthetic construct
  REGION 1..7: note = Synthetic Construct
RSKPGSK

SEQ ID NO: 17027 - protein, 7 aa, synthetic construct
  REGION 1..7: note = Synthetic Construct
RSKPGTK

SEQ ID NO: 17028 - protein, 7 aa, synthetic construct
  REGION 1..7: note = Synthetic Construct
RSKPGYK

SEQ ID NO: 17029 - protein, 7 aa, synthetic construct
  REGION 1..7: note = Synthetic Construct
RSKPHAK

SEQ ID NO: 17030 - protein, 7 aa, synthetic construct
  REGION 1..7: note = Synthetic Construct
RSKPHDK

SEQ ID NO: 17031 - protein, 7 aa, synthetic construct
  REGION 1..7: note = Synthetic Construct
RSKPHEK

SEQ ID NO: 17032 - protein, 7 aa, synthetic construct
  REGION 1..7: note = Synthetic Construct
RSKPHFK

SEQ ID NO: 17033 - protein, 7 aa, synthetic construct
  REGION 1..7: note = Synthetic Construct
RSKPHGK

SEQ ID NO: 17034 - protein, 7 aa, synthetic construct
  REGION 1..7: note = Synthetic Construct
RSKPHHK

SEQ ID NO: 17035 - protein, 7 aa, synthetic construct
  REGION 1..7: note = Synthetic Construct
RSKPHIK

SEQ ID NO: 17036 - protein, 7 aa, synthetic construct
  REGION 1..7: note = Synthetic Construct
RSKPHLK

SEQ ID NO: 17037 - protein, 7 aa, synthetic construct
  REGION 1..7: note = Synthetic Construct
RSKPHNK

SEQ ID NO: 17038 - protein, 7 aa, synthetic construct
  REGION 1..7: note = Synthetic Construct
RSKPHQK

SEQ ID NO: 17039 - protein, 7 aa, synthetic construct
  REGION 1..7: note = Synthetic Construct
RSKPHRK

SEQ ID NO: 17040 - protein, 7 aa, synthetic construct
  REGION 1..7: note = Synthetic Construct
RSKPHSK

SEQ ID NO: 17041 - protein, 7 aa, synthetic construct
  REGION 1..7: note = Synthetic Construct
RSKPHTK

SEQ ID NO: 17042 - protein, 7 aa, synthetic construct
  REGION 1..7: note = Synthetic Construct
RSKPHYK

SEQ ID NO: 17043 - protein, 7 aa, synthetic construct
  REGION 1..7: note = Synthetic Construct
RSKPIAK

SEQ ID NO: 17044 - protein, 7 aa, synthetic construct
  REGION 1..7: note = Synthetic Construct
RSKPIDK

SEQ ID NO: 17045 - protein, 7 aa, synthetic construct
  REGION 1..7: note = Synthetic Construct
RSKPIEK

SEQ ID NO: 17046 - protein, 7 aa, synthetic construct
  REGION 1..7: note = Synthetic Construct
RSKPIFK

SEQ ID NO: 17047 - protein, 7 aa, synthetic construct
  REGION 1..7: note = Synthetic Construct
RSKPIGK

SEQ ID NO: 17048 - protein, 7 aa, synthetic construct
  REGION 1..7: note = Synthetic Construct
RSKPIHK

SEQ ID NO: 17049 - protein, 7 aa, synthetic construct
  REGION 1..7: note = Synthetic Construct
RSKPIIK

SEQ ID NO: 17050 - protein, 7 aa, synthetic construct
  REGION 1..7: note = Synthetic Construct
RSKPILK

SEQ ID NO: 17051 - protein, 7 aa, synthetic construct
  REGION 1..7: note = Synthetic Construct
RSKPINK

SEQ ID NO: 17052 - protein, 7 aa, synthetic construct
  REGION 1..7: note = Synthetic Construct
RSKPIQK

SEQ ID NO: 17053 - protein, 7 aa, synthetic construct
  REGION 1..7: note = Synthetic Construct
RSKPIRK

SEQ ID NO: 17054 - protein, 7 aa, synthetic construct
  REGION 1..7: note = Synthetic Construct
RSKPISK

SEQ ID NO: 17055 - protein, 7 aa, synthetic construct
  REGION 1..7: note = Synthetic Construct
RSKPITK

SEQ ID NO: 17056 - protein, 7 aa, synthetic construct
  REGION 1..7: note = Synthetic Construct
RSKPIYK

SEQ ID NO: 17057 - protein, 7 aa, synthetic construct
  REGION 1..7: note = Synthetic Construct
RSKPLAK

SEQ ID NO: 17058 - protein, 7 aa, synthetic construct
  REGION 1..7: note = Synthetic Construct
RSKPLDK

SEQ ID NO: 17059 - protein, 7 aa, synthetic construct
  REGION 1..7: note = Synthetic Construct
RSKPLEK

SEQ ID NO: 17060 - protein, 7 aa, synthetic construct
  REGION 1..7: note = Synthetic Construct
RSKPLFK

SEQ ID NO: 17061 - protein, 7 aa, synthetic construct
  REGION 1..7: note = Synthetic Construct
RSKPLGK

SEQ ID NO: 17062 - protein, 7 aa, synthetic construct
  REGION 1..7: note = Synthetic Construct
RSKPLHK

SEQ ID NO: 17063 - protein, 7 aa, synthetic construct
  REGION 1..7: note = Synthetic Construct
RSKPLIK

SEQ ID NO: 17064 - protein, 7 aa, synthetic construct
  REGION 1..7: note = Synthetic Construct
RSKPLLK

SEQ ID NO: 17065 - protein, 7 aa, synthetic construct
  REGION 1..7: note = Synthetic Construct
RSKPLNK

SEQ ID NO: 17066 - protein, 7 aa, synthetic construct
  REGION 1..7: note = Synthetic Construct
RSKPLQK

SEQ ID NO: 17067 - protein, 7 aa, synthetic construct
  REGION 1..7: note = Synthetic Construct
RSKPLRK

SEQ ID NO: 17068 - protein, 7 aa, synthetic construct
  REGION 1..7: note = Synthetic Construct
RSKPLSK

SEQ ID NO: 17069 - protein, 7 aa, synthetic construct
  REGION 1..7: note = Synthetic Construct
RSKPLTK

SEQ ID NO: 17070 - protein, 7 aa, synthetic construct
  REGION 1..7: note = Synthetic Construct
RSKPLYK

SEQ ID NO: 17071 - protein, 7 aa, synthetic construct
  REGION 1..7: note = Synthetic Construct
RSKPNAK

SEQ ID NO: 17072 - protein, 7 aa, synthetic construct
  REGION 1..7: note = Synthetic Construct
RSKPNDK

SEQ ID NO: 17073 - protein, 7 aa, synthetic construct
  REGION 1..7: note = Synthetic Construct
RSKPNEK

SEQ ID NO: 17074 - protein, 7 aa, synthetic construct
  REGION 1..7: note = Synthetic Construct
RSKPNFK

SEQ ID NO: 17075 - protein, 7 aa, synthetic construct
  REGION 1..7: note = Synthetic Construct
RSKPNGK

SEQ ID NO: 17076 - protein, 7 aa, synthetic construct
  REGION 1..7: note = Synthetic Construct
RSKPNHK

SEQ ID NO: 17077 - protein, 7 aa, synthetic construct
  REGION 1..7: note = Synthetic Construct
RSKPNIK

SEQ ID NO: 17078 - protein, 7 aa, synthetic construct
  REGION 1..7: note = Synthetic Construct
RSKPNLK

SEQ ID NO: 17079 - protein, 7 aa, synthetic construct
  REGION 1..7: note = Synthetic Construct
RSKPNNK

SEQ ID NO: 17080 - protein, 7 aa, synthetic construct
  REGION 1..7: note = Synthetic Construct
RSKPNQK

SEQ ID NO: 17081 - protein, 7 aa, synthetic construct
  REGION 1..7: note = Synthetic Construct
RSKPNRK

SEQ ID NO: 17082 - protein, 7 aa, synthetic construct
  REGION 1..7: note = Synthetic Construct
RSKPNSK

SEQ ID NO: 17083 - protein, 7 aa, synthetic construct
  REGION 1..7: note = Synthetic Construct
RSKPNTK

SEQ ID NO: 17084 - protein, 7 aa, synthetic construct
  REGION 1..7: note = Synthetic Construct
RSKPNYK

SEQ ID NO: 17085 - protein, 7 aa, synthetic construct
  REGION 1..7: note = Synthetic Construct
RSKPQAK

SEQ ID NO: 17086 - protein, 7 aa, synthetic construct
  REGION 1..7: note = Synthetic Construct
RSKPQDK

SEQ ID NO: 17087 - protein, 7 aa, synthetic construct
  REGION 1..7: note = Synthetic Construct
RSKPQEK

SEQ ID NO: 17088 - protein, 7 aa, synthetic construct
  REGION 1..7: note = Synthetic Construct
RSKPQFK

SEQ ID NO: 17089 - protein, 7 aa, synthetic construct
  REGION 1..7: note = Synthetic Construct
RSKPQGK

SEQ ID NO: 17090 - protein, 7 aa, synthetic construct
  REGION 1..7: note = Synthetic Construct
RSKPQHK

SEQ ID NO: 17091 - protein, 7 aa, synthetic construct
  REGION 1..7: note = Synthetic Construct
RSKPQIK

SEQ ID NO: 17092 - protein, 7 aa, synthetic construct
  REGION 1..7: note = Synthetic Construct
RSKPQLK

SEQ ID NO: 17093 - protein, 7 aa, synthetic construct
  REGION 1..7: note = Synthetic Construct
RSKPQNK

SEQ ID NO: 17094 - protein, 7 aa, synthetic construct
  REGION 1..7: note = Synthetic Construct
RSKPQQK

SEQ ID NO: 17095 - protein, 7 aa, synthetic construct
  REGION 1..7: note = Synthetic Construct
RSKPQRK

SEQ ID NO: 17096 - protein, 7 aa, synthetic construct
  REGION 1..7: note = Synthetic Construct
RSKPQSK

SEQ ID NO: 17097 - protein, 7 aa, synthetic construct
  REGION 1..7: note = Synthetic Construct
RSKPQTK

SEQ ID NO: 17098 - protein, 7 aa, synthetic construct
  REGION 1..7: note = Synthetic Construct
RSKPQYK

SEQ ID NO: 17099 - protein, 7 aa, synthetic construct
  REGION 1..7: note = Synthetic Construct
RSKPRAK

SEQ ID NO: 17100 - protein, 7 aa, synthetic construct
  REGION 1..7: note = Synthetic Construct
RSKPRDK

SEQ ID NO: 17101 - protein, 7 aa, synthetic construct
  REGION 1..7: note = Synthetic Construct
RSKPREK

SEQ ID NO: 17102 - protein, 7 aa, synthetic construct
  REGION 1..7: note = Synthetic Construct
RSKPRFK

SEQ ID NO: 17103 - protein, 7 aa, synthetic construct
  REGION 1..7: note = Synthetic Construct
RSKPRGK

SEQ ID NO: 17104 - protein, 7 aa, synthetic construct
  REGION 1..7: note = Synthetic Construct
RSKPRHK

SEQ ID NO: 17105 - protein, 7 aa, synthetic construct
  REGION 1..7: note = Synthetic Construct
RSKPRIK

SEQ ID NO: 17106 - protein, 7 aa, synthetic construct
  REGION 1..7: note = Synthetic Construct
RSKPRLK

SEQ ID NO: 17107 - protein, 7 aa, synthetic construct
  REGION 1..7: note = Synthetic Construct
RSKPRNK

SEQ ID NO: 17108 - protein, 7 aa, synthetic construct
  REGION 1..7: note = Synthetic Construct
RSKPRQK

SEQ ID NO: 17109 - protein, 7 aa, synthetic construct
  REGION 1..7: note = Synthetic Construct
RSKPRRK

SEQ ID NO: 17110 - protein, 7 aa, synthetic construct
  REGION 1..7: note = Synthetic Construct
RSKPRSK

SEQ ID NO: 17111 - protein, 7 aa, synthetic construct
  REGION 1..7: note = Synthetic Construct
RSKPRTK

SEQ ID NO: 17112 - protein, 7 aa, synthetic construct
  REGION 1..7: note = Synthetic Construct
RSKPRYK

SEQ ID NO: 17113 - protein, 7 aa, synthetic construct
  REGION 1..7: note = Synthetic Construct
RSKPSAK

SEQ ID NO: 17114 - protein, 7 aa, synthetic construct
  REGION 1..7: note = Synthetic Construct
RSKPSDK

SEQ ID NO: 17115 - protein, 7 aa, synthetic construct
  REGION 1..7: note = Synthetic Construct
RSKPSEK

SEQ ID NO: 17116 - protein, 7 aa, synthetic construct
  REGION 1..7: note = Synthetic Construct
RSKPSFK

SEQ ID NO: 17117 - protein, 7 aa, synthetic construct
  REGION 1..7: note = Synthetic Construct
RSKPSGK

SEQ ID NO: 17118 - protein, 7 aa, synthetic construct
  REGION 1..7: note = Synthetic Construct
RSKPSHK

SEQ ID NO: 17119 - protein, 7 aa, synthetic construct
  REGION 1..7: note = Synthetic Construct
RSKPSIK

SEQ ID NO: 17120 - protein, 7 aa, synthetic construct
  REGION 1..7: note = Synthetic Construct
RSKPSLK

SEQ ID NO: 17121 - protein, 7 aa, synthetic construct
  REGION 1..7: note = Synthetic Construct
RSKPSNK

SEQ ID NO: 17122 - protein, 7 aa, synthetic construct
  REGION 1..7: note = Synthetic Construct
RSKPSQK

SEQ ID NO: 17123 - protein, 7 aa, synthetic construct
  REGION 1..7: note = Synthetic Construct
RSKPSRK

SEQ ID NO: 17124 - protein, 7 aa, synthetic construct
  REGION 1..7: note = Synthetic Construct
RSKPSSK

SEQ ID NO: 17125 - protein, 7 aa, synthetic construct
  REGION 1..7: note = Synthetic Construct
RSKPSTK

SEQ ID NO: 17126 - protein, 7 aa, synthetic construct
  REGION 1..7: note = Synthetic Construct
RSKPSYK

SEQ ID NO: 17127 - protein, 7 aa, synthetic construct
  REGION 1..7: note = Synthetic Construct
RSKPTAK

SEQ ID NO: 17128 - protein, 7 aa, synthetic construct
  REGION 1..7: note = Synthetic Construct
RSKPTDK

SEQ ID NO: 17129 - protein, 7 aa, synthetic construct
  REGION 1..7: note = Synthetic Construct
RSKPTEK

SEQ ID NO: 17130 - protein, 7 aa, synthetic construct
  REGION 1..7: note = Synthetic Construct
RSKPTFK

SEQ ID NO: 17131 - protein, 7 aa, synthetic construct
  REGION 1..7: note = Synthetic Construct
RSKPTGK

SEQ ID NO: 17132 - protein, 7 aa, synthetic construct
  REGION 1..7: note = Synthetic Construct
RSKPTHK

SEQ ID NO: 17133 - protein, 7 aa, synthetic construct
  REGION 1..7: note = Synthetic Construct
RSKPTIK

SEQ ID NO: 17134 - protein, 7 aa, synthetic construct
  REGION 1..7: note = Synthetic Construct
RSKPTLK

SEQ ID NO: 17135 - protein, 7 aa, synthetic construct
  REGION 1..7: note = Synthetic Construct
RSKPTNK

SEQ ID NO: 17136 - protein, 7 aa, synthetic construct
  REGION 1..7: note = Synthetic Construct
RSKPTQK

SEQ ID NO: 17137 - protein, 7 aa, synthetic construct
  REGION 1..7: note = Synthetic Construct
RSKPTRK

SEQ ID NO: 17138 - protein, 7 aa, synthetic construct
  REGION 1..7: note = Synthetic Construct
RSKPTSK

SEQ ID NO: 17139 - protein, 7 aa, synthetic construct
  REGION 1..7: note = Synthetic Construct
RSKPTTK

SEQ ID NO: 17140 - protein, 7 aa, synthetic construct
  REGION 1..7: note = Synthetic Construct
RSKPTYK

SEQ ID NO: 17141 - protein, 7 aa, synthetic construct
  REGION 1..7: note = Synthetic Construct
RSKPYAK

SEQ ID NO: 17142 - protein, 7 aa, synthetic construct
  REGION 1..7: note = Synthetic Construct
RSKPYDK

SEQ ID NO: 17143 - protein, 7 aa, synthetic construct
  REGION 1..7: note = Synthetic Construct
RSKPYEK

SEQ ID NO: 17144 - protein, 7 aa, synthetic construct
  REGION 1..7: note = Synthetic Construct
RSKPYFK

SEQ ID NO: 17145 - protein, 7 aa, synthetic construct
  REGION 1..7: note = Synthetic Construct
RSKPYGK

SEQ ID NO: 17146 - protein, 7 aa, synthetic construct
  REGION 1..7: note = Synthetic Construct
RSKPYHK

SEQ ID NO: 17147 - protein, 7 aa, synthetic construct
  REGION 1..7: note = Synthetic Construct
RSKPYIK

SEQ ID NO: 17148 - protein, 7 aa, synthetic construct
  REGION 1..7: note = Synthetic Construct
RSKPYLK

SEQ ID NO: 17149 - protein, 7 aa, synthetic construct
  REGION 1..7: note = Synthetic Construct
RSKPYNK

SEQ ID NO: 17150 - protein, 7 aa, synthetic construct
  REGION 1..7: note = Synthetic Construct
RSKPYQK

SEQ ID NO: 17151 - protein, 7 aa, synthetic construct
  REGION 1..7: note = Synthetic Construct
RSKPYRK

SEQ ID NO: 17152 - protein, 7 aa, synthetic construct
  REGION 1..7: note = Synthetic Construct
RSKPYSK

SEQ ID NO: 17153 - protein, 7 aa, synthetic construct
  REGION 1..7: note = Synthetic Construct
RSKPYTK

SEQ ID NO: 17154 - protein, 7 aa, synthetic construct
  REGION 1..7: note = Synthetic Construct
RSKPYYK

SEQ ID NO: 17155 - protein, 7 aa, synthetic construct
  REGION 1..7: note = Synthetic Construct
RSKQAAK

SEQ ID NO: 17156 - protein, 7 aa, synthetic construct
  REGION 1..7: note = Synthetic Construct
RSKQADK

SEQ ID NO: 17157 - protein, 7 aa, synthetic construct
  REGION 1..7: note = Synthetic Construct
RSKQAEK

SEQ ID NO: 17158 - protein, 7 aa, synthetic construct
  REGION 1..7: note = Synthetic Construct
RSKQAFK

SEQ ID NO: 17159 - protein, 7 aa, synthetic construct
  REGION 1..7: note = Synthetic Construct
RSKQAGK

SEQ ID NO: 17160 - protein, 7 aa, synthetic construct
  REGION 1..7: note = Synthetic Construct
RSKQAHK

SEQ ID NO: 17161 - protein, 7 aa, synthetic construct
  REGION 1..7: note = Synthetic Construct
RSKQAIK

SEQ ID NO: 17162 - protein, 7 aa, synthetic construct
  REGION 1..7: note = Synthetic Construct
RSKQALK

SEQ ID NO: 17163 - protein, 7 aa, synthetic construct
  REGION 1..7: note = Synthetic Construct
RSKQANK

SEQ ID NO: 17164 - protein, 7 aa, synthetic construct
  REGION 1..7: note = Synthetic Construct
RSKQAQK

SEQ ID NO: 17165 - protein, 7 aa, synthetic construct
  REGION 1..7: note = Synthetic Construct
RSKQARK

SEQ ID NO: 17166 - protein, 7 aa, synthetic construct
  REGION 1..7: note = Synthetic Construct
RSKQASK

SEQ ID NO: 17167 - protein, 7 aa, synthetic construct
  REGION 1..7: note = Synthetic Construct
RSKQATK

SEQ ID NO: 17168 - protein, 7 aa, synthetic construct
  REGION 1..7: note = Synthetic Construct
RSKQAYK

SEQ ID NO: 17169 - protein, 7 aa, synthetic construct
  REGION 1..7: note = Synthetic Construct
RSKQDAK

SEQ ID NO: 17170 - protein, 7 aa, synthetic construct
  REGION 1..7: note = Synthetic Construct
RSKQDDK

SEQ ID NO: 17171 - protein, 7 aa, synthetic construct
  REGION 1..7: note = Synthetic Construct
RSKQDEK

SEQ ID NO: 17172 - protein, 7 aa, synthetic construct
  REGION 1..7: note = Synthetic Construct
RSKQDFK

SEQ ID NO: 17173 - protein, 7 aa, synthetic construct
  REGION 1..7: note = Synthetic Construct
RSKQDGK

SEQ ID NO: 17174 - protein, 7 aa, synthetic construct
  REGION 1..7: note = Synthetic Construct
RSKQDHK

SEQ ID NO: 17175 - protein, 7 aa, synthetic construct
  REGION 1..7: note = Synthetic Construct
RSKQDIK

SEQ ID NO: 17176 - protein, 7 aa, synthetic construct
  REGION 1..7: note = Synthetic Construct
RSKQDLK

SEQ ID NO: 17177 - protein, 7 aa, synthetic construct
  REGION 1..7: note = Synthetic Construct
RSKQDNK

SEQ ID NO: 17178 - protein, 7 aa, synthetic construct
  REGION 1..7: note = Synthetic Construct
RSKQDQK

SEQ ID NO: 17179 - protein, 7 aa, synthetic construct
  REGION 1..7: note = Synthetic Construct
RSKQDRK

SEQ ID NO: 17180 - protein, 7 aa, synthetic construct
  REGION 1..7: note = Synthetic Construct
RSKQDSK

SEQ ID NO: 17181 - protein, 7 aa, synthetic construct
  REGION 1..7: note = Synthetic Construct
RSKQDTK

SEQ ID NO: 17182 - protein, 7 aa, synthetic construct
  REGION 1..7: note = Synthetic Construct
RSKQDYK

SEQ ID NO: 17183 - protein, 7 aa, synthetic construct
  REGION 1..7: note = Synthetic Construct
RSKQEAK

SEQ ID NO: 17184 - protein, 7 aa, synthetic construct
  REGION 1..7: note = Synthetic Construct
RSKQEDK

SEQ ID NO: 17185 - protein, 7 aa, synthetic construct
  REGION 1..7: note = Synthetic Construct
RSKQEEK

SEQ ID NO: 17186 - protein, 7 aa, synthetic construct
  REGION 1..7: note = Synthetic Construct
RSKQEFK

SEQ ID NO: 17187 - protein, 7 aa, synthetic construct
  REGION 1..7: note = Synthetic Construct
RSKQEGK

SEQ ID NO: 17188 - protein, 7 aa, synthetic construct
  REGION 1..7: note = Synthetic Construct
RSKQEHK

SEQ ID NO: 17189 - protein, 7 aa, synthetic construct
  REGION 1..7: note = Synthetic Construct
RSKQEIK

SEQ ID NO: 17190 - protein, 7 aa, synthetic construct
  REGION 1..7: note = Synthetic Construct
RSKQELK

SEQ ID NO: 17191 - protein, 7 aa, synthetic construct
  REGION 1..7: note = Synthetic Construct
RSKQENK

SEQ ID NO: 17192 - protein, 7 aa, synthetic construct
  REGION 1..7: note = Synthetic Construct
RSKQEQK

SEQ ID NO: 17193 - protein, 7 aa, synthetic construct
  REGION 1..7: note = Synthetic Construct
RSKQERK

SEQ ID NO: 17194 - protein, 7 aa, synthetic construct
  REGION 1..7: note = Synthetic Construct
RSKQESK

SEQ ID NO: 17195 - protein, 7 aa, synthetic construct
  REGION 1..7: note = Synthetic Construct
RSKQETK

SEQ ID NO: 17196 - protein, 7 aa, synthetic construct
  REGION 1..7: note = Synthetic Construct
RSKQEYK

SEQ ID NO: 17197 - protein, 7 aa, synthetic construct
  REGION 1..7: note = Synthetic Construct
RSKQFAK

SEQ ID NO: 17198 - protein, 7 aa, synthetic construct
  REGION 1..7: note = Synthetic Construct
RSKQFDK

SEQ ID NO: 17199 - protein, 7 aa, synthetic construct
  REGION 1..7: note = Synthetic Construct
RSKQFEK

SEQ ID NO: 17200 - protein, 7 aa, synthetic construct
  REGION 1..7: note = Synthetic Construct
RSKQFFK

SEQ ID NO: 17201 - protein, 7 aa, synthetic construct
  REGION 1..7: note = Synthetic Construct
RSKQFGK

SEQ ID NO: 17202 - protein, 7 aa, synthetic construct
  REGION 1..7: note = Synthetic Construct
RSKQFHK

SEQ ID NO: 17203 - protein, 7 aa, synthetic construct
  REGION 1..7: note = Synthetic Construct
RSKQFIK

SEQ ID NO: 17204 - protein, 7 aa, synthetic construct
  REGION 1..7: note = Synthetic Construct
RSKQFLK

SEQ ID NO: 17205 - protein, 7 aa, synthetic construct
  REGION 1..7: note = Synthetic Construct
RSKQFNK

SEQ ID NO: 17206 - protein, 7 aa, synthetic construct
  REGION 1..7: note = Synthetic Construct
RSKQFQK

SEQ ID NO: 17207 - protein, 7 aa, synthetic construct
  REGION 1..7: note = Synthetic Construct
RSKQFRK

SEQ ID NO: 17208 - protein, 7 aa, synthetic construct
  REGION 1..7: note = Synthetic Construct
RSKQFSK

SEQ ID NO: 17209 - protein, 7 aa, synthetic construct
  REGION 1..7: note = Synthetic Construct
RSKQFTK

SEQ ID NO: 17210 - protein, 7 aa, synthetic construct
  REGION 1..7: note = Synthetic Construct
RSKQFYK

SEQ ID NO: 17211 - protein, 7 aa, synthetic construct
  REGION 1..7: note = Synthetic Construct
RSKQGAK

SEQ ID NO: 17212 - protein, 7 aa, synthetic construct
  REGION 1..7: note = Synthetic Construct
RSKQGDK

SEQ ID NO: 17213 - protein, 7 aa, synthetic construct
  REGION 1..7: note = Synthetic Construct
RSKQGEK

SEQ ID NO: 17214 - protein, 7 aa, synthetic construct
  REGION 1..7: note = Synthetic Construct
RSKQGFK

SEQ ID NO: 17215 - protein, 7 aa, synthetic construct
  REGION 1..7: note = Synthetic Construct
RSKQGGK

SEQ ID NO: 17216 - protein, 7 aa, synthetic construct
  REGION 1..7: note = Synthetic Construct
RSKQGHK

SEQ ID NO: 17217 - protein, 7 aa, synthetic construct
  REGION 1..7: note = Synthetic Construct
RSKQGIK

SEQ ID NO: 17218 - protein, 7 aa, synthetic construct
  REGION 1..7: note = Synthetic Construct
RSKQGLK

SEQ ID NO: 17219 - protein, 7 aa, synthetic construct
  REGION 1..7: note = Synthetic Construct
RSKQGNK

SEQ ID NO: 17220 - protein, 7 aa, synthetic construct
  REGION 1..7: note = Synthetic Construct
RSKQGQK

SEQ ID NO: 17221 - protein, 7 aa, synthetic construct
  REGION 1..7: note = Synthetic Construct
RSKQGRK

SEQ ID NO: 17222 - protein, 7 aa, synthetic construct
  REGION 1..7: note = Synthetic Construct
RSKQGSK

SEQ ID NO: 17223 - protein, 7 aa, synthetic construct
  REGION 1..7: note = Synthetic Construct
RSKQGTK

SEQ ID NO: 17224 - protein, 7 aa, synthetic construct
  REGION 1..7: note = Synthetic Construct
RSKQGYK

SEQ ID NO: 17225 - protein, 7 aa, synthetic construct
  REGION 1..7: note = Synthetic Construct
RSKQHAK

SEQ ID NO: 17226 - protein, 7 aa, synthetic construct
  REGION 1..7: note = Synthetic Construct
RSKQHDK

SEQ ID NO: 17227 - protein, 7 aa, synthetic construct
  REGION 1..7: note = Synthetic Construct
RSKQHEK

SEQ ID NO: 17228 - protein, 7 aa, synthetic construct
  REGION 1..7: note = Synthetic Construct
RSKQHFK

SEQ ID NO: 17229 - protein, 7 aa, synthetic construct
  REGION 1..7: note = Synthetic Construct
RSKQHGK

SEQ ID NO: 17230 - protein, 7 aa, synthetic construct
  REGION 1..7: note = Synthetic Construct
RSKQHHK

SEQ ID NO: 17231 - protein, 7 aa, synthetic construct
  REGION 1..7: note = Synthetic Construct
RSKQHIK

SEQ ID NO: 17232 - protein, 7 aa, synthetic construct
  REGION 1..7: note = Synthetic Construct
RSKQHLK

SEQ ID NO: 17233 - protein, 7 aa, synthetic construct
  REGION 1..7: note = Synthetic Construct
RSKQHNK

SEQ ID NO: 17234 - protein, 7 aa, synthetic construct
  REGION 1..7: note = Synthetic Construct
RSKQHQK

SEQ ID NO: 17235 - protein, 7 aa, synthetic construct
  REGION 1..7: note = Synthetic Construct
RSKQHRK

SEQ ID NO: 17236 - protein, 7 aa, synthetic construct
  REGION 1..7: note = Synthetic Construct
RSKQHSK

SEQ ID NO: 17237 - protein, 7 aa, synthetic construct
  REGION 1..7: note = Synthetic Construct
RSKQHTK

SEQ ID NO: 17238 - protein, 7 aa, synthetic construct
  REGION 1..7: note = Synthetic Construct
RSKQHYK

SEQ ID NO: 17239 - protein, 7 aa, synthetic construct
  REGION 1..7: note = Synthetic Construct
RSKQIAK

SEQ ID NO: 17240 - protein, 7 aa, synthetic construct
  REGION 1..7: note = Synthetic Construct
RSKQIDK

SEQ ID NO: 17241 - protein, 7 aa, synthetic construct
  REGION 1..7: note = Synthetic Construct
RSKQIEK

SEQ ID NO: 17242 - protein, 7 aa, synthetic construct
  REGION 1..7: note = Synthetic Construct
RSKQIFK

SEQ ID NO: 17243 - protein, 7 aa, synthetic construct
  REGION 1..7: note = Synthetic Construct
RSKQIGK

SEQ ID NO: 17244 - protein, 7 aa, synthetic construct
  REGION 1..7: note = Synthetic Construct
RSKQIHK

SEQ ID NO: 17245 - protein, 7 aa, synthetic construct
  REGION 1..7: note = Synthetic Construct
RSKQIIK

SEQ ID NO: 17246 - protein, 7 aa, synthetic construct
  REGION 1..7: note = Synthetic Construct
RSKQILK

SEQ ID NO: 17247 - protein, 7 aa, synthetic construct
  REGION 1..7: note = Synthetic Construct
RSKQINK

SEQ ID NO: 17248 - protein, 7 aa, synthetic construct
  REGION 1..7: note = Synthetic Construct
RSKQIQK

SEQ ID NO: 17249 - protein, 7 aa, synthetic construct
  REGION 1..7: note = Synthetic Construct
RSKQIRK

SEQ ID NO: 17250 - protein, 7 aa, synthetic construct
  REGION 1..7: note = Synthetic Construct
RSKQISK

SEQ ID NO: 17251 - protein, 7 aa, synthetic construct
  REGION 1..7: note = Synthetic Construct
RSKQITK

SEQ ID NO: 17252 - protein, 7 aa, synthetic construct
  REGION 1..7: note = Synthetic Construct
RSKQIYK

SEQ ID NO: 17253 - protein, 7 aa, synthetic construct
  REGION 1..7: note = Synthetic Construct
RSKQLAK

SEQ ID NO: 17254 - protein, 7 aa, synthetic construct
  REGION 1..7: note = Synthetic Construct
RSKQLDK

SEQ ID NO: 17255 - protein, 7 aa, synthetic construct
  REGION 1..7: note = Synthetic Construct
RSKQLEK

SEQ ID NO: 17256 - protein, 7 aa, synthetic construct
  REGION 1..7: note = Synthetic Construct
RSKQLFK

SEQ ID NO: 17257 - protein, 7 aa, synthetic construct
  REGION 1..7: note = Synthetic Construct
RSKQLGK

SEQ ID NO: 17258 - protein, 7 aa, synthetic construct
  REGION 1..7: note = Synthetic Construct
RSKQLHK

SEQ ID NO: 17259 - protein, 7 aa, synthetic construct
  REGION 1..7: note = Synthetic Construct
RSKQLIK

SEQ ID NO: 17260 - protein, 7 aa, synthetic construct
  REGION 1..7: note = Synthetic Construct
RSKQLLK

SEQ ID NO: 17261 - protein, 7 aa, synthetic construct
  REGION 1..7: note = Synthetic Construct
RSKQLNK

SEQ ID NO: 17262 - protein, 7 aa, synthetic construct
  REGION 1..7: note = Synthetic Construct
RSKQLQK

SEQ ID NO: 17263 - protein, 7 aa, synthetic construct
  REGION 1..7: note = Synthetic Construct
RSKQLRK

SEQ ID NO: 17264 - protein, 7 aa, synthetic construct
  REGION 1..7: note = Synthetic Construct
RSKQLSK

SEQ ID NO: 17265 - protein, 7 aa, synthetic construct
  REGION 1..7: note = Synthetic Construct
RSKQLTK

SEQ ID NO: 17266 - protein, 7 aa, synthetic construct
  REGION 1..7: note = Synthetic Construct
RSKQLYK

SEQ ID NO: 17267 - protein, 7 aa, synthetic construct
  REGION 1..7: note = Synthetic Construct
RSKQNAK

SEQ ID NO: 17268 - protein, 7 aa, synthetic construct
  REGION 1..7: note = Synthetic Construct
RSKQNDK

SEQ ID NO: 17269 - protein, 7 aa, synthetic construct
  REGION 1..7: note = Synthetic Construct
RSKQNEK

SEQ ID NO: 17270 - protein, 7 aa, synthetic construct
  REGION 1..7: note = Synthetic Construct
RSKQNFK

SEQ ID NO: 17271 - protein, 7 aa, synthetic construct
  REGION 1..7: note = Synthetic Construct
RSKQNGK

SEQ ID NO: 17272 - protein, 7 aa, synthetic construct
  REGION 1..7: note = Synthetic Construct
RSKQNHK

SEQ ID NO: 17273 - protein, 7 aa, synthetic construct
  REGION 1..7: note = Synthetic Construct
RSKQNIK

SEQ ID NO: 17274 - protein, 7 aa, synthetic construct
  REGION 1..7: note = Synthetic Construct
RSKQNLK

SEQ ID NO: 17275 - protein, 7 aa, synthetic construct
  REGION 1..7: note = Synthetic Construct
RSKQNNK

SEQ ID NO: 17276 - protein, 7 aa, synthetic construct
  REGION 1..7: note = Synthetic Construct
RSKQNQK

SEQ ID NO: 17277 - protein, 7 aa, synthetic construct
  REGION 1..7: note = Synthetic Construct
RSKQNRK

SEQ ID NO: 17278 - protein, 7 aa, synthetic construct
  REGION 1..7: note = Synthetic Construct
RSKQNSK

SEQ ID NO: 17279 - protein, 7 aa, synthetic construct
  REGION 1..7: note = Synthetic Construct
RSKQNTK

SEQ ID NO: 17280 - protein, 7 aa, synthetic construct
  REGION 1..7: note = Synthetic Construct
RSKQNYK

SEQ ID NO: 17281 - protein, 7 aa, synthetic construct
  REGION 1..7: note = Synthetic Construct
RSKQQAK

SEQ ID NO: 17282 - protein, 7 aa, synthetic construct
  REGION 1..7: note = Synthetic Construct
RSKQQDK

SEQ ID NO: 17283 - protein, 7 aa, synthetic construct
  REGION 1..7: note = Synthetic Construct
RSKQQEK

SEQ ID NO: 17284 - protein, 7 aa, synthetic construct
  REGION 1..7: note = Synthetic Construct
RSKQQFK

SEQ ID NO: 17285 - protein, 7 aa, synthetic construct
  REGION 1..7: note = Synthetic Construct
RSKQQGK

SEQ ID NO: 17286 - protein, 7 aa, synthetic construct
  REGION 1..7: note = Synthetic Construct
RSKQQHK

SEQ ID NO: 17287 - protein, 7 aa, synthetic construct
  REGION 1..7: note = Synthetic Construct
RSKQQIK

SEQ ID NO: 17288 - protein, 7 aa, synthetic construct
  REGION 1..7: note = Synthetic Construct
RSKQQLK

SEQ ID NO: 17289 - protein, 7 aa, synthetic construct
  REGION 1..7: note = Synthetic Construct
RSKQQNK

SEQ ID NO: 17290 - protein, 7 aa, synthetic construct
  REGION 1..7: note = Synthetic Construct
RSKQQQK

SEQ ID NO: 17291 - protein, 7 aa, synthetic construct
  REGION 1..7: note = Synthetic Construct
RSKQQRK

SEQ ID NO: 17292 - protein, 7 aa, synthetic construct
  REGION 1..7: note = Synthetic Construct
RSKQQSK

SEQ ID NO: 17293 - protein, 7 aa, synthetic construct
  REGION 1..7: note = Synthetic Construct
RSKQQTK

SEQ ID NO: 17294 - protein, 7 aa, synthetic construct
  REGION 1..7: note = Synthetic Construct
RSKQQYK

SEQ ID NO: 17295 - protein, 7 aa, synthetic construct
  REGION 1..7: note = Synthetic Construct
RSKQRAK

SEQ ID NO: 17296 - protein, 7 aa, synthetic construct
  REGION 1..7: note = Synthetic Construct
RSKQRDK

SEQ ID NO: 17297 - protein, 7 aa, synthetic construct
  REGION 1..7: note = Synthetic Construct
RSKQREK

SEQ ID NO: 17298 - protein, 7 aa, synthetic construct
  REGION 1..7: note = Synthetic Construct
RSKQRFK

SEQ ID NO: 17299 - protein, 7 aa, synthetic construct
  REGION 1..7: note = Synthetic Construct
RSKQRGK

SEQ ID NO: 17300 - protein, 7 aa, synthetic construct
  REGION 1..7: note = Synthetic Construct
RSKQRHK

SEQ ID NO: 17301 - protein, 7 aa, synthetic construct
  REGION 1..7: note = Synthetic Construct
RSKQRIK

SEQ ID NO: 17302 - protein, 7 aa, synthetic construct
  REGION 1..7: note = Synthetic Construct
RSKQRLK

SEQ ID NO: 17303 - protein, 7 aa, synthetic construct
  REGION 1..7: note = Synthetic Construct
RSKQRNK

SEQ ID NO: 17304 - protein, 7 aa, synthetic construct
  REGION 1..7: note = Synthetic Construct
RSKQRQK

SEQ ID NO: 17305 - protein, 7 aa, synthetic construct
  REGION 1..7: note = Synthetic Construct
RSKQRRK

SEQ ID NO: 17306 - protein, 7 aa, synthetic construct
  REGION 1..7: note = Synthetic Construct
RSKQRSK

SEQ ID NO: 17307 - protein, 7 aa, synthetic construct
  REGION 1..7: note = Synthetic Construct
RSKQRTK

SEQ ID NO: 17308 - protein, 7 aa, synthetic construct
  REGION 1..7: note = Synthetic Construct
RSKQRYK

SEQ ID NO: 17309 - protein, 7 aa, synthetic construct
  REGION 1..7: note = Synthetic Construct
RSKQSAK

SEQ ID NO: 17310 - protein, 7 aa, synthetic construct
  REGION 1..7: note = Synthetic Construct
RSKQSDK

SEQ ID NO: 17311 - protein, 7 aa, synthetic construct
  REGION 1..7: note = Synthetic Construct
RSKQSEK

SEQ ID NO: 17312 - protein, 7 aa, synthetic construct
  REGION 1..7: note = Synthetic Construct
RSKQSFK

SEQ ID NO: 17313 - protein, 7 aa, synthetic construct
  REGION 1..7: note = Synthetic Construct
RSKQSGK

SEQ ID NO: 17314 - protein, 7 aa, synthetic construct
  REGION 1..7: note = Synthetic Construct
RSKQSHK

SEQ ID NO: 17315 - protein, 7 aa, synthetic construct
  REGION 1..7: note = Synthetic Construct
RSKQSIK

SEQ ID NO: 17316 - protein, 7 aa, synthetic construct
  REGION 1..7: note = Synthetic Construct
RSKQSLK

SEQ ID NO: 17317 - protein, 7 aa, synthetic construct
  REGION 1..7: note = Synthetic Construct
RSKQSNK

SEQ ID NO: 17318 - protein, 7 aa, synthetic construct
  REGION 1..7: note = Synthetic Construct
RSKQSQK

SEQ ID NO: 17319 - protein, 7 aa, synthetic construct
  REGION 1..7: note = Synthetic Construct
RSKQSRK

SEQ ID NO: 17320 - protein, 7 aa, synthetic construct
  REGION 1..7: note = Synthetic Construct
RSKQSSK

SEQ ID NO: 17321 - protein, 7 aa, synthetic construct
  REGION 1..7: note = Synthetic Construct
RSKQSTK

SEQ ID NO: 17322 - protein, 7 aa, synthetic construct
  REGION 1..7: note = Synthetic Construct
RSKQSYK

SEQ ID NO: 17323 - protein, 7 aa, synthetic construct
  REGION 1..7: note = Synthetic Construct
RSKQTAK

SEQ ID NO: 17324 - protein, 7 aa, synthetic construct
  REGION 1..7: note = Synthetic Construct
RSKQTDK

SEQ ID NO: 17325 - protein, 7 aa, synthetic construct
  REGION 1..7: note = Synthetic Construct
RSKQTEK

SEQ ID NO: 17326 - protein, 7 aa, synthetic construct
  REGION 1..7: note = Synthetic Construct
RSKQTFK

SEQ ID NO: 17327 - protein, 7 aa, synthetic construct
  REGION 1..7: note = Synthetic Construct
RSKQTGK

SEQ ID NO: 17328 - protein, 7 aa, synthetic construct
  REGION 1..7: note = Synthetic Construct
RSKQTHK

SEQ ID NO: 17329 - protein, 7 aa, synthetic construct
  REGION 1..7: note = Synthetic Construct
RSKQTIK

SEQ ID NO: 17330 - protein, 7 aa, synthetic construct
  REGION 1..7: note = Synthetic Construct
RSKQTLK

SEQ ID NO: 17331 - protein, 7 aa, synthetic construct
  REGION 1..7: note = Synthetic Construct
RSKQTNK

SEQ ID NO: 17332 - protein, 7 aa, synthetic construct
  REGION 1..7: note = Synthetic Construct
RSKQTQK

SEQ ID NO: 17333 - protein, 7 aa, synthetic construct
  REGION 1..7: note = Synthetic Construct
RSKQTRK

SEQ ID NO: 17334 - protein, 7 aa, synthetic construct
  REGION 1..7: note = Synthetic Construct
RSKQTSK

SEQ ID NO: 17335 - protein, 7 aa, synthetic construct
  REGION 1..7: note = Synthetic Construct
RSKQTTK

SEQ ID NO: 17336 - protein, 7 aa, synthetic construct
  REGION 1..7: note = Synthetic Construct
RSKQTYK

SEQ ID NO: 17337 - protein, 7 aa, synthetic construct
  REGION 1..7: note = Synthetic Construct
RSKQYAK

SEQ ID NO: 17338 - protein, 7 aa, synthetic construct
  REGION 1..7: note = Synthetic Construct
RSKQYDK

SEQ ID NO: 17339 - protein, 7 aa, synthetic construct
  REGION 1..7: note = Synthetic Construct
RSKQYEK

SEQ ID NO: 17340 - protein, 7 aa, synthetic construct
  REGION 1..7: note = Synthetic Construct
RSKQYFK

SEQ ID NO: 17341 - protein, 7 aa, synthetic construct
  REGION 1..7: note = Synthetic Construct
RSKQYGK

SEQ ID NO: 17342 - protein, 7 aa, synthetic construct
  REGION 1..7: note = Synthetic Construct
RSKQYHK

SEQ ID NO: 17343 - protein, 7 aa, synthetic construct
  REGION 1..7: note = Synthetic Construct
RSKQYIK

SEQ ID NO: 17344 - protein, 7 aa, synthetic construct
  REGION 1..7: note = Synthetic Construct
RSKQYLK

SEQ ID NO: 17345 - protein, 7 aa, synthetic construct
  REGION 1..7: note = Synthetic Construct
RSKQYNK

SEQ ID NO: 17346 - protein, 7 aa, synthetic construct
  REGION 1..7: note = Synthetic Construct
RSKQYQK

SEQ ID NO: 17347 - protein, 7 aa, synthetic construct
  REGION 1..7: note = Synthetic Construct
RSKQYRK

SEQ ID NO: 17348 - protein, 7 aa, synthetic construct
  REGION 1..7: note = Synthetic Construct
RSKQYSK

SEQ ID NO: 17349 - protein, 7 aa, synthetic construct
  REGION 1..7: note = Synthetic Construct
RSKQYTK

SEQ ID NO: 17350 - protein, 7 aa, synthetic construct
  REGION 1..7: note = Synthetic Construct
RSKQYYK

SEQ ID NO: 17351 - protein, 7 aa, synthetic construct
  REGION 1..7: note = Synthetic Construct
RSKRAAK

SEQ ID NO: 17352 - protein, 7 aa, synthetic construct
  REGION 1..7: note = Synthetic Construct
RSKRADK

SEQ ID NO: 17353 - protein, 7 aa, synthetic construct
  REGION 1..7: note = Synthetic Construct
RSKRAEK

SEQ ID NO: 17354 - protein, 7 aa, synthetic construct
  REGION 1..7: note = Synthetic Construct
RSKRAFK

SEQ ID NO: 17355 - protein, 7 aa, synthetic construct
  REGION 1..7: note = Synthetic Construct
RSKRAGK

SEQ ID NO: 17356 - protein, 7 aa, synthetic construct
  REGION 1..7: note = Synthetic Construct
RSKRAHK

SEQ ID NO: 17357 - protein, 7 aa, synthetic construct
  REGION 1..7: note = Synthetic Construct
RSKRAIK

SEQ ID NO: 17358 - protein, 7 aa, synthetic construct
  REGION 1..7: note = Synthetic Construct
RSKRALK

SEQ ID NO: 17359 - protein, 7 aa, synthetic construct
  REGION 1..7: note = Synthetic Construct
RSKRANK

SEQ ID NO: 17360 - protein, 7 aa, synthetic construct
  REGION 1..7: note = Synthetic Construct
RSKRAQK

SEQ ID NO: 17361 - protein, 7 aa, synthetic construct
  REGION 1..7: note = Synthetic Construct
RSKRARK

SEQ ID NO: 17362 - protein, 7 aa, synthetic construct
  REGION 1..7: note = Synthetic Construct
RSKRASK

SEQ ID NO: 17363 - protein, 7 aa, synthetic construct
  REGION 1..7: note = Synthetic Construct
RSKRATK

SEQ ID NO: 17364 - protein, 7 aa, synthetic construct
  REGION 1..7: note = Synthetic Construct
RSKRAYK

SEQ ID NO: 17365 - protein, 7 aa, synthetic construct
  REGION 1..7: note = Synthetic Construct
RSKRDAK

SEQ ID NO: 17366 - protein, 7 aa, synthetic construct
  REGION 1..7: note = Synthetic Construct
RSKRDDK

SEQ ID NO: 17367 - protein, 7 aa, synthetic construct
  REGION 1..7: note = Synthetic Construct
RSKRDEK

SEQ ID NO: 17368 - protein, 7 aa, synthetic construct
  REGION 1..7: note = Synthetic Construct
RSKRDFK

SEQ ID NO: 17369 - protein, 7 aa, synthetic construct
  REGION 1..7: note = Synthetic Construct
RSKRDGK

SEQ ID NO: 17370 - protein, 7 aa, synthetic construct
  REGION 1..7: note = Synthetic Construct
RSKRDHK

SEQ ID NO: 17371 - protein, 7 aa, synthetic construct
  REGION 1..7: note = Synthetic Construct
RSKRDIK

SEQ ID NO: 17372 - protein, 7 aa, synthetic construct
  REGION 1..7: note = Synthetic Construct
RSKRDLK

SEQ ID NO: 17373 - protein, 7 aa, synthetic construct
  REGION 1..7: note = Synthetic Construct
RSKRDNK

SEQ ID NO: 17374 - protein, 7 aa, synthetic construct
  REGION 1..7: note = Synthetic Construct
RSKRDQK

SEQ ID NO: 17375 - protein, 7 aa, synthetic construct
  REGION 1..7: note = Synthetic Construct
RSKRDRK

SEQ ID NO: 17376 - protein, 7 aa, synthetic construct
  REGION 1..7: note = Synthetic Construct
RSKRDSK

SEQ ID NO: 17377 - protein, 7 aa, synthetic construct
  REGION 1..7: note = Synthetic Construct
RSKRDTK

SEQ ID NO: 17378 - protein, 7 aa, synthetic construct
  REGION 1..7: note = Synthetic Construct
RSKRDYK

SEQ ID NO: 17379 - protein, 7 aa, synthetic construct
  REGION 1..7: note = Synthetic Construct
RSKREAK

SEQ ID NO: 17380 - protein, 7 aa, synthetic construct
  REGION 1..7: note = Synthetic Construct
RSKREDK

SEQ ID NO: 17381 - protein, 7 aa, synthetic construct
  REGION 1..7: note = Synthetic Construct
RSKREEK

SEQ ID NO: 17382 - protein, 7 aa, synthetic construct
  REGION 1..7: note = Synthetic Construct
RSKREFK

SEQ ID NO: 17383 - protein, 7 aa, synthetic construct
  REGION 1..7: note = Synthetic Construct
RSKREGK

SEQ ID NO: 17384 - protein, 7 aa, synthetic construct
  REGION 1..7: note = Synthetic Construct
RSKREHK

SEQ ID NO: 17385 - protein, 7 aa, synthetic construct
  REGION 1..7: note = Synthetic Construct
RSKREIK

SEQ ID NO: 17386 - protein, 7 aa, synthetic construct
  REGION 1..7: note = Synthetic Construct
RSKRELK

SEQ ID NO: 17387 - protein, 7 aa, synthetic construct
  REGION 1..7: note = Synthetic Construct
RSKRENK

SEQ ID NO: 17388 - protein, 7 aa, synthetic construct
  REGION 1..7: note = Synthetic Construct
RSKREQK

SEQ ID NO: 17389 - protein, 7 aa, synthetic construct
  REGION 1..7: note = Synthetic Construct
RSKRERK

SEQ ID NO: 17390 - protein, 7 aa, synthetic construct
  REGION 1..7: note = Synthetic Construct
RSKRESK

SEQ ID NO: 17391 - protein, 7 aa, synthetic construct
  REGION 1..7: note = Synthetic Construct
RSKRETK

SEQ ID NO: 17392 - protein, 7 aa, synthetic construct
  REGION 1..7: note = Synthetic Construct
RSKREYK

SEQ ID NO: 17393 - protein, 7 aa, synthetic construct
  REGION 1..7: note = Synthetic Construct
RSKRFAK

SEQ ID NO: 17394 - protein, 7 aa, synthetic construct
  REGION 1..7: note = Synthetic Construct
RSKRFDK

SEQ ID NO: 17395 - protein, 7 aa, synthetic construct
  REGION 1..7: note = Synthetic Construct
RSKRFEK

SEQ ID NO: 17396 - protein, 7 aa, synthetic construct
  REGION 1..7: note = Synthetic Construct
RSKRFFK

SEQ ID NO: 17397 - protein, 7 aa, synthetic construct
  REGION 1..7: note = Synthetic Construct
RSKRFGK

SEQ ID NO: 17398 - protein, 7 aa, synthetic construct
  REGION 1..7: note = Synthetic Construct
RSKRFHK

SEQ ID NO: 17399 - protein, 7 aa, synthetic construct
  REGION 1..7: note = Synthetic Construct
RSKRFIK

SEQ ID NO: 17400 - protein, 7 aa, synthetic construct
  REGION 1..7: note = Synthetic Construct
RSKRFLK

SEQ ID NO: 17401 - protein, 7 aa, synthetic construct
  REGION 1..7: note = Synthetic Construct
RSKRFNK

SEQ ID NO: 17402 - protein, 7 aa, synthetic construct
  REGION 1..7: note = Synthetic Construct
RSKRFQK

SEQ ID NO: 17403 - protein, 7 aa, synthetic construct
  REGION 1..7: note = Synthetic Construct
RSKRFRK

SEQ ID NO: 17404 - protein, 7 aa, synthetic construct
  REGION 1..7: note = Synthetic Construct
RSKRFSK

SEQ ID NO: 17405 - protein, 7 aa, synthetic construct
  REGION 1..7: note = Synthetic Construct
RSKRFTK

SEQ ID NO: 17406 - protein, 7 aa, synthetic construct
  REGION 1..7: note = Synthetic Construct
RSKRFYK

SEQ ID NO: 17407 - protein, 7 aa, synthetic construct
  REGION 1..7: note = Synthetic Construct
RSKRGAK

SEQ ID NO: 17408 - protein, 7 aa, synthetic construct
  REGION 1..7: note = Synthetic Construct
RSKRGDK

SEQ ID NO: 17409 - protein, 7 aa, synthetic construct
  REGION 1..7: note = Synthetic Construct
RSKRGEK

SEQ ID NO: 17410 - protein, 7 aa, synthetic construct
  REGION 1..7: note = Synthetic Construct
RSKRGFK

SEQ ID NO: 17411 - protein, 7 aa, synthetic construct
  REGION 1..7: note = Synthetic Construct
RSKRGGK

SEQ ID NO: 17412 - protein, 7 aa, synthetic construct
  REGION 1..7: note = Synthetic Construct
RSKRGHK

SEQ ID NO: 17413 - protein, 7 aa, synthetic construct
  REGION 1..7: note = Synthetic Construct
RSKRGIK

SEQ ID NO: 17414 - protein, 7 aa, synthetic construct
  REGION 1..7: note = Synthetic Construct
RSKRGLK

SEQ ID NO: 17415 - protein, 7 aa, synthetic construct
  REGION 1..7: note = Synthetic Construct
RSKRGNK

SEQ ID NO: 17416 - protein, 7 aa, synthetic construct
  REGION 1..7: note = Synthetic Construct
RSKRGQK

SEQ ID NO: 17417 - protein, 7 aa, synthetic construct
  REGION 1..7: note = Synthetic Construct
RSKRGRK

SEQ ID NO: 17418 - protein, 7 aa, synthetic construct
  REGION 1..7: note = Synthetic Construct
RSKRGSK

SEQ ID NO: 17419 - protein, 7 aa, synthetic construct
  REGION 1..7: note = Synthetic Construct
RSKRGTK

SEQ ID NO: 17420 - protein, 7 aa, synthetic construct
  REGION 1..7: note = Synthetic Construct
RSKRGYK

SEQ ID NO: 17421 - protein, 7 aa, synthetic construct
  REGION 1..7: note = Synthetic Construct
RSKRHAK

SEQ ID NO: 17422 - protein, 7 aa, synthetic construct
  REGION 1..7: note = Synthetic Construct
RSKRHDK

SEQ ID NO: 17423 - protein, 7 aa, synthetic construct
  REGION 1..7: note = Synthetic Construct
RSKRHEK

SEQ ID NO: 17424 - protein, 7 aa, synthetic construct
  REGION 1..7: note = Synthetic Construct
RSKRHFK

SEQ ID NO: 17425 - protein, 7 aa, synthetic construct
  REGION 1..7: note = Synthetic Construct
RSKRHGK

SEQ ID NO: 17426 - protein, 7 aa, synthetic construct
  REGION 1..7: note = Synthetic Construct
RSKRHHK

SEQ ID NO: 17427 - protein, 7 aa, synthetic construct
  REGION 1..7: note = Synthetic Construct
RSKRHIK

SEQ ID NO: 17428 - protein, 7 aa, synthetic construct
  REGION 1..7: note = Synthetic Construct
RSKRHLK

SEQ ID NO: 17429 - protein, 7 aa, synthetic construct
  REGION 1..7: note = Synthetic Construct
RSKRHNK

SEQ ID NO: 17430 - protein, 7 aa, synthetic construct
  REGION 1..7: note = Synthetic Construct
RSKRHQK

SEQ ID NO: 17431 - protein, 7 aa, synthetic construct
  REGION 1..7: note = Synthetic Construct
RSKRHRK

SEQ ID NO: 17432 - protein, 7 aa, synthetic construct
  REGION 1..7: note = Synthetic Construct
RSKRHSK

SEQ ID NO: 17433 - protein, 7 aa, synthetic construct
  REGION 1..7: note = Synthetic Construct
RSKRHTK

SEQ ID NO: 17434 - protein, 7 aa, synthetic construct
  REGION 1..7: note = Synthetic Construct
RSKRHYK

SEQ ID NO: 17435 - protein, 7 aa, synthetic construct
  REGION 1..7: note = Synthetic Construct
RSKRIAK

SEQ ID NO: 17436 - protein, 7 aa, synthetic construct
  REGION 1..7: note = Synthetic Construct
RSKRIDK

SEQ ID NO: 17437 - protein, 7 aa, synthetic construct
  REGION 1..7: note = Synthetic Construct
RSKRIEK

SEQ ID NO: 17438 - protein, 7 aa, synthetic construct
  REGION 1..7: note = Synthetic Construct
RSKRIFK

SEQ ID NO: 17439 - protein, 7 aa, synthetic construct
  REGION 1..7: note = Synthetic Construct
RSKRIGK

SEQ ID NO: 17440 - protein, 7 aa, synthetic construct
  REGION 1..7: note = Synthetic Construct
RSKRIHK

SEQ ID NO: 17441 - protein, 7 aa, synthetic construct
  REGION 1..7: note = Synthetic Construct
RSKRIIK

SEQ ID NO: 17442 - protein, 7 aa, synthetic construct
  REGION 1..7: note = Synthetic Construct
RSKRILK

SEQ ID NO: 17443 - protein, 7 aa, synthetic construct
  REGION 1..7: note = Synthetic Construct
RSKRINK

SEQ ID NO: 17444 - protein, 7 aa, synthetic construct
  REGION 1..7: note = Synthetic Construct
RSKRIQK

SEQ ID NO: 17445 - protein, 7 aa, synthetic construct
  REGION 1..7: note = Synthetic Construct
RSKRIRK

SEQ ID NO: 17446 - protein, 7 aa, synthetic construct
  REGION 1..7: note = Synthetic Construct
RSKRISK

SEQ ID NO: 17447 - protein, 7 aa, synthetic construct
  REGION 1..7: note = Synthetic Construct
RSKRITK

SEQ ID NO: 17448 - protein, 7 aa, synthetic construct
  REGION 1..7: note = Synthetic Construct
RSKRIYK

SEQ ID NO: 17449 - protein, 7 aa, synthetic construct
  REGION 1..7: note = Synthetic Construct
RSKRLAK

SEQ ID NO: 17450 - protein, 7 aa, synthetic construct
  REGION 1..7: note = Synthetic Construct
RSKRLDK

SEQ ID NO: 17451 - protein, 7 aa, synthetic construct
  REGION 1..7: note = Synthetic Construct
RSKRLEK

SEQ ID NO: 17452 - protein, 7 aa, synthetic construct
  REGION 1..7: note = Synthetic Construct
RSKRLFK

SEQ ID NO: 17453 - protein, 7 aa, synthetic construct
  REGION 1..7: note = Synthetic Construct
RSKRLGK

SEQ ID NO: 17454 - protein, 7 aa, synthetic construct
  REGION 1..7: note = Synthetic Construct
RSKRLHK

SEQ ID NO: 17455 - protein, 7 aa, synthetic construct
  REGION 1..7: note = Synthetic Construct
RSKRLIK

SEQ ID NO: 17456 - protein, 7 aa, synthetic construct
  REGION 1..7: note = Synthetic Construct
RSKRLLK

SEQ ID NO: 17457 - protein, 7 aa, synthetic construct
  REGION 1..7: note = Synthetic Construct
RSKRLNK

SEQ ID NO: 17458 - protein, 7 aa, synthetic construct
  REGION 1..7: note = Synthetic Construct
RSKRLQK

SEQ ID NO: 17459 - protein, 7 aa, synthetic construct
  REGION 1..7: note = Synthetic Construct
RSKRLRK

SEQ ID NO: 17460 - protein, 7 aa, synthetic construct
  REGION 1..7: note = Synthetic Construct
RSKRLSK

SEQ ID NO: 17461 - protein, 7 aa, synthetic construct
  REGION 1..7: note = Synthetic Construct
RSKRLTK

SEQ ID NO: 17462 - protein, 7 aa, synthetic construct
  REGION 1..7: note = Synthetic Construct
RSKRLYK

SEQ ID NO: 17463 - protein, 7 aa, synthetic construct
  REGION 1..7: note = Synthetic Construct
RSKRNAK

SEQ ID NO: 17464 - protein, 7 aa, synthetic construct
  REGION 1..7: note = Synthetic Construct
RSKRNDK

SEQ ID NO: 17465 - protein, 7 aa, synthetic construct
  REGION 1..7: note = Synthetic Construct
RSKRNEK

SEQ ID NO: 17466 - protein, 7 aa, synthetic construct
  REGION 1..7: note = Synthetic Construct
RSKRNFK

SEQ ID NO: 17467 - protein, 7 aa, synthetic construct
  REGION 1..7: note = Synthetic Construct
RSKRNGK

SEQ ID NO: 17468 - protein, 7 aa, synthetic construct
  REGION 1..7: note = Synthetic Construct
RSKRNHK

SEQ ID NO: 17469 - protein, 7 aa, synthetic construct
  REGION 1..7: note = Synthetic Construct
RSKRNIK

SEQ ID NO: 17470 - protein, 7 aa, synthetic construct
  REGION 1..7: note = Synthetic Construct
RSKRNLK

SEQ ID NO: 17471 - protein, 7 aa, synthetic construct
  REGION 1..7: note = Synthetic Construct
RSKRNNK

SEQ ID NO: 17472 - protein, 7 aa, synthetic construct
  REGION 1..7: note = Synthetic Construct
RSKRNQK

SEQ ID NO: 17473 - protein, 7 aa, synthetic construct
  REGION 1..7: note = Synthetic Construct
RSKRNRK

SEQ ID NO: 17474 - protein, 7 aa, synthetic construct
  REGION 1..7: note = Synthetic Construct
RSKRNSK

SEQ ID NO: 17475 - protein, 7 aa, synthetic construct
  REGION 1..7: note = Synthetic Construct
RSKRNTK

SEQ ID NO: 17476 - protein, 7 aa, synthetic construct
  REGION 1..7: note = Synthetic Construct
RSKRNYK

SEQ ID NO: 17477 - protein, 7 aa, synthetic construct
  REGION 1..7: note = Synthetic Construct
RSKRQAK

SEQ ID NO: 17478 - protein, 7 aa, synthetic construct
  REGION 1..7: note = Synthetic Construct
RSKRQDK

SEQ ID NO: 17479 - protein, 7 aa, synthetic construct
  REGION 1..7: note = Synthetic Construct
RSKRQEK

SEQ ID NO: 17480 - protein, 7 aa, synthetic construct
  REGION 1..7: note = Synthetic Construct
RSKRQFK

SEQ ID NO: 17481 - protein, 7 aa, synthetic construct
  REGION 1..7: note = Synthetic Construct
RSKRQGK

SEQ ID NO: 17482 - protein, 7 aa, synthetic construct
  REGION 1..7: note = Synthetic Construct
RSKRQHK

SEQ ID NO: 17483 - protein, 7 aa, synthetic construct
  REGION 1..7: note = Synthetic Construct
RSKRQIK

SEQ ID NO: 17484 - protein, 7 aa, synthetic construct
  REGION 1..7: note = Synthetic Construct
RSKRQLK

SEQ ID NO: 17485 - protein, 7 aa, synthetic construct
  REGION 1..7: note = Synthetic Construct
RSKRQNK

SEQ ID NO: 17486 - protein, 7 aa, synthetic construct
  REGION 1..7: note = Synthetic Construct
RSKRQQK

SEQ ID NO: 17487 - protein, 7 aa, synthetic construct
  REGION 1..7: note = Synthetic Construct
RSKRQRK

SEQ ID NO: 17488 - protein, 7 aa, synthetic construct
  REGION 1..7: note = Synthetic Construct
RSKRQSK

SEQ ID NO: 17489 - protein, 7 aa, synthetic construct
  REGION 1..7: note = Synthetic Construct
RSKRQTK

SEQ ID NO: 17490 - protein, 7 aa, synthetic construct
  REGION 1..7: note = Synthetic Construct
RSKRQYK

SEQ ID NO: 17491 - protein, 7 aa, synthetic construct
  REGION 1..7: note = Synthetic Construct
RSKRRAK

SEQ ID NO: 17492 - protein, 7 aa, synthetic construct
  REGION 1..7: note = Synthetic Construct
RSKRRDK

SEQ ID NO: 17493 - protein, 7 aa, synthetic construct
  REGION 1..7: note = Synthetic Construct
RSKRREK

SEQ ID NO: 17494 - protein, 7 aa, synthetic construct
  REGION 1..7: note = Synthetic Construct
RSKRRFK

SEQ ID NO: 17495 - protein, 7 aa, synthetic construct
  REGION 1..7: note = Synthetic Construct
RSKRRGK

SEQ ID NO: 17496 - protein, 7 aa, synthetic construct
  REGION 1..7: note = Synthetic Construct
RSKRRHK

SEQ ID NO: 17497 - protein, 7 aa, synthetic construct
  REGION 1..7: note = Synthetic Construct
RSKRRIK

SEQ ID NO: 17498 - protein, 7 aa, synthetic construct
  REGION 1..7: note = Synthetic Construct
RSKRRLK

SEQ ID NO: 17499 - protein, 7 aa, synthetic construct
  REGION 1..7: note = Synthetic Construct
RSKRRNK

SEQ ID NO: 17500 - protein, 7 aa, synthetic construct
  REGION 1..7: note = Synthetic Construct
RSKRRQK

SEQ ID NO: 17501 - protein, 7 aa, synthetic construct
  REGION 1..7: note = Synthetic Construct
RSKRRRK

SEQ ID NO: 17502 - protein, 7 aa, synthetic construct
  REGION 1..7: note = Synthetic Construct
RSKRRSK

SEQ ID NO: 17503 - protein, 7 aa, synthetic construct
  REGION 1..7: note = Synthetic Construct
RSKRRTK

SEQ ID NO: 17504 - protein, 7 aa, synthetic construct
  REGION 1..7: note = Synthetic Construct
RSKRRYK

SEQ ID NO: 17505 - protein, 7 aa, synthetic construct
  REGION 1..7: note = Synthetic Construct
RSKRSAK

SEQ ID NO: 17506 - protein, 7 aa, synthetic construct
  REGION 1..7: note = Synthetic Construct
RSKRSDK

SEQ ID NO: 17507 - protein, 7 aa, synthetic construct
  REGION 1..7: note = Synthetic Construct
RSKRSEK

SEQ ID NO: 17508 - protein, 7 aa, synthetic construct
  REGION 1..7: note = Synthetic Construct
RSKRSFK

SEQ ID NO: 17509 - protein, 7 aa, synthetic construct
  REGION 1..7: note = Synthetic Construct
RSKRSGK

SEQ ID NO: 17510 - protein, 7 aa, synthetic construct
  REGION 1..7: note = Synthetic Construct
RSKRSHK

SEQ ID NO: 17511 - protein, 7 aa, synthetic construct
  REGION 1..7: note = Synthetic Construct
RSKRSIK

SEQ ID NO: 17512 - protein, 7 aa, synthetic construct
  REGION 1..7: note = Synthetic Construct
RSKRSLK

SEQ ID NO: 17513 - protein, 7 aa, synthetic construct
  REGION 1..7: note = Synthetic Construct
RSKRSNK

SEQ ID NO: 17514 - protein, 7 aa, synthetic construct
  REGION 1..7: note = Synthetic Construct
RSKRSQK

SEQ ID NO: 17515 - protein, 7 aa, synthetic construct
  REGION 1..7: note = Synthetic Construct
RSKRSRK

SEQ ID NO: 17516 - protein, 7 aa, synthetic construct
  REGION 1..7: note = Synthetic Construct
RSKRSSK

SEQ ID NO: 17517 - protein, 7 aa, synthetic construct
  REGION 1..7: note = Synthetic Construct
RSKRSTK

SEQ ID NO: 17518 - protein, 7 aa, synthetic construct
  REGION 1..7: note = Synthetic Construct
RSKRSYK

SEQ ID NO: 17519 - protein, 7 aa, synthetic construct
  REGION 1..7: note = Synthetic Construct
RSKRTAK

SEQ ID NO: 17520 - protein, 7 aa, synthetic construct
  REGION 1..7: note = Synthetic Construct
RSKRTDK

SEQ ID NO: 17521 - protein, 7 aa, synthetic construct
  REGION 1..7: note = Synthetic Construct
RSKRTEK

SEQ ID NO: 17522 - protein, 7 aa, synthetic construct
  REGION 1..7: note = Synthetic Construct
RSKRTFK

SEQ ID NO: 17523 - protein, 7 aa, synthetic construct
  REGION 1..7: note = Synthetic Construct
RSKRTGK

SEQ ID NO: 17524 - protein, 7 aa, synthetic construct
  REGION 1..7: note = Synthetic Construct
RSKRTHK

SEQ ID NO: 17525 - protein, 7 aa, synthetic construct
  REGION 1..7: note = Synthetic Construct
RSKRTIK

SEQ ID NO: 17526 - protein, 7 aa, synthetic construct
  REGION 1..7: note = Synthetic Construct
RSKRTLK

SEQ ID NO: 17527 - protein, 7 aa, synthetic construct
  REGION 1..7: note = Synthetic Construct
RSKRTNK

SEQ ID NO: 17528 - protein, 7 aa, synthetic construct
  REGION 1..7: note = Synthetic Construct
RSKRTQK

SEQ ID NO: 17529 - protein, 7 aa, synthetic construct
  REGION 1..7: note = Synthetic Construct
RSKRTRK

SEQ ID NO: 17530 - protein, 7 aa, synthetic construct
  REGION 1..7: note = Synthetic Construct
RSKRTSK

SEQ ID NO: 17531 - protein, 7 aa, synthetic construct
  REGION 1..7: note = Synthetic Construct
RSKRTTK

SEQ ID NO: 17532 - protein, 7 aa, synthetic construct
  REGION 1..7: note = Synthetic Construct
RSKRTYK

SEQ ID NO: 17533 - protein, 7 aa, synthetic construct
  REGION 1..7: note = Synthetic Construct
RSKRYAK

SEQ ID NO: 17534 - protein, 7 aa, synthetic construct
  REGION 1..7: note = Synthetic Construct
RSKRYDK

SEQ ID NO: 17535 - protein, 7 aa, synthetic construct
  REGION 1..7: note = Synthetic Construct
RSKRYEK

SEQ ID NO: 17536 - protein, 7 aa, synthetic construct
  REGION 1..7: note = Synthetic Construct
RSKRYFK

SEQ ID NO: 17537 - protein, 7 aa, synthetic construct
  REGION 1..7: note = Synthetic Construct
RSKRYGK

SEQ ID NO: 17538 - protein, 7 aa, synthetic construct
  REGION 1..7: note = Synthetic Construct
RSKRYHK

SEQ ID NO: 17539 - protein, 7 aa, synthetic construct
  REGION 1..7: note = Synthetic Construct
RSKRYIK

SEQ ID NO: 17540 - protein, 7 aa, synthetic construct
  REGION 1..7: note = Synthetic Construct
RSKRYLK

SEQ ID NO: 17541 - protein, 7 aa, synthetic construct
  REGION 1..7: note = Synthetic Construct
RSKRYNK

SEQ ID NO: 17542 - protein, 7 aa, synthetic construct
  REGION 1..7: note = Synthetic Construct
RSKRYQK

SEQ ID NO: 17543 - protein, 7 aa, synthetic construct
  REGION 1..7: note = Synthetic Construct
RSKRYRK

SEQ ID NO: 17544 - protein, 7 aa, synthetic construct
  REGION 1..7: note = Synthetic Construct
RSKRYSK

SEQ ID NO: 17545 - protein, 7 aa, synthetic construct
  REGION 1..7: note = Synthetic Construct
RSKRYTK

SEQ ID NO: 17546 - protein, 7 aa, synthetic construct
  REGION 1..7: note = Synthetic Construct
RSKRYYK

SEQ ID NO: 17547 - protein, 7 aa, synthetic construct
  REGION 1..7: note = Synthetic Construct
RSKSAAK

SEQ ID NO: 17548 - protein, 7 aa, synthetic construct
  REGION 1..7: note = Synthetic Construct
RSKSADK

SEQ ID NO: 17549 - protein, 7 aa, synthetic construct
  REGION 1..7: note = Synthetic Construct
RSKSAEK

SEQ ID NO: 17550 - protein, 7 aa, synthetic construct
  REGION 1..7: note = Synthetic Construct
RSKSAFK

SEQ ID NO: 17551 - protein, 7 aa, synthetic construct
  REGION 1..7: note = Synthetic Construct
RSKSAGK

SEQ ID NO: 17552 - protein, 7 aa, synthetic construct
  REGION 1..7: note = Synthetic Construct
RSKSAHK

SEQ ID NO: 17553 - protein, 7 aa, synthetic construct
  REGION 1..7: note = Synthetic Construct
RSKSAIK

SEQ ID NO: 17554 - protein, 7 aa, synthetic construct
  REGION 1..7: note = Synthetic Construct
RSKSALK

SEQ ID NO: 17555 - protein, 7 aa, synthetic construct
  REGION 1..7: note = Synthetic Construct
RSKSANK

SEQ ID NO: 17556 - protein, 7 aa, synthetic construct
  REGION 1..7: note = Synthetic Construct
RSKSAQK

SEQ ID NO: 17557 - protein, 7 aa, synthetic construct
  REGION 1..7: note = Synthetic Construct
RSKSARK

SEQ ID NO: 17558 - protein, 7 aa, synthetic construct
  REGION 1..7: note = Synthetic Construct
RSKSASK

SEQ ID NO: 17559 - protein, 7 aa, synthetic construct
  REGION 1..7: note = Synthetic Construct
RSKSATK

SEQ ID NO: 17560 - protein, 7 aa, synthetic construct
  REGION 1..7: note = Synthetic Construct
RSKSAYK

SEQ ID NO: 17561 - protein, 7 aa, synthetic construct
  REGION 1..7: note = Synthetic Construct
RSKSDAK

SEQ ID NO: 17562 - protein, 7 aa, synthetic construct
  REGION 1..7: note = Synthetic Construct
RSKSDDK

SEQ ID NO: 17563 - protein, 7 aa, synthetic construct
  REGION 1..7: note = Synthetic Construct
RSKSDEK

SEQ ID NO: 17564 - protein, 7 aa, synthetic construct
  REGION 1..7: note = Synthetic Construct
RSKSDFK

SEQ ID NO: 17565 - protein, 7 aa, synthetic construct
  REGION 1..7: note = Synthetic Construct
RSKSDGK

SEQ ID NO: 17566 - protein, 7 aa, synthetic construct
  REGION 1..7: note = Synthetic Construct
RSKSDHK

SEQ ID NO: 17567 - protein, 7 aa, synthetic construct
  REGION 1..7: note = Synthetic Construct
RSKSDIK

SEQ ID NO: 17568 - protein, 7 aa, synthetic construct
  REGION 1..7: note = Synthetic Construct
RSKSDLK

SEQ ID NO: 17569 - protein, 7 aa, synthetic construct
  REGION 1..7: note = Synthetic Construct
RSKSDNK

SEQ ID NO: 17570 - protein, 7 aa, synthetic construct
  REGION 1..7: note = Synthetic Construct
RSKSDQK

SEQ ID NO: 17571 - protein, 7 aa, synthetic construct
  REGION 1..7: note = Synthetic Construct
RSKSDRK

SEQ ID NO: 17572 - protein, 7 aa, synthetic construct
  REGION 1..7: note = Synthetic Construct
RSKSDSK

SEQ ID NO: 17573 - protein, 7 aa, synthetic construct
  REGION 1..7: note = Synthetic Construct
RSKSDTK

SEQ ID NO: 17574 - protein, 7 aa, synthetic construct
  REGION 1..7: note = Synthetic Construct
RSKSDYK

SEQ ID NO: 17575 - protein, 7 aa, synthetic construct
  REGION 1..7: note = Synthetic Construct
RSKSEAK

SEQ ID NO: 17576 - protein, 7 aa, synthetic construct
  REGION 1..7: note = Synthetic Construct
RSKSEDK

SEQ ID NO: 17577 - protein, 7 aa, synthetic construct
  REGION 1..7: note = Synthetic Construct
RSKSEEK

SEQ ID NO: 17578 - protein, 7 aa, synthetic construct
  REGION 1..7: note = Synthetic Construct
RSKSEFK

SEQ ID NO: 17579 - protein, 7 aa, synthetic construct
  REGION 1..7: note = Synthetic Construct
RSKSEGK

SEQ ID NO: 17580 - protein, 7 aa, synthetic construct
  REGION 1..7: note = Synthetic Construct
RSKSEHK

SEQ ID NO: 17581 - protein, 7 aa, synthetic construct
  REGION 1..7: note = Synthetic Construct
RSKSEIK

SEQ ID NO: 17582 - protein, 7 aa, synthetic construct
  REGION 1..7: note = Synthetic Construct
RSKSELK

SEQ ID NO: 17583 - protein, 7 aa, synthetic construct
  REGION 1..7: note = Synthetic Construct
RSKSENK

SEQ ID NO: 17584 - protein, 7 aa, synthetic construct
  REGION 1..7: note = Synthetic Construct
RSKSEQK

SEQ ID NO: 17585 - protein, 7 aa, synthetic construct
  REGION 1..7: note = Synthetic Construct
RSKSERK

SEQ ID NO: 17586 - protein, 7 aa, synthetic construct
  REGION 1..7: note = Synthetic Construct
RSKSESK

SEQ ID NO: 17587 - protein, 7 aa, synthetic construct
  REGION 1..7: note = Synthetic Construct
RSKSETK

SEQ ID NO: 17588 - protein, 7 aa, synthetic construct
  REGION 1..7: note = Synthetic Construct
RSKSEYK

SEQ ID NO: 17589 - protein, 7 aa, synthetic construct
  REGION 1..7: note = Synthetic Construct
RSKSFAK

SEQ ID NO: 17590 - protein, 7 aa, synthetic construct
  REGION 1..7: note = Synthetic Construct
RSKSFDK

SEQ ID NO: 17591 - protein, 7 aa, synthetic construct
  REGION 1..7: note = Synthetic Construct
RSKSFEK

SEQ ID NO: 17592 - protein, 7 aa, synthetic construct
  REGION 1..7: note = Synthetic Construct
RSKSFFK

SEQ ID NO: 17593 - protein, 7 aa, synthetic construct
  REGION 1..7: note = Synthetic Construct
RSKSFGK

SEQ ID NO: 17594 - protein, 7 aa, synthetic construct
  REGION 1..7: note = Synthetic Construct
RSKSFHK

SEQ ID NO: 17595 - protein, 7 aa, synthetic construct
  REGION 1..7: note = Synthetic Construct
RSKSFIK

SEQ ID NO: 17596 - protein, 7 aa, synthetic construct
  REGION 1..7: note = Synthetic Construct
RSKSFLK

SEQ ID NO: 17597 - protein, 7 aa, synthetic construct
  REGION 1..7: note = Synthetic Construct
RSKSFNK

SEQ ID NO: 17598 - protein, 7 aa, synthetic construct
  REGION 1..7: note = Synthetic Construct
RSKSFQK

SEQ ID NO: 17599 - protein, 7 aa, synthetic construct
  REGION 1..7: note = Synthetic Construct
RSKSFRK

SEQ ID NO: 17600 - protein, 7 aa, synthetic construct
  REGION 1..7: note = Synthetic Construct
RSKSFSK

SEQ ID NO: 17601 - protein, 7 aa, synthetic construct
  REGION 1..7: note = Synthetic Construct
RSKSFTK

SEQ ID NO: 17602 - protein, 7 aa, synthetic construct
  REGION 1..7: note = Synthetic Construct
RSKSFYK

SEQ ID NO: 17603 - protein, 7 aa, synthetic construct
  REGION 1..7: note = Synthetic Construct
RSKSGAK

SEQ ID NO: 17604 - protein, 7 aa, synthetic construct
  REGION 1..7: note = Synthetic Construct
RSKSGDK

SEQ ID NO: 17605 - protein, 7 aa, synthetic construct
  REGION 1..7: note = Synthetic Construct
RSKSGEK

SEQ ID NO: 17606 - protein, 7 aa, synthetic construct
  REGION 1..7: note = Synthetic Construct
RSKSGFK

SEQ ID NO: 17607 - protein, 7 aa, synthetic construct
  REGION 1..7: note = Synthetic Construct
RSKSGGK

SEQ ID NO: 17608 - protein, 7 aa, synthetic construct
  REGION 1..7: note = Synthetic Construct
RSKSGHK

SEQ ID NO: 17609 - protein, 7 aa, synthetic construct
  REGION 1..7: note = Synthetic Construct
RSKSGIK

SEQ ID NO: 17610 - protein, 7 aa, synthetic construct
  REGION 1..7: note = Synthetic Construct
RSKSGLK

SEQ ID NO: 17611 - protein, 7 aa, synthetic construct
  REGION 1..7: note = Synthetic Construct
RSKSGNK

SEQ ID NO: 17612 - protein, 7 aa, synthetic construct
  REGION 1..7: note = Synthetic Construct
RSKSGQK

SEQ ID NO: 17613 - protein, 7 aa, synthetic construct
  REGION 1..7: note = Synthetic Construct
RSKSGRK

SEQ ID NO: 17614 - protein, 7 aa, synthetic construct
  REGION 1..7: note = Synthetic Construct
RSKSGSK

SEQ ID NO: 17615 - protein, 7 aa, synthetic construct
  REGION 1..7: note = Synthetic Construct
RSKSGTK

SEQ ID NO: 17616 - protein, 7 aa, synthetic construct
  REGION 1..7: note = Synthetic Construct
RSKSGYK

SEQ ID NO: 17617 - protein, 7 aa, synthetic construct
  REGION 1..7: note = Synthetic Construct
RSKSHAK

SEQ ID NO: 17618 - protein, 7 aa, synthetic construct
  REGION 1..7: note = Synthetic Construct
RSKSHDK

SEQ ID NO: 17619 - protein, 7 aa, synthetic construct
  REGION 1..7: note = Synthetic Construct
RSKSHEK

SEQ ID NO: 17620 - protein, 7 aa, synthetic construct
  REGION 1..7: note = Synthetic Construct
RSKSHFK

SEQ ID NO: 17621 - protein, 7 aa, synthetic construct
  REGION 1..7: note = Synthetic Construct
RSKSHGK

SEQ ID NO: 17622 - protein, 7 aa, synthetic construct
  REGION 1..7: note = Synthetic Construct
RSKSHHK

SEQ ID NO: 17623 - protein, 7 aa, synthetic construct
  REGION 1..7: note = Synthetic Construct
RSKSHIK

SEQ ID NO: 17624 - protein, 7 aa, synthetic construct
  REGION 1..7: note = Synthetic Construct
RSKSHLK

SEQ ID NO: 17625 - protein, 7 aa, synthetic construct
  REGION 1..7: note = Synthetic Construct
RSKSHNK

SEQ ID NO: 17626 - protein, 7 aa, synthetic construct
  REGION 1..7: note = Synthetic Construct
RSKSHQK

SEQ ID NO: 17627 - protein, 7 aa, synthetic construct
  REGION 1..7: note = Synthetic Construct
RSKSHRK

SEQ ID NO: 17628 - protein, 7 aa, synthetic construct
  REGION 1..7: note = Synthetic Construct
RSKSHSK

SEQ ID NO: 17629 - protein, 7 aa, synthetic construct
  REGION 1..7: note = Synthetic Construct
RSKSHTK

SEQ ID NO: 17630 - protein, 7 aa, synthetic construct
  REGION 1..7: note = Synthetic Construct
RSKSHYK

SEQ ID NO: 17631 - protein, 7 aa, synthetic construct
  REGION 1..7: note = Synthetic Construct
RSKSIAK

SEQ ID NO: 17632 - protein, 7 aa, synthetic construct
  REGION 1..7: note = Synthetic Construct
RSKSIDK

SEQ ID NO: 17633 - protein, 7 aa, synthetic construct
  REGION 1..7: note = Synthetic Construct
RSKSIEK

SEQ ID NO: 17634 - protein, 7 aa, synthetic construct
  REGION 1..7: note = Synthetic Construct
RSKSIFK

SEQ ID NO: 17635 - protein, 7 aa, synthetic construct
  REGION 1..7: note = Synthetic Construct
RSKSIGK

SEQ ID NO: 17636 - protein, 7 aa, synthetic construct
  REGION 1..7: note = Synthetic Construct
RSKSIHK

SEQ ID NO: 17637 - protein, 7 aa, synthetic construct
  REGION 1..7: note = Synthetic Construct
RSKSIIK

SEQ ID NO: 17638 - protein, 7 aa, synthetic construct
  REGION 1..7: note = Synthetic Construct
RSKSILK

SEQ ID NO: 17639 - protein, 7 aa, synthetic construct
  REGION 1..7: note = Synthetic Construct
RSKSINK

SEQ ID NO: 17640 - protein, 7 aa, synthetic construct
  REGION 1..7: note = Synthetic Construct
RSKSIQK

SEQ ID NO: 17641 - protein, 7 aa, synthetic construct
  REGION 1..7: note = Synthetic Construct
RSKSIRK

SEQ ID NO: 17642 - protein, 7 aa, synthetic construct
  REGION 1..7: note = Synthetic Construct
RSKSISK

SEQ ID NO: 17643 - protein, 7 aa, synthetic construct
  REGION 1..7: note = Synthetic Construct
RSKSITK

SEQ ID NO: 17644 - protein, 7 aa, synthetic construct
  REGION 1..7: note = Synthetic Construct
RSKSIYK

SEQ ID NO: 17645 - protein, 7 aa, synthetic construct
  REGION 1..7: note = Synthetic Construct
RSKSLAK

SEQ ID NO: 17646 - protein, 7 aa, synthetic construct
  REGION 1..7: note = Synthetic Construct
RSKSLDK

SEQ ID NO: 17647 - protein, 7 aa, synthetic construct
  REGION 1..7: note = Synthetic Construct
RSKSLEK

SEQ ID NO: 17648 - protein, 7 aa, synthetic construct
  REGION 1..7: note = Synthetic Construct
RSKSLFK

SEQ ID NO: 17649 - protein, 7 aa, synthetic construct
  REGION 1..7: note = Synthetic Construct
RSKSLGK

SEQ ID NO: 17650 - protein, 7 aa, synthetic construct
  REGION 1..7: note = Synthetic Construct
RSKSLHK

SEQ ID NO: 17651 - protein, 7 aa, synthetic construct
  REGION 1..7: note = Synthetic Construct
RSKSLIK

SEQ ID NO: 17652 - protein, 7 aa, synthetic construct
  REGION 1..7: note = Synthetic Construct
RSKSLLK

SEQ ID NO: 17653 - protein, 7 aa, synthetic construct
  REGION 1..7: note = Synthetic Construct
RSKSLNK

SEQ ID NO: 17654 - protein, 7 aa, synthetic construct
  REGION 1..7: note = Synthetic Construct
RSKSLQK

SEQ ID NO: 17655 - protein, 7 aa, synthetic construct
  REGION 1..7: note = Synthetic Construct
RSKSLRK

SEQ ID NO: 17656 - protein, 7 aa, synthetic construct
  REGION 1..7: note = Synthetic Construct
RSKSLSK

SEQ ID NO: 17657 - protein, 7 aa, synthetic construct
  REGION 1..7: note = Synthetic Construct
RSKSLTK

SEQ ID NO: 17658 - protein, 7 aa, synthetic construct
  REGION 1..7: note = Synthetic Construct
RSKSLYK

SEQ ID NO: 17659 - protein, 7 aa, synthetic construct
  REGION 1..7: note = Synthetic Construct
RSKSNAK

SEQ ID NO: 17660 - protein, 7 aa, synthetic construct
  REGION 1..7: note = Synthetic Construct
RSKSNDK

SEQ ID NO: 17661 - protein, 7 aa, synthetic construct
  REGION 1..7: note = Synthetic Construct
RSKSNEK

SEQ ID NO: 17662 - protein, 7 aa, synthetic construct
  REGION 1..7: note = Synthetic Construct
RSKSNFK

SEQ ID NO: 17663 - protein, 7 aa, synthetic construct
  REGION 1..7: note = Synthetic Construct
RSKSNGK

SEQ ID NO: 17664 - protein, 7 aa, synthetic construct
  REGION 1..7: note = Synthetic Construct
RSKSNHK

SEQ ID NO: 17665 - protein, 7 aa, synthetic construct
  REGION 1..7: note = Synthetic Construct
RSKSNIK

SEQ ID NO: 17666 - protein, 7 aa, synthetic construct
  REGION 1..7: note = Synthetic Construct
RSKSNLK

SEQ ID NO: 17667 - protein, 7 aa, synthetic construct
  REGION 1..7: note = Synthetic Construct
RSKSNNK

SEQ ID NO: 17668 - protein, 7 aa, synthetic construct
  REGION 1..7: note = Synthetic Construct
RSKSNQK

SEQ ID NO: 17669 - protein, 7 aa, synthetic construct
  REGION 1..7: note = Synthetic Construct
RSKSNRK

SEQ ID NO: 17670 - protein, 7 aa, synthetic construct
  REGION 1..7: note = Synthetic Construct
RSKSNSK

SEQ ID NO: 17671 - protein, 7 aa, synthetic construct
  REGION 1..7: note = Synthetic Construct
RSKSNTK

SEQ ID NO: 17672 - protein, 7 aa, synthetic construct
  REGION 1..7: note = Synthetic Construct
RSKSNYK

SEQ ID NO: 17673 - protein, 7 aa, synthetic construct
  REGION 1..7: note = Synthetic Construct
RSKSQAK

SEQ ID NO: 17674 - protein, 7 aa, synthetic construct
  REGION 1..7: note = Synthetic Construct
RSKSQDK

SEQ ID NO: 17675 - protein, 7 aa, synthetic construct
  REGION 1..7: note = Synthetic Construct
RSKSQEK

SEQ ID NO: 17676 - protein, 7 aa, synthetic construct
  REGION 1..7: note = Synthetic Construct
RSKSQFK

SEQ ID NO: 17677 - protein, 7 aa, synthetic construct
  REGION 1..7: note = Synthetic Construct
RSKSQGK

SEQ ID NO: 17678 - protein, 7 aa, synthetic construct
  REGION 1..7: note = Synthetic Construct
RSKSQHK

SEQ ID NO: 17679 - protein, 7 aa, synthetic construct
  REGION 1..7: note = Synthetic Construct
RSKSQIK

SEQ ID NO: 17680 - protein, 7 aa, synthetic construct
  REGION 1..7: note = Synthetic Construct
RSKSQLK

SEQ ID NO: 17681 - protein, 7 aa, synthetic construct
  REGION 1..7: note = Synthetic Construct
RSKSQNK

SEQ ID NO: 17682 - protein, 7 aa, synthetic construct
  REGION 1..7: note = Synthetic Construct
RSKSQQK

SEQ ID NO: 17683 - protein, 7 aa, synthetic construct
  REGION 1..7: note = Synthetic Construct
RSKSQRK

SEQ ID NO: 17684 - protein, 7 aa, synthetic construct
  REGION 1..7: note = Synthetic Construct
RSKSQSK

SEQ ID NO: 17685 - protein, 7 aa, synthetic construct
  REGION 1..7: note = Synthetic Construct
RSKSQTK

SEQ ID NO: 17686 - protein, 7 aa, synthetic construct
  REGION 1..7: note = Synthetic Construct
RSKSQYK

SEQ ID NO: 17687 - protein, 7 aa, synthetic construct
  REGION 1..7: note = Synthetic Construct
RSKSRAK

SEQ ID NO: 17688 - protein, 7 aa, synthetic construct
  REGION 1..7: note = Synthetic Construct
RSKSRDK

SEQ ID NO: 17689 - protein, 7 aa, synthetic construct
  REGION 1..7: note = Synthetic Construct
RSKSREK

SEQ ID NO: 17690 - protein, 7 aa, synthetic construct
  REGION 1..7: note = Synthetic Construct
RSKSRFK

SEQ ID NO: 17691 - protein, 7 aa, synthetic construct
  REGION 1..7: note = Synthetic Construct
RSKSRGK

SEQ ID NO: 17692 - protein, 7 aa, synthetic construct
  REGION 1..7: note = Synthetic Construct
RSKSRHK

SEQ ID NO: 17693 - protein, 7 aa, synthetic construct
  REGION 1..7: note = Synthetic Construct
RSKSRIK

SEQ ID NO: 17694 - protein, 7 aa, synthetic construct
  REGION 1..7: note = Synthetic Construct
RSKSRLK

SEQ ID NO: 17695 - protein, 7 aa, synthetic construct
  REGION 1..7: note = Synthetic Construct
RSKSRNK

SEQ ID NO: 17696 - protein, 7 aa, synthetic construct
  REGION 1..7: note = Synthetic Construct
RSKSRQK

SEQ ID NO: 17697 - protein, 7 aa, synthetic construct
  REGION 1..7: note = Synthetic Construct
RSKSRRK

SEQ ID NO: 17698 - protein, 7 aa, synthetic construct
  REGION 1..7: note = Synthetic Construct
RSKSRSK

SEQ ID NO: 17699 - protein, 7 aa, synthetic construct
  REGION 1..7: note = Synthetic Construct
RSKSRTK

SEQ ID NO: 17700 - protein, 7 aa, synthetic construct
  REGION 1..7: note = Synthetic Construct
RSKSRYK

SEQ ID NO: 17701 - protein, 7 aa, synthetic construct
  REGION 1..7: note = Synthetic Construct
RSKSSAK

SEQ ID NO: 17702 - protein, 7 aa, synthetic construct
  REGION 1..7: note = Synthetic Construct
RSKSSDK

SEQ ID NO: 17703 - protein, 7 aa, synthetic construct
  REGION 1..7: note = Synthetic Construct
RSKSSEK

SEQ ID NO: 17704 - protein, 7 aa, synthetic construct
  REGION 1..7: note = Synthetic Construct
RSKSSFK

SEQ ID NO: 17705 - protein, 7 aa, synthetic construct
  REGION 1..7: note = Synthetic Construct
RSKSSGK

SEQ ID NO: 17706 - protein, 7 aa, synthetic construct
  REGION 1..7: note = Synthetic Construct
RSKSSHK

SEQ ID NO: 17707 - protein, 7 aa, synthetic construct
  REGION 1..7: note = Synthetic Construct
RSKSSIK

SEQ ID NO: 17708 - protein, 7 aa, synthetic construct
  REGION 1..7: note = Synthetic Construct
RSKSSLK

SEQ ID NO: 17709 - protein, 7 aa, synthetic construct
  REGION 1..7: note = Synthetic Construct
RSKSSNK

SEQ ID NO: 17710 - protein, 7 aa, synthetic construct
  REGION 1..7: note = Synthetic Construct
RSKSSQK

SEQ ID NO: 17711 - protein, 7 aa, synthetic construct
  REGION 1..7: note = Synthetic Construct
RSKSSRK

SEQ ID NO: 17712 - protein, 7 aa, synthetic construct
  REGION 1..7: note = Synthetic Construct
RSKSSSK

SEQ ID NO: 17713 - protein, 7 aa, synthetic construct
  REGION 1..7: note = Synthetic Construct
RSKSSTK

SEQ ID NO: 17714 - protein, 7 aa, synthetic construct
  REGION 1..7: note = Synthetic Construct
RSKSSYK

SEQ ID NO: 17715 - protein, 7 aa, synthetic construct
  REGION 1..7: note = Synthetic Construct
RSKSTAK

SEQ ID NO: 17716 - protein, 7 aa, synthetic construct
  REGION 1..7: note = Synthetic Construct
RSKSTDK

SEQ ID NO: 17717 - protein, 7 aa, synthetic construct
  REGION 1..7: note = Synthetic Construct
RSKSTEK

SEQ ID NO: 17718 - protein, 7 aa, synthetic construct
  REGION 1..7: note = Synthetic Construct
RSKSTFK

SEQ ID NO: 17719 - protein, 7 aa, synthetic construct
  REGION 1..7: note = Synthetic Construct
RSKSTGK

SEQ ID NO: 17720 - protein, 7 aa, synthetic construct
  REGION 1..7: note = Synthetic Construct
RSKSTHK

SEQ ID NO: 17721 - protein, 7 aa, synthetic construct
  REGION 1..7: note = Synthetic Construct
RSKSTIK

SEQ ID NO: 17722 - protein, 7 aa, synthetic construct
  REGION 1..7: note = Synthetic Construct
RSKSTLK

SEQ ID NO: 17723 - protein, 7 aa, synthetic construct
  REGION 1..7: note = Synthetic Construct
RSKSTNK

SEQ ID NO: 17724 - protein, 7 aa, synthetic construct
  REGION 1..7: note = Synthetic Construct
RSKSTQK

SEQ ID NO: 17725 - protein, 7 aa, synthetic construct
  REGION 1..7: note = Synthetic Construct
RSKSTRK

SEQ ID NO: 17726 - protein, 7 aa, synthetic construct
  REGION 1..7: note = Synthetic Construct
RSKSTSK

SEQ ID NO: 17727 - protein, 7 aa, synthetic construct
  REGION 1..7: note = Synthetic Construct
RSKSTTK

SEQ ID NO: 17728 - protein, 7 aa, synthetic construct
  REGION 1..7: note = Synthetic Construct
RSKSTYK

SEQ ID NO: 17729 - protein, 7 aa, synthetic construct
  REGION 1..7: note = Synthetic Construct
RSKSYAK

SEQ ID NO: 17730 - protein, 7 aa, synthetic construct
  REGION 1..7: note = Synthetic Construct
RSKSYDK

SEQ ID NO: 17731 - protein, 7 aa, synthetic construct
  REGION 1..7: note = Synthetic Construct
RSKSYEK

SEQ ID NO: 17732 - protein, 7 aa, synthetic construct
  REGION 1..7: note = Synthetic Construct
RSKSYFK

SEQ ID NO: 17733 - protein, 7 aa, synthetic construct
  REGION 1..7: note = Synthetic Construct
RSKSYGK

SEQ ID NO: 17734 - protein, 7 aa, synthetic construct
  REGION 1..7: note = Synthetic Construct
RSKSYHK

SEQ ID NO: 17735 - protein, 7 aa, synthetic construct
  REGION 1..7: note = Synthetic Construct
RSKSYIK

SEQ ID NO: 17736 - protein, 7 aa, synthetic construct
  REGION 1..7: note = Synthetic Construct
RSKSYLK

SEQ ID NO: 17737 - protein, 7 aa, synthetic construct
  REGION 1..7: note = Synthetic Construct
RSKSYNK

SEQ ID NO: 17738 - protein, 7 aa, synthetic construct
  REGION 1..7: note = Synthetic Construct
RSKSYQK

SEQ ID NO: 17739 - protein, 7 aa, synthetic construct
  REGION 1..7: note = Synthetic Construct
RSKSYRK

SEQ ID NO: 17740 - protein, 7 aa, synthetic construct
  REGION 1..7: note = Synthetic Construct
RSKSYSK

SEQ ID NO: 17741 - protein, 7 aa, synthetic construct
  REGION 1..7: note = Synthetic Construct
RSKSYTK

SEQ ID NO: 17742 - protein, 7 aa, synthetic construct
  REGION 1..7: note = Synthetic Construct
RSKSYYK

SEQ ID NO: 17743 - protein, 7 aa, synthetic construct
  REGION 1..7: note = Synthetic Construct
RSKTAAK

SEQ ID NO: 17744 - protein, 7 aa, synthetic construct
  REGION 1..7: note = Synthetic Construct
RSKTADK

SEQ ID NO: 17745 - protein, 7 aa, synthetic construct
  REGION 1..7: note = Synthetic Construct
RSKTAEK

SEQ ID NO: 17746 - protein, 7 aa, synthetic construct
  REGION 1..7: note = Synthetic Construct
RSKTAFK

SEQ ID NO: 17747 - protein, 7 aa, synthetic construct
  REGION 1..7: note = Synthetic Construct
RSKTAGK

SEQ ID NO: 17748 - protein, 7 aa, synthetic construct
  REGION 1..7: note = Synthetic Construct
RSKTAHK

SEQ ID NO: 17749 - protein, 7 aa, synthetic construct
  REGION 1..7: note = Synthetic Construct
RSKTAIK

SEQ ID NO: 17750 - protein, 7 aa, synthetic construct
  REGION 1..7: note = Synthetic Construct
RSKTALK

SEQ ID NO: 17751 - protein, 7 aa, synthetic construct
  REGION 1..7: note = Synthetic Construct
RSKTANK

SEQ ID NO: 17752 - protein, 7 aa, synthetic construct
  REGION 1..7: note = Synthetic Construct
RSKTAQK

SEQ ID NO: 17753 - protein, 7 aa, synthetic construct
  REGION 1..7: note = Synthetic Construct
RSKTARK

SEQ ID NO: 17754 - protein, 7 aa, synthetic construct
  REGION 1..7: note = Synthetic Construct
RSKTASK

SEQ ID NO: 17755 - protein, 7 aa, synthetic construct
  REGION 1..7: note = Synthetic Construct
RSKTATK

SEQ ID NO: 17756 - protein, 7 aa, synthetic construct
  REGION 1..7: note = Synthetic Construct
RSKTAYK

SEQ ID NO: 17757 - protein, 7 aa, synthetic construct
  REGION 1..7: note = Synthetic Construct
RSKTDAK

SEQ ID NO: 17758 - protein, 7 aa, synthetic construct
  REGION 1..7: note = Synthetic Construct
RSKTDDK

SEQ ID NO: 17759 - protein, 7 aa, synthetic construct
  REGION 1..7: note = Synthetic Construct
RSKTDEK

SEQ ID NO: 17760 - protein, 7 aa, synthetic construct
  REGION 1..7: note = Synthetic Construct
RSKTDFK

SEQ ID NO: 17761 - protein, 7 aa, synthetic construct
  REGION 1..7: note = Synthetic Construct
RSKTDGK

SEQ ID NO: 17762 - protein, 7 aa, synthetic construct
  REGION 1..7: note = Synthetic Construct
RSKTDHK

SEQ ID NO: 17763 - protein, 7 aa, synthetic construct
  REGION 1..7: note = Synthetic Construct
RSKTDIK

SEQ ID NO: 17764 - protein, 7 aa, synthetic construct
  REGION 1..7: note = Synthetic Construct
RSKTDLK

SEQ ID NO: 17765 - protein, 7 aa, synthetic construct
  REGION 1..7: note = Synthetic Construct
RSKTDNK

SEQ ID NO: 17766 - protein, 7 aa, synthetic construct
  REGION 1..7: note = Synthetic Construct
RSKTDQK

SEQ ID NO: 17767 - protein, 7 aa, synthetic construct
  REGION 1..7: note = Synthetic Construct
RSKTDRK

SEQ ID NO: 17768 - protein, 7 aa, synthetic construct
  REGION 1..7: note = Synthetic Construct
RSKTDSK

SEQ ID NO: 17769 - protein, 7 aa, synthetic construct
  REGION 1..7: note = Synthetic Construct
RSKTDTK

SEQ ID NO: 17770 - protein, 7 aa, synthetic construct
  REGION 1..7: note = Synthetic Construct
RSKTDYK

SEQ ID NO: 17771 - protein, 7 aa, synthetic construct
  REGION 1..7: note = Synthetic Construct
RSKTEAK

SEQ ID NO: 17772 - protein, 7 aa, synthetic construct
  REGION 1..7: note = Synthetic Construct
RSKTEDK

SEQ ID NO: 17773 - protein, 7 aa, synthetic construct
  REGION 1..7: note = Synthetic Construct
RSKTEEK

SEQ ID NO: 17774 - protein, 7 aa, synthetic construct
  REGION 1..7: note = Synthetic Construct
RSKTEFK

SEQ ID NO: 17775 - protein, 7 aa, synthetic construct
  REGION 1..7: note = Synthetic Construct
RSKTEGK

SEQ ID NO: 17776 - protein, 7 aa, synthetic construct
  REGION 1..7: note = Synthetic Construct
RSKTEHK

SEQ ID NO: 17777 - protein, 7 aa, synthetic construct
  REGION 1..7: note = Synthetic Construct
RSKTEIK

SEQ ID NO: 17778 - protein, 7 aa, synthetic construct
  REGION 1..7: note = Synthetic Construct
RSKTELK

SEQ ID NO: 17779 - protein, 7 aa, synthetic construct
  REGION 1..7: note = Synthetic Construct
RSKTENK

SEQ ID NO: 17780 - protein, 7 aa, synthetic construct
  REGION 1..7: note = Synthetic Construct
RSKTEQK

SEQ ID NO: 17781 - protein, 7 aa, synthetic construct
  REGION 1..7: note = Synthetic Construct
RSKTERK

SEQ ID NO: 17782 - protein, 7 aa, synthetic construct
  REGION 1..7: note = Synthetic Construct
RSKTESK

SEQ ID NO: 17783 - protein, 7 aa, synthetic construct
  REGION 1..7: note = Synthetic Construct
RSKTETK

SEQ ID NO: 17784 - protein, 7 aa, synthetic construct
  REGION 1..7: note = Synthetic Construct
RSKTEYK

SEQ ID NO: 17785 - protein, 7 aa, synthetic construct
  REGION 1..7: note = Synthetic Construct
RSKTFAK

SEQ ID NO: 17786 - protein, 7 aa, synthetic construct
  REGION 1..7: note = Synthetic Construct
RSKTFDK

SEQ ID NO: 17787 - protein, 7 aa, synthetic construct
  REGION 1..7: note = Synthetic Construct
RSKTFEK

SEQ ID NO: 17788 - protein, 7 aa, synthetic construct
  REGION 1..7: note = Synthetic Construct
RSKTFFK

SEQ ID NO: 17789 - protein, 7 aa, synthetic construct
  REGION 1..7: note = Synthetic Construct
RSKTFGK

SEQ ID NO: 17790 - protein, 7 aa, synthetic construct
  REGION 1..7: note = Synthetic Construct
RSKTFHK

SEQ ID NO: 17791 - protein, 7 aa, synthetic construct
  REGION 1..7: note = Synthetic Construct
RSKTFIK

SEQ ID NO: 17792 - protein, 7 aa, synthetic construct
  REGION 1..7: note = Synthetic Construct
RSKTFLK

SEQ ID NO: 17793 - protein, 7 aa, synthetic construct
  REGION 1..7: note = Synthetic Construct
RSKTFNK

SEQ ID NO: 17794 - protein, 7 aa, synthetic construct
  REGION 1..7: note = Synthetic Construct
RSKTFQK

SEQ ID NO: 17795 - protein, 7 aa, synthetic construct
  REGION 1..7: note = Synthetic Construct
RSKTFRK

SEQ ID NO: 17796 - protein, 7 aa, synthetic construct
  REGION 1..7: note = Synthetic Construct
RSKTFSK

SEQ ID NO: 17797 - protein, 7 aa, synthetic construct
  REGION 1..7: note = Synthetic Construct
RSKTFTK

SEQ ID NO: 17798 - protein, 7 aa, synthetic construct
  REGION 1..7: note = Synthetic Construct
RSKTFYK

SEQ ID NO: 17799 - protein, 7 aa, synthetic construct
  REGION 1..7: note = Synthetic Construct
RSKTGAK

SEQ ID NO: 17800 - protein, 7 aa, synthetic construct
  REGION 1..7: note = Synthetic Construct
RSKTGDK

SEQ ID NO: 17801 - protein, 7 aa, synthetic construct
  REGION 1..7: note = Synthetic Construct
RSKTGEK

SEQ ID NO: 17802 - protein, 7 aa, synthetic construct
  REGION 1..7: note = Synthetic Construct
RSKTGFK

SEQ ID NO: 17803 - protein, 7 aa, synthetic construct
  REGION 1..7: note = Synthetic Construct
RSKTGGK

SEQ ID NO: 17804 - protein, 7 aa, synthetic construct
  REGION 1..7: note = Synthetic Construct
RSKTGHK

SEQ ID NO: 17805 - protein, 7 aa, synthetic construct
  REGION 1..7: note = Synthetic Construct
RSKTGIK

SEQ ID NO: 17806 - protein, 7 aa, synthetic construct
  REGION 1..7: note = Synthetic Construct
RSKTGLK

SEQ ID NO: 17807 - protein, 7 aa, synthetic construct
  REGION 1..7: note = Synthetic Construct
RSKTGNK

SEQ ID NO: 17808 - protein, 7 aa, synthetic construct
  REGION 1..7: note = Synthetic Construct
RSKTGQK

SEQ ID NO: 17809 - protein, 7 aa, synthetic construct
  REGION 1..7: note = Synthetic Construct
RSKTGRK

SEQ ID NO: 17810 - protein, 7 aa, synthetic construct
  REGION 1..7: note = Synthetic Construct
RSKTGSK

SEQ ID NO: 17811 - protein, 7 aa, synthetic construct
  REGION 1..7: note = Synthetic Construct
RSKTGTK

SEQ ID NO: 17812 - protein, 7 aa, synthetic construct
  REGION 1..7: note = Synthetic Construct
RSKTGYK

SEQ ID NO: 17813 - protein, 7 aa, synthetic construct
  REGION 1..7: note = Synthetic Construct
RSKTHAK

SEQ ID NO: 17814 - protein, 7 aa, synthetic construct
  REGION 1..7: note = Synthetic Construct
RSKTHDK

SEQ ID NO: 17815 - protein, 7 aa, synthetic construct
  REGION 1..7: note = Synthetic Construct
RSKTHEK

SEQ ID NO: 17816 - protein, 7 aa, synthetic construct
  REGION 1..7: note = Synthetic Construct
RSKTHFK

SEQ ID NO: 17817 - protein, 7 aa, synthetic construct
  REGION 1..7: note = Synthetic Construct
RSKTHGK

SEQ ID NO: 17818 - protein, 7 aa, synthetic construct
  REGION 1..7: note = Synthetic Construct
RSKTHHK

SEQ ID NO: 17819 - protein, 7 aa, synthetic construct
  REGION 1..7: note = Synthetic Construct
RSKTHIK

SEQ ID NO: 17820 - protein, 7 aa, synthetic construct
  REGION 1..7: note = Synthetic Construct
RSKTHLK

SEQ ID NO: 17821 - protein, 7 aa, synthetic construct
  REGION 1..7: note = Synthetic Construct
RSKTHNK

SEQ ID NO: 17822 - protein, 7 aa, synthetic construct
  REGION 1..7: note = Synthetic Construct
RSKTHQK

SEQ ID NO: 17823 - protein, 7 aa, synthetic construct
  REGION 1..7: note = Synthetic Construct
RSKTHRK

SEQ ID NO: 17824 - protein, 7 aa, synthetic construct
  REGION 1..7: note = Synthetic Construct
RSKTHSK

SEQ ID NO: 17825 - protein, 7 aa, synthetic construct
  REGION 1..7: note = Synthetic Construct
RSKTHTK

SEQ ID NO: 17826 - protein, 7 aa, synthetic construct
  REGION 1..7: note = Synthetic Construct
RSKTHYK

SEQ ID NO: 17827 - protein, 7 aa, synthetic construct
  REGION 1..7: note = Synthetic Construct
RSKTIAK

SEQ ID NO: 17828 - protein, 7 aa, synthetic construct
  REGION 1..7: note = Synthetic Construct
RSKTIDK

SEQ ID NO: 17829 - protein, 7 aa, synthetic construct
  REGION 1..7: note = Synthetic Construct
RSKTIEK

SEQ ID NO: 17830 - protein, 7 aa, synthetic construct
  REGION 1..7: note = Synthetic Construct
RSKTIFK

SEQ ID NO: 17831 - protein, 7 aa, synthetic construct
  REGION 1..7: note = Synthetic Construct
RSKTIGK

SEQ ID NO: 17832 - protein, 7 aa, synthetic construct
  REGION 1..7: note = Synthetic Construct
RSKTIHK

SEQ ID NO: 17833 - protein, 7 aa, synthetic construct
  REGION 1..7: note = Synthetic Construct
RSKTIIK

SEQ ID NO: 17834 - protein, 7 aa, synthetic construct
  REGION 1..7: note = Synthetic Construct
RSKTILK

SEQ ID NO: 17835 - protein, 7 aa, synthetic construct
  REGION 1..7: note = Synthetic Construct
RSKTINK

SEQ ID NO: 17836 - protein, 7 aa, synthetic construct
  REGION 1..7: note = Synthetic Construct
RSKTIQK

SEQ ID NO: 17837 - protein, 7 aa, synthetic construct
  REGION 1..7: note = Synthetic Construct
RSKTIRK

SEQ ID NO: 17838 - protein, 7 aa, synthetic construct
  REGION 1..7: note = Synthetic Construct
RSKTISK

SEQ ID NO: 17839 - protein, 7 aa, synthetic construct
  REGION 1..7: note = Synthetic Construct
RSKTITK

SEQ ID NO: 17840 - protein, 7 aa, synthetic construct
  REGION 1..7: note = Synthetic Construct
RSKTIYK

SEQ ID NO: 17841 - protein, 7 aa, synthetic construct
  REGION 1..7: note = Synthetic Construct
RSKTLAK

SEQ ID NO: 17842 - protein, 7 aa, synthetic construct
  REGION 1..7: note = Synthetic Construct
RSKTLDK

SEQ ID NO: 17843 - protein, 7 aa, synthetic construct
  REGION 1..7: note = Synthetic Construct
RSKTLEK

SEQ ID NO: 17844 - protein, 7 aa, synthetic construct
  REGION 1..7: note = Synthetic Construct
RSKTLFK

SEQ ID NO: 17845 - protein, 7 aa, synthetic construct
  REGION 1..7: note = Synthetic Construct
RSKTLGK

SEQ ID NO: 17846 - protein, 7 aa, synthetic construct
  REGION 1..7: note = Synthetic Construct
RSKTLHK

SEQ ID NO: 17847 - protein, 7 aa, synthetic construct
  REGION 1..7: note = Synthetic Construct
RSKTLIK

SEQ ID NO: 17848 - protein, 7 aa, synthetic construct
  REGION 1..7: note = Synthetic Construct
RSKTLLK

SEQ ID NO: 17849 - protein, 7 aa, synthetic construct
  REGION 1..7: note = Synthetic Construct
RSKTLNK

SEQ ID NO: 17850 - protein, 7 aa, synthetic construct
  REGION 1..7: note = Synthetic Construct
RSKTLQK

SEQ ID NO: 17851 - protein, 7 aa, synthetic construct
  REGION 1..7: note = Synthetic Construct
RSKTLRK

SEQ ID NO: 17852 - protein, 7 aa, synthetic construct
  REGION 1..7: note = Synthetic Construct
RSKTLSK

SEQ ID NO: 17853 - protein, 7 aa, synthetic construct
  REGION 1..7: note = Synthetic Construct
RSKTLTK

SEQ ID NO: 17854 - protein, 7 aa, synthetic construct
  REGION 1..7: note = Synthetic Construct
RSKTLYK

SEQ ID NO: 17855 - protein, 7 aa, synthetic construct
  REGION 1..7: note = Synthetic Construct
RSKTNAK

SEQ ID NO: 17856 - protein, 7 aa, synthetic construct
  REGION 1..7: note = Synthetic Construct
RSKTNDK

SEQ ID NO: 17857 - protein, 7 aa, synthetic construct
  REGION 1..7: note = Synthetic Construct
RSKTNEK

SEQ ID NO: 17858 - protein, 7 aa, synthetic construct
  REGION 1..7: note = Synthetic Construct
RSKTNFK

SEQ ID NO: 17859 - protein, 7 aa, synthetic construct
  REGION 1..7: note = Synthetic Construct
RSKTNGK

SEQ ID NO: 17860 - protein, 7 aa, synthetic construct
  REGION 1..7: note = Synthetic Construct
RSKTNHK

SEQ ID NO: 17861 - protein, 7 aa, synthetic construct
  REGION 1..7: note = Synthetic Construct
RSKTNIK

SEQ ID NO: 17862 - protein, 7 aa, synthetic construct
  REGION 1..7: note = Synthetic Construct
RSKTNLK

SEQ ID NO: 17863 - protein, 7 aa, synthetic construct
  REGION 1..7: note = Synthetic Construct
RSKTNNK

SEQ ID NO: 17864 - protein, 7 aa, synthetic construct
  REGION 1..7: note = Synthetic Construct
RSKTNQK

SEQ ID NO: 17865 - protein, 7 aa, synthetic construct
  REGION 1..7: note = Synthetic Construct
RSKTNRK

SEQ ID NO: 17866 - protein, 7 aa, synthetic construct
  REGION 1..7: note = Synthetic Construct
RSKTNSK

SEQ ID NO: 17867 - protein, 7 aa, synthetic construct
  REGION 1..7: note = Synthetic Construct
RSKTNTK

SEQ ID NO: 17868 - protein, 7 aa, synthetic construct
  REGION 1..7: note = Synthetic Construct
RSKTNYK

SEQ ID NO: 17869 - protein, 7 aa, synthetic construct
  REGION 1..7: note = Synthetic Construct
RSKTQAK

SEQ ID NO: 17870 - protein, 7 aa, synthetic construct
  REGION 1..7: note = Synthetic Construct
RSKTQDK

SEQ ID NO: 17871 - protein, 7 aa, synthetic construct
  REGION 1..7: note = Synthetic Construct
RSKTQEK

SEQ ID NO: 17872 - protein, 7 aa, synthetic construct
  REGION 1..7: note = Synthetic Construct
RSKTQFK

SEQ ID NO: 17873 - protein, 7 aa, synthetic construct
  REGION 1..7: note = Synthetic Construct
RSKTQGK

SEQ ID NO: 17874 - protein, 7 aa, synthetic construct
  REGION 1..7: note = Synthetic Construct
RSKTQHK

SEQ ID NO: 17875 - protein, 7 aa, synthetic construct
  REGION 1..7: note = Synthetic Construct
RSKTQIK

SEQ ID NO: 17876 - protein, 7 aa, synthetic construct
  REGION 1..7: note = Synthetic Construct
RSKTQLK

SEQ ID NO: 17877 - protein, 7 aa, synthetic construct
  REGION 1..7: note = Synthetic Construct
RSKTQNK

SEQ ID NO: 17878 - protein, 7 aa, synthetic construct
  REGION 1..7: note = Synthetic Construct
RSKTQQK

SEQ ID NO: 17879 - protein, 7 aa, synthetic construct
  REGION 1..7: note = Synthetic Construct
RSKTQRK

SEQ ID NO: 17880 - protein, 7 aa, synthetic construct
  REGION 1..7: note = Synthetic Construct
RSKTQSK

SEQ ID NO: 17881 - protein, 7 aa, synthetic construct
  REGION 1..7: note = Synthetic Construct
RSKTQTK

SEQ ID NO: 17882 - protein, 7 aa, synthetic construct
  REGION 1..7: note = Synthetic Construct
RSKTQYK

SEQ ID NO: 17883 - protein, 7 aa, synthetic construct
  REGION 1..7: note = Synthetic Construct
RSKTRAK

SEQ ID NO: 17884 - protein, 7 aa, synthetic construct
  REGION 1..7: note = Synthetic Construct
RSKTRDK

SEQ ID NO: 17885 - protein, 7 aa, synthetic construct
  REGION 1..7: note = Synthetic Construct
RSKTREK

SEQ ID NO: 17886 - protein, 7 aa, synthetic construct
  REGION 1..7: note = Synthetic Construct
RSKTRFK

SEQ ID NO: 17887 - protein, 7 aa, synthetic construct
  REGION 1..7: note = Synthetic Construct
RSKTRGK

SEQ ID NO: 17888 - protein, 7 aa, synthetic construct
  REGION 1..7: note = Synthetic Construct
RSKTRHK

SEQ ID NO: 17889 - protein, 7 aa, synthetic construct
  REGION 1..7: note = Synthetic Construct
RSKTRIK

SEQ ID NO: 17890 - protein, 7 aa, synthetic construct
  REGION 1..7: note = Synthetic Construct
RSKTRLK

SEQ ID NO: 17891 - protein, 7 aa, synthetic construct
  REGION 1..7: note = Synthetic Construct
RSKTRNK

SEQ ID NO: 17892 - protein, 7 aa, synthetic construct
  REGION 1..7: note = Synthetic Construct
RSKTRQK

SEQ ID NO: 17893 - protein, 7 aa, synthetic construct
  REGION 1..7: note = Synthetic Construct
RSKTRRK

SEQ ID NO: 17894 - protein, 7 aa, synthetic construct
  REGION 1..7: note = Synthetic Construct
RSKTRSK

SEQ ID NO: 17895 - protein, 7 aa, synthetic construct
  REGION 1..7: note = Synthetic Construct
RSKTRTK

SEQ ID NO: 17896 - protein, 7 aa, synthetic construct
  REGION 1..7: note = Synthetic Construct
RSKTRYK

SEQ ID NO: 17897 - protein, 7 aa, synthetic construct
  REGION 1..7: note = Synthetic Construct
RSKTSAK

SEQ ID NO: 17898 - protein, 7 aa, synthetic construct
  REGION 1..7: note = Synthetic Construct
RSKTSDK

SEQ ID NO: 17899 - protein, 7 aa, synthetic construct
  REGION 1..7: note = Synthetic Construct
RSKTSEK

SEQ ID NO: 17900 - protein, 7 aa, synthetic construct
  REGION 1..7: note = Synthetic Construct
RSKTSFK

SEQ ID NO: 17901 - protein, 7 aa, synthetic construct
  REGION 1..7: note = Synthetic Construct
RSKTSGK

SEQ ID NO: 17902 - protein, 7 aa, synthetic construct
  REGION 1..7: note = Synthetic Construct
RSKTSHK

SEQ ID NO: 17903 - protein, 7 aa, synthetic construct
  REGION 1..7: note = Synthetic Construct
RSKTSIK

SEQ ID NO: 17904 - protein, 7 aa, synthetic construct
  REGION 1..7: note = Synthetic Construct
RSKTSLK

SEQ ID NO: 17905 - protein, 7 aa, synthetic construct
  REGION 1..7: note = Synthetic Construct
RSKTSNK

SEQ ID NO: 17906 - protein, 7 aa, synthetic construct
  REGION 1..7: note = Synthetic Construct
RSKTSQK

SEQ ID NO: 17907 - protein, 7 aa, synthetic construct
  REGION 1..7: note = Synthetic Construct
RSKTSRK

SEQ ID NO: 17908 - protein, 7 aa, synthetic construct
  REGION 1..7: note = Synthetic Construct
RSKTSSK

SEQ ID NO: 17909 - protein, 7 aa, synthetic construct
  REGION 1..7: note = Synthetic Construct
RSKTSTK

SEQ ID NO: 17910 - protein, 7 aa, synthetic construct
  REGION 1..7: note = Synthetic Construct
RSKTSYK

SEQ ID NO: 17911 - protein, 7 aa, synthetic construct
  REGION 1..7: note = Synthetic Construct
RSKTTAK

SEQ ID NO: 17912 - protein, 7 aa, synthetic construct
  REGION 1..7: note = Synthetic Construct
RSKTTDK

SEQ ID NO: 17913 - protein, 7 aa, synthetic construct
  REGION 1..7: note = Synthetic Construct
RSKTTEK

SEQ ID NO: 17914 - protein, 7 aa, synthetic construct
  REGION 1..7: note = Synthetic Construct
RSKTTFK

SEQ ID NO: 17915 - protein, 7 aa, synthetic construct
  REGION 1..7: note = Synthetic Construct
RSKTTGK

SEQ ID NO: 17916 - protein, 7 aa, synthetic construct
  REGION 1..7: note = Synthetic Construct
RSKTTHK

SEQ ID NO: 17917 - protein, 7 aa, synthetic construct
  REGION 1..7: note = Synthetic Construct
RSKTTIK

SEQ ID NO: 17918 - protein, 7 aa, synthetic construct
  REGION 1..7: note = Synthetic Construct
RSKTTLK

SEQ ID NO: 17919 - protein, 7 aa, synthetic construct
  REGION 1..7: note = Synthetic Construct
RSKTTNK

SEQ ID NO: 17920 - protein, 7 aa, synthetic construct
  REGION 1..7: note = Synthetic Construct
RSKTTQK

SEQ ID NO: 17921 - protein, 7 aa, synthetic construct
  REGION 1..7: note = Synthetic Construct
RSKTTRK

SEQ ID NO: 17922 - protein, 7 aa, synthetic construct
  REGION 1..7: note = Synthetic Construct
RSKTTSK

SEQ ID NO: 17923 - protein, 7 aa, synthetic construct
  REGION 1..7: note = Synthetic Construct
RSKTTTK

SEQ ID NO: 17924 - protein, 7 aa, synthetic construct
  REGION 1..7: note = Synthetic Construct
RSKTTYK

SEQ ID NO: 17925 - protein, 7 aa, synthetic construct
  REGION 1..7: note = Synthetic Construct
RSKTYAK

SEQ ID NO: 17926 - protein, 7 aa, synthetic construct
  REGION 1..7: note = Synthetic Construct
RSKTYDK

SEQ ID NO: 17927 - protein, 7 aa, synthetic construct
  REGION 1..7: note = Synthetic Construct
RSKTYEK

SEQ ID NO: 17928 - protein, 7 aa, synthetic construct
  REGION 1..7: note = Synthetic Construct
RSKTYFK

SEQ ID NO: 17929 - protein, 7 aa, synthetic construct
  REGION 1..7: note = Synthetic Construct
RSKTYGK

SEQ ID NO: 17930 - protein, 7 aa, synthetic construct
  REGION 1..7: note = Synthetic Construct
RSKTYHK

SEQ ID NO: 17931 - protein, 7 aa, synthetic construct
  REGION 1..7: note = Synthetic Construct
RSKTYIK

SEQ ID NO: 17932 - protein, 7 aa, synthetic construct
  REGION 1..7: note = Synthetic Construct
RSKTYLK

SEQ ID NO: 17933 - protein, 7 aa, synthetic construct
  REGION 1..7: note = Synthetic Construct
RSKTYNK

SEQ ID NO: 17934 - protein, 7 aa, synthetic construct
  REGION 1..7: note = Synthetic Construct
RSKTYQK

SEQ ID NO: 17935 - protein, 7 aa, synthetic construct
  REGION 1..7: note = Synthetic Construct
RSKTYRK

SEQ ID NO: 17936 - protein, 7 aa, synthetic construct
  REGION 1..7: note = Synthetic Construct
RSKTYSK

SEQ ID NO: 17937 - protein, 7 aa, synthetic construct
  REGION 1..7: note = Synthetic Construct
RSKTYTK

SEQ ID NO: 17938 - protein, 7 aa, synthetic construct
  REGION 1..7: note = Synthetic Construct
RSKTYYK

SEQ ID NO: 17939 - protein, 7 aa, synthetic construct
  REGION 1..7: note = Synthetic Construct
RSKYAAK

SEQ ID NO: 17940 - protein, 7 aa, synthetic construct
  REGION 1..7: note = Synthetic Construct
RSKYADK

SEQ ID NO: 17941 - protein, 7 aa, synthetic construct
  REGION 1..7: note = Synthetic Construct
RSKYAEK

SEQ ID NO: 17942 - protein, 7 aa, synthetic construct
  REGION 1..7: note = Synthetic Construct
RSKYAFK

SEQ ID NO: 17943 - protein, 7 aa, synthetic construct
  REGION 1..7: note = Synthetic Construct
RSKYAGK

SEQ ID NO: 17944 - protein, 7 aa, synthetic construct
  REGION 1..7: note = Synthetic Construct
RSKYAHK

SEQ ID NO: 17945 - protein, 7 aa, synthetic construct
  REGION 1..7: note = Synthetic Construct
RSKYAIK

SEQ ID NO: 17946 - protein, 7 aa, synthetic construct
  REGION 1..7: note = Synthetic Construct
RSKYALK

SEQ ID NO: 17947 - protein, 7 aa, synthetic construct
  REGION 1..7: note = Synthetic Construct
RSKYANK

SEQ ID NO: 17948 - protein, 7 aa, synthetic construct
  REGION 1..7: note = Synthetic Construct
RSKYAQK

SEQ ID NO: 17949 - protein, 7 aa, synthetic construct
  REGION 1..7: note = Synthetic Construct
RSKYARK

SEQ ID NO: 17950 - protein, 7 aa, synthetic construct
  REGION 1..7: note = Synthetic Construct
RSKYASK

SEQ ID NO: 17951 - protein, 7 aa, synthetic construct
  REGION 1..7: note = Synthetic Construct
RSKYATK

SEQ ID NO: 17952 - protein, 7 aa, synthetic construct
  REGION 1..7: note = Synthetic Construct
RSKYAYK

SEQ ID NO: 17953 - protein, 7 aa, synthetic construct
  REGION 1..7: note = Synthetic Construct
RSKYDAK

SEQ ID NO: 17954 - protein, 7 aa, synthetic construct
  REGION 1..7: note = Synthetic Construct
RSKYDDK

SEQ ID NO: 17955 - protein, 7 aa, synthetic construct
  REGION 1..7: note = Synthetic Construct
RSKYDEK

SEQ ID NO: 17956 - protein, 7 aa, synthetic construct
  REGION 1..7: note = Synthetic Construct
RSKYDFK

SEQ ID NO: 17957 - protein, 7 aa, synthetic construct
  REGION 1..7: note = Synthetic Construct
RSKYDGK

SEQ ID NO: 17958 - protein, 7 aa, synthetic construct
  REGION 1..7: note = Synthetic Construct
RSKYDHK

SEQ ID NO: 17959 - protein, 7 aa, synthetic construct
  REGION 1..7: note = Synthetic Construct
RSKYDIK

SEQ ID NO: 17960 - protein, 7 aa, synthetic construct
  REGION 1..7: note = Synthetic Construct
RSKYDLK

SEQ ID NO: 17961 - protein, 7 aa, synthetic construct
  REGION 1..7: note = Synthetic Construct
RSKYDNK

SEQ ID NO: 17962 - protein, 7 aa, synthetic construct
  REGION 1..7: note = Synthetic Construct
RSKYDQK

SEQ ID NO: 17963 - protein, 7 aa, synthetic construct
  REGION 1..7: note = Synthetic Construct
RSKYDRK

SEQ ID NO: 17964 - protein, 7 aa, synthetic construct
  REGION 1..7: note = Synthetic Construct
RSKYDSK

SEQ ID NO: 17965 - protein, 7 aa, synthetic construct
  REGION 1..7: note = Synthetic Construct
RSKYDTK

SEQ ID NO: 17966 - protein, 7 aa, synthetic construct
  REGION 1..7: note = Synthetic Construct
RSKYDYK

SEQ ID NO: 17967 - protein, 7 aa, synthetic construct
  REGION 1..7: note = Synthetic Construct
RSKYEAK

SEQ ID NO: 17968 - protein, 7 aa, synthetic construct
  REGION 1..7: note = Synthetic Construct
RSKYEDK

SEQ ID NO: 17969 - protein, 7 aa, synthetic construct
  REGION 1..7: note = Synthetic Construct
RSKYEEK

SEQ ID NO: 17970 - protein, 7 aa, synthetic construct
  REGION 1..7: note = Synthetic Construct
RSKYEFK

SEQ ID NO: 17971 - protein, 7 aa, synthetic construct
  REGION 1..7: note = Synthetic Construct
RSKYEGK

SEQ ID NO: 17972 - protein, 7 aa, synthetic construct
  REGION 1..7: note = Synthetic Construct
RSKYEHK

SEQ ID NO: 17973 - protein, 7 aa, synthetic construct
  REGION 1..7: note = Synthetic Construct
RSKYEIK

SEQ ID NO: 17974 - protein, 7 aa, synthetic construct
  REGION 1..7: note = Synthetic Construct
RSKYELK

SEQ ID NO: 17975 - protein, 7 aa, synthetic construct
  REGION 1..7: note = Synthetic Construct
RSKYENK

SEQ ID NO: 17976 - protein, 7 aa, synthetic construct
  REGION 1..7: note = Synthetic Construct
RSKYEQK

SEQ ID NO: 17977 - protein, 7 aa, synthetic construct
  REGION 1..7: note = Synthetic Construct
RSKYERK

SEQ ID NO: 17978 - protein, 7 aa, synthetic construct
  REGION 1..7: note = Synthetic Construct
RSKYESK

SEQ ID NO: 17979 - protein, 7 aa, synthetic construct
  REGION 1..7: note = Synthetic Construct
RSKYETK

SEQ ID NO: 17980 - protein, 7 aa, synthetic construct
  REGION 1..7: note = Synthetic Construct
RSKYEYK

SEQ ID NO: 17981 - protein, 7 aa, synthetic construct
  REGION 1..7: note = Synthetic Construct
RSKYFAK

SEQ ID NO: 17982 - protein, 7 aa, synthetic construct
  REGION 1..7: note = Synthetic Construct
RSKYFDK

SEQ ID NO: 17983 - protein, 7 aa, synthetic construct
  REGION 1..7: note = Synthetic Construct
RSKYFEK

SEQ ID NO: 17984 - protein, 7 aa, synthetic construct
  REGION 1..7: note = Synthetic Construct
RSKYFFK

SEQ ID NO: 17985 - protein, 7 aa, synthetic construct
  REGION 1..7: note = Synthetic Construct
RSKYFGK

SEQ ID NO: 17986 - protein, 7 aa, synthetic construct
  REGION 1..7: note = Synthetic Construct
RSKYFHK

SEQ ID NO: 17987 - protein, 7 aa, synthetic construct
  REGION 1..7: note = Synthetic Construct
RSKYFIK

SEQ ID NO: 17988 - protein, 7 aa, synthetic construct
  REGION 1..7: note = Synthetic Construct
RSKYFLK

SEQ ID NO: 17989 - protein, 7 aa, synthetic construct
  REGION 1..7: note = Synthetic Construct
RSKYFNK

SEQ ID NO: 17990 - protein, 7 aa, synthetic construct
  REGION 1..7: note = Synthetic Construct
RSKYFQK

SEQ ID NO: 17991 - protein, 7 aa, synthetic construct
  REGION 1..7: note = Synthetic Construct
RSKYFRK

SEQ ID NO: 17992 - protein, 7 aa, synthetic construct
  REGION 1..7: note = Synthetic Construct
RSKYFSK

SEQ ID NO: 17993 - protein, 7 aa, synthetic construct
  REGION 1..7: note = Synthetic Construct
RSKYFTK

SEQ ID NO: 17994 - protein, 7 aa, synthetic construct
  REGION 1..7: note = Synthetic Construct
RSKYFYK

SEQ ID NO: 17995 - protein, 7 aa, synthetic construct
  REGION 1..7: note = Synthetic Construct
RSKYGAK

SEQ ID NO: 17996 - protein, 7 aa, synthetic construct
  REGION 1..7: note = Synthetic Construct
RSKYGDK

SEQ ID NO: 17997 - protein, 7 aa, synthetic construct
  REGION 1..7: note = Synthetic Construct
RSKYGEK

SEQ ID NO: 17998 - protein, 7 aa, synthetic construct
  REGION 1..7: note = Synthetic Construct
RSKYGFK

SEQ ID NO: 17999 - protein, 7 aa, synthetic construct
  REGION 1..7: note = Synthetic Construct
RSKYGGK

SEQ ID NO: 18000 - protein, 7 aa, synthetic construct
  REGION 1..7: note = Synthetic Construct
RSKYGHK

SEQ ID NO: 18001 - protein, 7 aa, synthetic construct
  REGION 1..7: note = Synthetic Construct
RSKYGIK

SEQ ID NO: 18002 - protein, 7 aa, synthetic construct
  REGION 1..7: note = Synthetic Construct
RSKYGLK

SEQ ID NO: 18003 - protein, 7 aa, synthetic construct
  REGION 1..7: note = Synthetic Construct
RSKYGNK

SEQ ID NO: 18004 - protein, 7 aa, synthetic construct
  REGION 1..7: note = Synthetic Construct
RSKYGQK

SEQ ID NO: 18005 - protein, 7 aa, synthetic construct
  REGION 1..7: note = Synthetic Construct
RSKYGRK

SEQ ID NO: 18006 - protein, 7 aa, synthetic construct
  REGION 1..7: note = Synthetic Construct
RSKYGSK

SEQ ID NO: 18007 - protein, 7 aa, synthetic construct
  REGION 1..7: note = Synthetic Construct
RSKYGTK

SEQ ID NO: 18008 - protein, 7 aa, synthetic construct
  REGION 1..7: note = Synthetic Construct
RSKYGYK

SEQ ID NO: 18009 - protein, 7 aa, synthetic construct
  REGION 1..7: note = Synthetic Construct
RSKYHAK

SEQ ID NO: 18010 - protein, 7 aa, synthetic construct
  REGION 1..7: note = Synthetic Construct
RSKYHDK

SEQ ID NO: 18011 - protein, 7 aa, synthetic construct
  REGION 1..7: note = Synthetic Construct
RSKYHEK

SEQ ID NO: 18012 - protein, 7 aa, synthetic construct
  REGION 1..7: note = Synthetic Construct
RSKYHFK

SEQ ID NO: 18013 - protein, 7 aa, synthetic construct
  REGION 1..7: note = Synthetic Construct
RSKYHGK

SEQ ID NO: 18014 - protein, 7 aa, synthetic construct
  REGION 1..7: note = Synthetic Construct
RSKYHHK

SEQ ID NO: 18015 - protein, 7 aa, synthetic construct
  REGION 1..7: note = Synthetic Construct
RSKYHIK

SEQ ID NO: 18016 - protein, 7 aa, synthetic construct
  REGION 1..7: note = Synthetic Construct
RSKYHLK

SEQ ID NO: 18017 - protein, 7 aa, synthetic construct
  REGION 1..7: note = Synthetic Construct
RSKYHNK

SEQ ID NO: 18018 - protein, 7 aa, synthetic construct
  REGION 1..7: note = Synthetic Construct
RSKYHQK

SEQ ID NO: 18019 - protein, 7 aa, synthetic construct
  REGION 1..7: note = Synthetic Construct
RSKYHRK

SEQ ID NO: 18020 - protein, 7 aa, synthetic construct
  REGION 1..7: note = Synthetic Construct
RSKYHSK

SEQ ID NO: 18021 - protein, 7 aa, synthetic construct
  REGION 1..7: note = Synthetic Construct
RSKYHTK

SEQ ID NO: 18022 - protein, 7 aa, synthetic construct
  REGION 1..7: note = Synthetic Construct
RSKYHYK

SEQ ID NO: 18023 - protein, 7 aa, synthetic construct
  REGION 1..7: note = Synthetic Construct
RSKYIAK

SEQ ID NO: 18024 - protein, 7 aa, synthetic construct
  REGION 1..7: note = Synthetic Construct
RSKYIDK

SEQ ID NO: 18025 - protein, 7 aa, synthetic construct
  REGION 1..7: note = Synthetic Construct
RSKYIEK

SEQ ID NO: 18026 - protein, 7 aa, synthetic construct
  REGION 1..7: note = Synthetic Construct
RSKYIFK

SEQ ID NO: 18027 - protein, 7 aa, synthetic construct
  REGION 1..7: note = Synthetic Construct
RSKYIGK

SEQ ID NO: 18028 - protein, 7 aa, synthetic construct
  REGION 1..7: note = Synthetic Construct
RSKYIHK

SEQ ID NO: 18029 - protein, 7 aa, synthetic construct
  REGION 1..7: note = Synthetic Construct
RSKYIIK

SEQ ID NO: 18030 - protein, 7 aa, synthetic construct
  REGION 1..7: note = Synthetic Construct
RSKYILK

SEQ ID NO: 18031 - protein, 7 aa, synthetic construct
  REGION 1..7: note = Synthetic Construct
RSKYINK

SEQ ID NO: 18032 - protein, 7 aa, synthetic construct
  REGION 1..7: note = Synthetic Construct
RSKYIQK

SEQ ID NO: 18033 - protein, 7 aa, synthetic construct
  REGION 1..7: note = Synthetic Construct
RSKYIRK

SEQ ID NO: 18034 - protein, 7 aa, synthetic construct
  REGION 1..7: note = Synthetic Construct
RSKYISK

SEQ ID NO: 18035 - protein, 7 aa, synthetic construct
  REGION 1..7: note = Synthetic Construct
RSKYITK

SEQ ID NO: 18036 - protein, 7 aa, synthetic construct
  REGION 1..7: note = Synthetic Construct
RSKYIYK

SEQ ID NO: 18037 - protein, 7 aa, synthetic construct
  REGION 1..7: note = Synthetic Construct
RSKYLAK

SEQ ID NO: 18038 - protein, 7 aa, synthetic construct
  REGION 1..7: note = Synthetic Construct
RSKYLDK

SEQ ID NO: 18039 - protein, 7 aa, synthetic construct
  REGION 1..7: note = Synthetic Construct
RSKYLEK

SEQ ID NO: 18040 - protein, 7 aa, synthetic construct
  REGION 1..7: note = Synthetic Construct
RSKYLFK

SEQ ID NO: 18041 - protein, 7 aa, synthetic construct
  REGION 1..7: note = Synthetic Construct
RSKYLGK

SEQ ID NO: 18042 - protein, 7 aa, synthetic construct
  REGION 1..7: note = Synthetic Construct
RSKYLHK

SEQ ID NO: 18043 - protein, 7 aa, synthetic construct
  REGION 1..7: note = Synthetic Construct
RSKYLIK

SEQ ID NO: 18044 - protein, 7 aa, synthetic construct
  REGION 1..7: note = Synthetic Construct
RSKYLLK

SEQ ID NO: 18045 - protein, 7 aa, synthetic construct
  REGION 1..7: note = Synthetic Construct
RSKYLNK

SEQ ID NO: 18046 - protein, 7 aa, synthetic construct
  REGION 1..7: note = Synthetic Construct
RSKYLQK

SEQ ID NO: 18047 - protein, 7 aa, synthetic construct
  REGION 1..7: note = Synthetic Construct
RSKYLRK

SEQ ID NO: 18048 - protein, 7 aa, synthetic construct
  REGION 1..7: note = Synthetic Construct
RSKYLSK

SEQ ID NO: 18049 - protein, 7 aa, synthetic construct
  REGION 1..7: note = Synthetic Construct
RSKYLTK

SEQ ID NO: 18050 - protein, 7 aa, synthetic construct
  REGION 1..7: note = Synthetic Construct
RSKYLYK

SEQ ID NO: 18051 - protein, 7 aa, synthetic construct
  REGION 1..7: note = Synthetic Construct
RSKYNAK

SEQ ID NO: 18052 - protein, 7 aa, synthetic construct
  REGION 1..7: note = Synthetic Construct
RSKYNDK

SEQ ID NO: 18053 - protein, 7 aa, synthetic construct
  REGION 1..7: note = Synthetic Construct
RSKYNEK

SEQ ID NO: 18054 - protein, 7 aa, synthetic construct
  REGION 1..7: note = Synthetic Construct
RSKYNFK

SEQ ID NO: 18055 - protein, 7 aa, synthetic construct
  REGION 1..7: note = Synthetic Construct
RSKYNGK

SEQ ID NO: 18056 - protein, 7 aa, synthetic construct
  REGION 1..7: note = Synthetic Construct
RSKYNHK

SEQ ID NO: 18057 - protein, 7 aa, synthetic construct
  REGION 1..7: note = Synthetic Construct
RSKYNIK

SEQ ID NO: 18058 - protein, 7 aa, synthetic construct
  REGION 1..7: note = Synthetic Construct
RSKYNLK

SEQ ID NO: 18059 - protein, 7 aa, synthetic construct
  REGION 1..7: note = Synthetic Construct
RSKYNNK

SEQ ID NO: 18060 - protein, 7 aa, synthetic construct
  REGION 1..7: note = Synthetic Construct
RSKYNQK

SEQ ID NO: 18061 - protein, 7 aa, synthetic construct
  REGION 1..7: note = Synthetic Construct
RSKYNRK

SEQ ID NO: 18062 - protein, 7 aa, synthetic construct
  REGION 1..7: note = Synthetic Construct
RSKYNSK

SEQ ID NO: 18063 - protein, 7 aa, synthetic construct
  REGION 1..7: note = Synthetic Construct
RSKYNTK

SEQ ID NO: 18064 - protein, 7 aa, synthetic construct
  REGION 1..7: note = Synthetic Construct
RSKYNYK

SEQ ID NO: 18065 - protein, 7 aa, synthetic construct
  REGION 1..7: note = Synthetic Construct
RSKYQAK

SEQ ID NO: 18066 - protein, 7 aa, synthetic construct
  REGION 1..7: note = Synthetic Construct
RSKYQDK

SEQ ID NO: 18067 - protein, 7 aa, synthetic construct
  REGION 1..7: note = Synthetic Construct
RSKYQEK

SEQ ID NO: 18068 - protein, 7 aa, synthetic construct
  REGION 1..7: note = Synthetic Construct
RSKYQFK

SEQ ID NO: 18069 - protein, 7 aa, synthetic construct
  REGION 1..7: note = Synthetic Construct
RSKYQGK

SEQ ID NO: 18070 - protein, 7 aa, synthetic construct
  REGION 1..7: note = Synthetic Construct
RSKYQHK

SEQ ID NO: 18071 - protein, 7 aa, synthetic construct
  REGION 1..7: note = Synthetic Construct
RSKYQIK

SEQ ID NO: 18072 - protein, 7 aa, synthetic construct
  REGION 1..7: note = Synthetic Construct
RSKYQLK

SEQ ID NO: 18073 - protein, 7 aa, synthetic construct
  REGION 1..7: note = Synthetic Construct
RSKYQNK

SEQ ID NO: 18074 - protein, 7 aa, synthetic construct
  REGION 1..7: note = Synthetic Construct
RSKYQQK

SEQ ID NO: 18075 - protein, 7 aa, synthetic construct
  REGION 1..7: note = Synthetic Construct
RSKYQRK

SEQ ID NO: 18076 - protein, 7 aa, synthetic construct
  REGION 1..7: note = Synthetic Construct
RSKYQSK

SEQ ID NO: 18077 - protein, 7 aa, synthetic construct
  REGION 1..7: note = Synthetic Construct
RSKYQTK

SEQ ID NO: 18078 - protein, 7 aa, synthetic construct
  REGION 1..7: note = Synthetic Construct
RSKYQYK

SEQ ID NO: 18079 - protein, 7 aa, synthetic construct
  REGION 1..7: note = Synthetic Construct
RSKYRAK

SEQ ID NO: 18080 - protein, 7 aa, synthetic construct
  REGION 1..7: note = Synthetic Construct
RSKYRDK

SEQ ID NO: 18081 - protein, 7 aa, synthetic construct
  REGION 1..7: note = Synthetic Construct
RSKYREK

SEQ ID NO: 18082 - protein, 7 aa, synthetic construct
  REGION 1..7: note = Synthetic Construct
RSKYRFK

SEQ ID NO: 18083 - protein, 7 aa, synthetic construct
  REGION 1..7: note = Synthetic Construct
RSKYRGK

SEQ ID NO: 18084 - protein, 7 aa, synthetic construct
  REGION 1..7: note = Synthetic Construct
RSKYRHK

SEQ ID NO: 18085 - protein, 7 aa, synthetic construct
  REGION 1..7: note = Synthetic Construct
RSKYRIK

SEQ ID NO: 18086 - protein, 7 aa, synthetic construct
  REGION 1..7: note = Synthetic Construct
RSKYRLK

SEQ ID NO: 18087 - protein, 7 aa, synthetic construct
  REGION 1..7: note = Synthetic Construct
RSKYRNK

SEQ ID NO: 18088 - protein, 7 aa, synthetic construct
  REGION 1..7: note = Synthetic Construct
RSKYRQK

SEQ ID NO: 18089 - protein, 7 aa, synthetic construct
  REGION 1..7: note = Synthetic Construct
RSKYRRK

SEQ ID NO: 18090 - protein, 7 aa, synthetic construct
  REGION 1..7: note = Synthetic Construct
RSKYRSK

SEQ ID NO: 18091 - protein, 7 aa, synthetic construct
  REGION 1..7: note = Synthetic Construct
RSKYRTK

SEQ ID NO: 18092 - protein, 7 aa, synthetic construct
  REGION 1..7: note = Synthetic Construct
RSKYRYK

SEQ ID NO: 18093 - protein, 7 aa, synthetic construct
  REGION 1..7: note = Synthetic Construct
RSKYSAK

SEQ ID NO: 18094 - protein, 7 aa, synthetic construct
  REGION 1..7: note = Synthetic Construct
RSKYSDK

SEQ ID NO: 18095 - protein, 7 aa, synthetic construct
  REGION 1..7: note = Synthetic Construct
RSKYSEK

SEQ ID NO: 18096 - protein, 7 aa, synthetic construct
  REGION 1..7: note = Synthetic Construct
RSKYSFK

SEQ ID NO: 18097 - protein, 7 aa, synthetic construct
  REGION 1..7: note = Synthetic Construct
RSKYSGK

SEQ ID NO: 18098 - protein, 7 aa, synthetic construct
  REGION 1..7: note = Synthetic Construct
RSKYSHK

SEQ ID NO: 18099 - protein, 7 aa, synthetic construct
  REGION 1..7: note = Synthetic Construct
RSKYSIK

SEQ ID NO: 18100 - protein, 7 aa, synthetic construct
  REGION 1..7: note = Synthetic Construct
RSKYSLK

SEQ ID NO: 18101 - protein, 7 aa, synthetic construct
  REGION 1..7: note = Synthetic Construct
RSKYSNK

SEQ ID NO: 18102 - protein, 7 aa, synthetic construct
  REGION 1..7: note = Synthetic Construct
RSKYSQK

SEQ ID NO: 18103 - protein, 7 aa, synthetic construct
  REGION 1..7: note = Synthetic Construct
RSKYSRK

SEQ ID NO: 18104 - protein, 7 aa, synthetic construct
  REGION 1..7: note = Synthetic Construct
RSKYSSK

SEQ ID NO: 18105 - protein, 7 aa, synthetic construct
  REGION 1..7: note = Synthetic Construct
RSKYSTK

SEQ ID NO: 18106 - protein, 7 aa, synthetic construct
  REGION 1..7: note = Synthetic Construct
RSKYSYK

SEQ ID NO: 18107 - protein, 7 aa, synthetic construct
  REGION 1..7: note = Synthetic Construct
RSKYTAK

SEQ ID NO: 18108 - protein, 7 aa, synthetic construct
  REGION 1..7: note = Synthetic Construct
RSKYTDK

SEQ ID NO: 18109 - protein, 7 aa, synthetic construct
  REGION 1..7: note = Synthetic Construct
RSKYTEK

SEQ ID NO: 18110 - protein, 7 aa, synthetic construct
  REGION 1..7: note = Synthetic Construct
RSKYTFK

SEQ ID NO: 18111 - protein, 7 aa, synthetic construct
  REGION 1..7: note = Synthetic Construct
RSKYTGK

SEQ ID NO: 18112 - protein, 7 aa, synthetic construct
  REGION 1..7: note = Synthetic Construct
RSKYTHK

SEQ ID NO: 18113 - protein, 7 aa, synthetic construct
  REGION 1..7: note = Synthetic Construct
RSKYTIK

SEQ ID NO: 18114 - protein, 7 aa, synthetic construct
  REGION 1..7: note = Synthetic Construct
RSKYTLK

SEQ ID NO: 18115 - protein, 7 aa, synthetic construct
  REGION 1..7: note = Synthetic Construct
RSKYTNK

SEQ ID NO: 18116 - protein, 7 aa, synthetic construct
  REGION 1..7: note = Synthetic Construct
RSKYTQK

SEQ ID NO: 18117 - protein, 7 aa, synthetic construct
  REGION 1..7: note = Synthetic Construct
RSKYTRK

SEQ ID NO: 18118 - protein, 7 aa, synthetic construct
  REGION 1..7: note = Synthetic Construct
RSKYTSK

SEQ ID NO: 18119 - protein, 7 aa, synthetic construct
  REGION 1..7: note = Synthetic Construct
RSKYTTK

SEQ ID NO: 18120 - protein, 7 aa, synthetic construct
  REGION 1..7: note = Synthetic Construct
RSKYTYK

SEQ ID NO: 18121 - protein, 7 aa, synthetic construct
  REGION 1..7: note = Synthetic Construct
RSKYYAK

SEQ ID NO: 18122 - protein, 7 aa, synthetic construct
  REGION 1..7: note = Synthetic Construct
RSKYYDK

SEQ ID NO: 18123 - protein, 7 aa, synthetic construct
  REGION 1..7: note = Synthetic Construct
RSKYYEK

SEQ ID NO: 18124 - protein, 7 aa, synthetic construct
  REGION 1..7: note = Synthetic Construct
RSKYYFK

SEQ ID NO: 18125 - protein, 7 aa, synthetic construct
  REGION 1..7: note = Synthetic Construct
RSKYYGK

SEQ ID NO: 18126 - protein, 7 aa, synthetic construct
  REGION 1..7: note = Synthetic Construct
RSKYYHK

SEQ ID NO: 18127 - protein, 7 aa, synthetic construct
  REGION 1..7: note = Synthetic Construct
RSKYYIK

SEQ ID NO: 18128 - protein, 7 aa, synthetic construct
  REGION 1..7: note = Synthetic Construct
RSKYYLK

SEQ ID NO: 18129 - protein, 7 aa, synthetic construct
  REGION 1..7: note = Synthetic Construct
RSKYYNK

SEQ ID NO: 18130 - protein, 7 aa, synthetic construct
  REGION 1..7: note = Synthetic Construct
RSKYYQK

SEQ ID NO: 18131 - protein, 7 aa, synthetic construct
  REGION 1..7: note = Synthetic Construct
RSKYYRK

SEQ ID NO: 18132 - protein, 7 aa, synthetic construct
  REGION 1..7: note = Synthetic Construct
RSKYYSK

SEQ ID NO: 18133 - protein, 7 aa, synthetic construct
  REGION 1..7: note = Synthetic Construct
RSKYYTK

SEQ ID NO: 18134 - protein, 7 aa, synthetic construct
  REGION 1..7: note = Synthetic Construct
RSKYYYK

SEQ ID NO: 18135 - protein, 6 aa, synthetic construct
  REGION 1..6: note = Synthetic Construct
TKAAAK

SEQ ID NO: 18136 - protein, 6 aa, synthetic construct
  REGION 1..6: note = Synthetic Construct
TKAADK

SEQ ID NO: 18137 - protein, 6 aa, synthetic construct
  REGION 1..6: note = Synthetic Construct
TKAAEK

SEQ ID NO: 18138 - protein, 6 aa, synthetic construct
  REGION 1..6: note = Synthetic Construct
TKAAFK

SEQ ID NO: 18139 - protein, 6 aa, synthetic construct
  REGION 1..6: note = Synthetic Construct
TKAAGK

SEQ ID NO: 18140 - protein, 6 aa, synthetic construct
  REGION 1..6: note = Synthetic Construct
TKAAHK

SEQ ID NO: 18141 - protein, 6 aa, synthetic construct
  REGION 1..6: note = Synthetic Construct
TKAAIK

SEQ ID NO: 18142 - protein, 6 aa, synthetic construct
  REGION 1..6: note = Synthetic Construct
TKAALK

SEQ ID NO: 18143 - protein, 6 aa, synthetic construct
  REGION 1..6: note = Synthetic Construct
TKAANK

SEQ ID NO: 18144 - protein, 6 aa, synthetic construct
  REGION 1..6: note = Synthetic Construct
TKAAQK

SEQ ID NO: 18145 - protein, 6 aa, synthetic construct
  REGION 1..6: note = Synthetic Construct
TKAARK

SEQ ID NO: 18146 - protein, 6 aa, synthetic construct
  REGION 1..6: note = Synthetic Construct
TKAASK

SEQ ID NO: 18147 - protein, 6 aa, synthetic construct
  REGION 1..6: note = Synthetic Construct
TKAATK

SEQ ID NO: 18148 - protein, 6 aa, synthetic construct
  REGION 1..6: note = Synthetic Construct
TKAAYK

SEQ ID NO: 18149 - protein, 6 aa, synthetic construct
  REGION 1..6: note = Synthetic Construct
TKADAK

SEQ ID NO: 18150 - protein, 6 aa, synthetic construct
  REGION 1..6: note = Synthetic Construct
TKADDK

SEQ ID NO: 18151 - protein, 6 aa, synthetic construct
  REGION 1..6: note = Synthetic Construct
TKADEK

SEQ ID NO: 18152 - protein, 6 aa, synthetic construct
  REGION 1..6: note = Synthetic Construct
TKADFK

SEQ ID NO: 18153 - protein, 6 aa, synthetic construct
  REGION 1..6: note = Synthetic Construct
TKADGK

SEQ ID NO: 18154 - protein, 6 aa, synthetic construct
  REGION 1..6: note = Synthetic Construct
TKADHK

SEQ ID NO: 18155 - protein, 6 aa, synthetic construct
  REGION 1..6: note = Synthetic Construct
TKADIK

SEQ ID NO: 18156 - protein, 6 aa, synthetic construct
  REGION 1..6: note = Synthetic Construct
TKADLK

SEQ ID NO: 18157 - protein, 6 aa, synthetic construct
  REGION 1..6: note = Synthetic Construct
TKADNK

SEQ ID NO: 18158 - protein, 6 aa, synthetic construct
  REGION 1..6: note = Synthetic Construct
TKADQK

SEQ ID NO: 18159 - protein, 6 aa, synthetic construct
  REGION 1..6: note = Synthetic Construct
TKADRK

SEQ ID NO: 18160 - protein, 6 aa, synthetic construct
  REGION 1..6: note = Synthetic Construct
TKADSK

SEQ ID NO: 18161 - protein, 6 aa, synthetic construct
  REGION 1..6: note = Synthetic Construct
TKADTK

SEQ ID NO: 18162 - protein, 6 aa, synthetic construct
  REGION 1..6: note = Synthetic Construct
TKADYK

SEQ ID NO: 18163 - protein, 6 aa, synthetic construct
  REGION 1..6: note = Synthetic Construct
TKAEAK

SEQ ID NO: 18164 - protein, 6 aa, synthetic construct
  REGION 1..6: note = Synthetic Construct
TKAEDK

SEQ ID NO: 18165 - protein, 6 aa, synthetic construct
  REGION 1..6: note = Synthetic Construct
TKAEEK

SEQ ID NO: 18166 - protein, 6 aa, synthetic construct
  REGION 1..6: note = Synthetic Construct
TKAEFK

SEQ ID NO: 18167 - protein, 6 aa, synthetic construct
  REGION 1..6: note = Synthetic Construct
TKAEGK

SEQ ID NO: 18168 - protein, 6 aa, synthetic construct
  REGION 1..6: note = Synthetic Construct
TKAEHK

SEQ ID NO: 18169 - protein, 6 aa, synthetic construct
  REGION 1..6: note = Synthetic Construct
TKAEIK

SEQ ID NO: 18170 - protein, 6 aa, synthetic construct
  REGION 1..6: note = Synthetic Construct
TKAELK

SEQ ID NO: 18171 - protein, 6 aa, synthetic construct
  REGION 1..6: note = Synthetic Construct
TKAENK

SEQ ID NO: 18172 - protein, 6 aa, synthetic construct
  REGION 1..6: note = Synthetic Construct
TKAEQK

SEQ ID NO: 18173 - protein, 6 aa, synthetic construct
  REGION 1..6: note = Synthetic Construct
TKAERK

SEQ ID NO: 18174 - protein, 6 aa, synthetic construct
  REGION 1..6: note = Synthetic Construct
TKAESK

SEQ ID NO: 18175 - protein, 6 aa, synthetic construct
  REGION 1..6: note = Synthetic Construct
TKAETK

SEQ ID NO: 18176 - protein, 6 aa, synthetic construct
  REGION 1..6: note = Synthetic Construct
TKAEYK

SEQ ID NO: 18177 - protein, 6 aa, synthetic construct
  REGION 1..6: note = Synthetic Construct
TKAFAK

SEQ ID NO: 18178 - protein, 6 aa, synthetic construct
  REGION 1..6: note = Synthetic Construct
TKAFDK

SEQ ID NO: 18179 - protein, 6 aa, synthetic construct
  REGION 1..6: note = Synthetic Construct
TKAFEK

SEQ ID NO: 18180 - protein, 6 aa, synthetic construct
  REGION 1..6: note = Synthetic Construct
TKAFFK

SEQ ID NO: 18181 - protein, 6 aa, synthetic construct
  REGION 1..6: note = Synthetic Construct
TKAFGK

SEQ ID NO: 18182 - protein, 6 aa, synthetic construct
  REGION 1..6: note = Synthetic Construct
TKAFHK

SEQ ID NO: 18183 - protein, 6 aa, synthetic construct
  REGION 1..6: note = Synthetic Construct
TKAFIK

SEQ ID NO: 18184 - protein, 6 aa, synthetic construct
  REGION 1..6: note = Synthetic Construct
TKAFLK

SEQ ID NO: 18185 - protein, 6 aa, synthetic construct
  REGION 1..6: note = Synthetic Construct
TKAFNK

SEQ ID NO: 18186 - protein, 6 aa, synthetic construct
  REGION 1..6: note = Synthetic Construct
TKAFQK

SEQ ID NO: 18187 - protein, 6 aa, synthetic construct
  REGION 1..6: note = Synthetic Construct
TKAFRK

SEQ ID NO: 18188 - protein, 6 aa, synthetic construct
  REGION 1..6: note = Synthetic Construct
TKAFSK

SEQ ID NO: 18189 - protein, 6 aa, synthetic construct
  REGION 1..6: note = Synthetic Construct
TKAFTK

SEQ ID NO: 18190 - protein, 6 aa, synthetic construct
  REGION 1..6: note = Synthetic Construct
TKAFYK

SEQ ID NO: 18191 - protein, 6 aa, synthetic construct
  REGION 1..6: note = Synthetic Construct
TKAGAK

SEQ ID NO: 18192 - protein, 6 aa, synthetic construct
  REGION 1..6: note = Synthetic Construct
TKAGDK

SEQ ID NO: 18193 - protein, 6 aa, synthetic construct
  REGION 1..6: note = Synthetic Construct
TKAGEK

SEQ ID NO: 18194 - protein, 6 aa, synthetic construct
  REGION 1..6: note = Synthetic Construct
TKAGFK

SEQ ID NO: 18195 - protein, 6 aa, synthetic construct
  REGION 1..6: note = Synthetic Construct
TKAGGK

SEQ ID NO: 18196 - protein, 6 aa, synthetic construct
  REGION 1..6: note = Synthetic Construct
TKAGHK

SEQ ID NO: 18197 - protein, 6 aa, synthetic construct
  REGION 1..6: note = Synthetic Construct
TKAGIK

SEQ ID NO: 18198 - protein, 6 aa, synthetic construct
  REGION 1..6: note = Synthetic Construct
TKAGLK

SEQ ID NO: 18199 - protein, 6 aa, synthetic construct
  REGION 1..6: note = Synthetic Construct
TKAGNK

SEQ ID NO: 18200 - protein, 6 aa, synthetic construct
  REGION 1..6: note = Synthetic Construct
TKAGQK

SEQ ID NO: 18201 - protein, 6 aa, synthetic construct
  REGION 1..6: note = Synthetic Construct
TKAGRK

SEQ ID NO: 18202 - protein, 6 aa, synthetic construct
  REGION 1..6: note = Synthetic Construct
TKAGSK

SEQ ID NO: 18203 - protein, 6 aa, synthetic construct
  REGION 1..6: note = Synthetic Construct
TKAGTK

SEQ ID NO: 18204 - protein, 6 aa, synthetic construct
  REGION 1..6: note = Synthetic Construct
TKAGYK

SEQ ID NO: 18205 - protein, 6 aa, synthetic construct
  REGION 1..6: note = Synthetic Construct
TKAHAK

SEQ ID NO: 18206 - protein, 6 aa, synthetic construct
  REGION 1..6: note = Synthetic Construct
TKAHDK

SEQ ID NO: 18207 - protein, 6 aa, synthetic construct
  REGION 1..6: note = Synthetic Construct
TKAHEK

SEQ ID NO: 18208 - protein, 6 aa, synthetic construct
  REGION 1..6: note = Synthetic Construct
TKAHFK

SEQ ID NO: 18209 - protein, 6 aa, synthetic construct
  REGION 1..6: note = Synthetic Construct
TKAHGK

SEQ ID NO: 18210 - protein, 6 aa, synthetic construct
  REGION 1..6: note = Synthetic Construct
TKAHHK

SEQ ID NO: 18211 - protein, 6 aa, synthetic construct
  REGION 1..6: note = Synthetic Construct
TKAHIK

SEQ ID NO: 18212 - protein, 6 aa, synthetic construct
  REGION 1..6: note = Synthetic Construct
TKAHLK

SEQ ID NO: 18213 - protein, 6 aa, synthetic construct
  REGION 1..6: note = Synthetic Construct
TKAHNK

SEQ ID NO: 18214 - protein, 6 aa, synthetic construct
  REGION 1..6: note = Synthetic Construct
TKAHQK

SEQ ID NO: 18215 - protein, 6 aa, synthetic construct
  REGION 1..6: note = Synthetic Construct
TKAHRK

SEQ ID NO: 18216 - protein, 6 aa, synthetic construct
  REGION 1..6: note = Synthetic Construct
TKAHSK

SEQ ID NO: 18217 - protein, 6 aa, synthetic construct
  REGION 1..6: note = Synthetic Construct
TKAHTK

SEQ ID NO: 18218 - protein, 6 aa, synthetic construct
  REGION 1..6: note = Synthetic Construct
TKAHYK

SEQ ID NO: 18219 - protein, 6 aa, synthetic construct
  REGION 1..6: note = Synthetic Construct
TKAIAK

SEQ ID NO: 18220 - protein, 6 aa, synthetic construct
  REGION 1..6: note = Synthetic Construct
TKAIDK

SEQ ID NO: 18221 - protein, 6 aa, synthetic construct
  REGION 1..6: note = Synthetic Construct
TKAIEK

SEQ ID NO: 18222 - protein, 6 aa, synthetic construct
  REGION 1..6: note = Synthetic Construct
TKAIFK

SEQ ID NO: 18223 - protein, 6 aa, synthetic construct
  REGION 1..6: note = Synthetic Construct
TKAIGK

SEQ ID NO: 18224 - protein, 6 aa, synthetic construct
  REGION 1..6: note = Synthetic Construct
TKAIHK

SEQ ID NO: 18225 - protein, 6 aa, synthetic construct
  REGION 1..6: note = Synthetic Construct
TKAIIK

SEQ ID NO: 18226 - protein, 6 aa, synthetic construct
  REGION 1..6: note = Synthetic Construct
TKAILK

SEQ ID NO: 18227 - protein, 6 aa, synthetic construct
  REGION 1..6: note = Synthetic Construct
TKAINK

SEQ ID NO: 18228 - protein, 6 aa, synthetic construct
  REGION 1..6: note = Synthetic Construct
TKAIQK

SEQ ID NO: 18229 - protein, 6 aa, synthetic construct
  REGION 1..6: note = Synthetic Construct
TKAIRK

SEQ ID NO: 18230 - protein, 6 aa, synthetic construct
  REGION 1..6: note = Synthetic Construct
TKAISK

SEQ ID NO: 18231 - protein, 6 aa, synthetic construct
  REGION 1..6: note = Synthetic Construct
TKAITK

SEQ ID NO: 18232 - protein, 6 aa, synthetic construct
  REGION 1..6: note = Synthetic Construct
TKAIYK

SEQ ID NO: 18233 - protein, 6 aa, synthetic construct
  REGION 1..6: note = Synthetic Construct
TKALAK

SEQ ID NO: 18234 - protein, 6 aa, synthetic construct
  REGION 1..6: note = Synthetic Construct
TKALDK

SEQ ID NO: 18235 - protein, 6 aa, synthetic construct
  REGION 1..6: note = Synthetic Construct
TKALEK

SEQ ID NO: 18236 - protein, 6 aa, synthetic construct
  REGION 1..6: note = Synthetic Construct
TKALFK

SEQ ID NO: 18237 - protein, 6 aa, synthetic construct
  REGION 1..6: note = Synthetic Construct
TKALGK

SEQ ID NO: 18238 - protein, 6 aa, synthetic construct
  REGION 1..6: note = Synthetic Construct
TKALHK

SEQ ID NO: 18239 - protein, 6 aa, synthetic construct
  REGION 1..6: note = Synthetic Construct
TKALIK

SEQ ID NO: 18240 - protein, 6 aa, synthetic construct
  REGION 1..6: note = Synthetic Construct
TKALLK

SEQ ID NO: 18241 - protein, 6 aa, synthetic construct
  REGION 1..6: note = Synthetic Construct
TKALNK

SEQ ID NO: 18242 - protein, 6 aa, synthetic construct
  REGION 1..6: note = Synthetic Construct
TKALQK

SEQ ID NO: 18243 - protein, 6 aa, synthetic construct
  REGION 1..6: note = Synthetic Construct
TKALRK

SEQ ID NO: 18244 - protein, 6 aa, synthetic construct
  REGION 1..6: note = Synthetic Construct
TKALSK

SEQ ID NO: 18245 - protein, 6 aa, synthetic construct
  REGION 1..6: note = Synthetic Construct
TKALTK

SEQ ID NO: 18246 - protein, 6 aa, synthetic construct
  REGION 1..6: note = Synthetic Construct
TKALYK

SEQ ID NO: 18247 - protein, 6 aa, synthetic construct
  REGION 1..6: note = Synthetic Construct
TKANAK

SEQ ID NO: 18248 - protein, 6 aa, synthetic construct
  REGION 1..6: note = Synthetic Construct
TKANDK

SEQ ID NO: 18249 - protein, 6 aa, synthetic construct
  REGION 1..6: note = Synthetic Construct
TKANEK

SEQ ID NO: 18250 - protein, 6 aa, synthetic construct
  REGION 1..6: note = Synthetic Construct
TKANFK

SEQ ID NO: 18251 - protein, 6 aa, synthetic construct
  REGION 1..6: note = Synthetic Construct
TKANGK

SEQ ID NO: 18252 - protein, 6 aa, synthetic construct
  REGION 1..6: note = Synthetic Construct
TKANHK

SEQ ID NO: 18253 - protein, 6 aa, synthetic construct
  REGION 1..6: note = Synthetic Construct
TKANIK

SEQ ID NO: 18254 - protein, 6 aa, synthetic construct
  REGION 1..6: note = Synthetic Construct
TKANLK

SEQ ID NO: 18255 - protein, 6 aa, synthetic construct
  REGION 1..6: note = Synthetic Construct
TKANNK

SEQ ID NO: 18256 - protein, 6 aa, synthetic construct
  REGION 1..6: note = Synthetic Construct
TKANQK

SEQ ID NO: 18257 - protein, 6 aa, synthetic construct
  REGION 1..6: note = Synthetic Construct
TKANRK

SEQ ID NO: 18258 - protein, 6 aa, synthetic construct
  REGION 1..6: note = Synthetic Construct
TKANSK

SEQ ID NO: 18259 - protein, 6 aa, synthetic construct
  REGION 1..6: note = Synthetic Construct
TKANTK

SEQ ID NO: 18260 - protein, 6 aa, synthetic construct
  REGION 1..6: note = Synthetic Construct
TKANYK

SEQ ID NO: 18261 - protein, 6 aa, synthetic construct
  REGION 1..6: note = Synthetic Construct
TKAQAK

SEQ ID NO: 18262 - protein, 6 aa, synthetic construct
  REGION 1..6: note = Synthetic Construct
TKAQDK

SEQ ID NO: 18263 - protein, 6 aa, synthetic construct
  REGION 1..6: note = Synthetic Construct
TKAQEK

SEQ ID NO: 18264 - protein, 6 aa, synthetic construct
  REGION 1..6: note = Synthetic Construct
TKAQFK

SEQ ID NO: 18265 - protein, 6 aa, synthetic construct
  REGION 1..6: note = Synthetic Construct
TKAQGK

SEQ ID NO: 18266 - protein, 6 aa, synthetic construct
  REGION 1..6: note = Synthetic Construct
TKAQHK

SEQ ID NO: 18267 - protein, 6 aa, synthetic construct
  REGION 1..6: note = Synthetic Construct
TKAQIK

SEQ ID NO: 18268 - protein, 6 aa, synthetic construct
  REGION 1..6: note = Synthetic Construct
TKAQLK

SEQ ID NO: 18269 - protein, 6 aa, synthetic construct
  REGION 1..6: note = Synthetic Construct
TKAQNK

SEQ ID NO: 18270 - protein, 6 aa, synthetic construct
  REGION 1..6: note = Synthetic Construct
TKAQQK

SEQ ID NO: 18271 - protein, 6 aa, synthetic construct
  REGION 1..6: note = Synthetic Construct
TKAQRK

SEQ ID NO: 18272 - protein, 6 aa, synthetic construct
  REGION 1..6: note = Synthetic Construct
TKAQSK

SEQ ID NO: 18273 - protein, 6 aa, synthetic construct
  REGION 1..6: note = Synthetic Construct
TKAQTK

SEQ ID NO: 18274 - protein, 6 aa, synthetic construct
  REGION 1..6: note = Synthetic Construct
TKAQYK

SEQ ID NO: 18275 - protein, 6 aa, synthetic construct
  REGION 1..6: note = Synthetic Construct
TKARAK

SEQ ID NO: 18276 - protein, 6 aa, synthetic construct
  REGION 1..6: note = Synthetic Construct
TKARDK

SEQ ID NO: 18277 - protein, 6 aa, synthetic construct
  REGION 1..6: note = Synthetic Construct
TKAREK

SEQ ID NO: 18278 - protein, 6 aa, synthetic construct
  REGION 1..6: note = Synthetic Construct
TKARFK

SEQ ID NO: 18279 - protein, 6 aa, synthetic construct
  REGION 1..6: note = Synthetic Construct
TKARGK

SEQ ID NO: 18280 - protein, 6 aa, synthetic construct
  REGION 1..6: note = Synthetic Construct
TKARHK

SEQ ID NO: 18281 - protein, 6 aa, synthetic construct
  REGION 1..6: note = Synthetic Construct
TKARIK

SEQ ID NO: 18282 - protein, 6 aa, synthetic construct
  REGION 1..6: note = Synthetic Construct
TKARLK

SEQ ID NO: 18283 - protein, 6 aa, synthetic construct
  REGION 1..6: note = Synthetic Construct
TKARNK

SEQ ID NO: 18284 - protein, 6 aa, synthetic construct
  REGION 1..6: note = Synthetic Construct
TKARQK

SEQ ID NO: 18285 - protein, 6 aa, synthetic construct
  REGION 1..6: note = Synthetic Construct
TKARRK

SEQ ID NO: 18286 - protein, 6 aa, synthetic construct
  REGION 1..6: note = Synthetic Construct
TKARSK

SEQ ID NO: 18287 - protein, 6 aa, synthetic construct
  REGION 1..6: note = Synthetic Construct
TKARTK

SEQ ID NO: 18288 - protein, 6 aa, synthetic construct
  REGION 1..6: note = Synthetic Construct
TKARYK

SEQ ID NO: 18289 - protein, 6 aa, synthetic construct
  REGION 1..6: note = Synthetic Construct
TKASAK

SEQ ID NO: 18290 - protein, 6 aa, synthetic construct
  REGION 1..6: note = Synthetic Construct
TKASDK

SEQ ID NO: 18291 - protein, 6 aa, synthetic construct
  REGION 1..6: note = Synthetic Construct
TKASEK

SEQ ID NO: 18292 - protein, 6 aa, synthetic construct
  REGION 1..6: note = Synthetic Construct
TKASFK

SEQ ID NO: 18293 - protein, 6 aa, synthetic construct
  REGION 1..6: note = Synthetic Construct
TKASGK

SEQ ID NO: 18294 - protein, 6 aa, synthetic construct
  REGION 1..6: note = Synthetic Construct
TKASHK

SEQ ID NO: 18295 - protein, 6 aa, synthetic construct
  REGION 1..6: note = Synthetic Construct
TKASIK

SEQ ID NO: 18296 - protein, 6 aa, synthetic construct
  REGION 1..6: note = Synthetic Construct
TKASLK

SEQ ID NO: 18297 - protein, 6 aa, synthetic construct
  REGION 1..6: note = Synthetic Construct
TKASNK

SEQ ID NO: 18298 - protein, 6 aa, synthetic construct
  REGION 1..6: note = Synthetic Construct
TKASQK

SEQ ID NO: 18299 - protein, 6 aa, synthetic construct
  REGION 1..6: note = Synthetic Construct
TKASRK

SEQ ID NO: 18300 - protein, 6 aa, synthetic construct
  REGION 1..6: note = Synthetic Construct
TKASSK

SEQ ID NO: 18301 - protein, 6 aa, synthetic construct
  REGION 1..6: note = Synthetic Construct
TKASTK

SEQ ID NO: 18302 - protein, 6 aa, synthetic construct
  REGION 1..6: note = Synthetic Construct
TKASYK

SEQ ID NO: 18303 - protein, 6 aa, synthetic construct
  REGION 1..6: note = Synthetic Construct
TKATAK

SEQ ID NO: 18304 - protein, 6 aa, synthetic construct
  REGION 1..6: note = Synthetic Construct
TKATDK

SEQ ID NO: 18305 - protein, 6 aa, synthetic construct
  REGION 1..6: note = Synthetic Construct
TKATEK

SEQ ID NO: 18306 - protein, 6 aa, synthetic construct
  REGION 1..6: note = Synthetic Construct
TKATFK

SEQ ID NO: 18307 - protein, 6 aa, synthetic construct
  REGION 1..6: note = Synthetic Construct
TKATGK

SEQ ID NO: 18308 - protein, 6 aa, synthetic construct
  REGION 1..6: note = Synthetic Construct
TKATHK

SEQ ID NO: 18309 - protein, 6 aa, synthetic construct
  REGION 1..6: note = Synthetic Construct
TKATIK

SEQ ID NO: 18310 - protein, 6 aa, synthetic construct
  REGION 1..6: note = Synthetic Construct
TKATLK

SEQ ID NO: 18311 - protein, 6 aa, synthetic construct
  REGION 1..6: note = Synthetic Construct
TKATNK

SEQ ID NO: 18312 - protein, 6 aa, synthetic construct
  REGION 1..6: note = Synthetic Construct
TKATQK

SEQ ID NO: 18313 - protein, 6 aa, synthetic construct
  REGION 1..6: note = Synthetic Construct
TKATRK

SEQ ID NO: 18314 - protein, 6 aa, synthetic construct
  REGION 1..6: note = Synthetic Construct
TKATSK

SEQ ID NO: 18315 - protein, 6 aa, synthetic construct
  REGION 1..6: note = Synthetic Construct
TKATTK

SEQ ID NO: 18316 - protein, 6 aa, synthetic construct
  REGION 1..6: note = Synthetic Construct
TKATYK

SEQ ID NO: 18317 - protein, 6 aa, synthetic construct
  REGION 1..6: note = Synthetic Construct
TKAYAK

SEQ ID NO: 18318 - protein, 6 aa, synthetic construct
  REGION 1..6: note = Synthetic Construct
TKAYDK

SEQ ID NO: 18319 - protein, 6 aa, synthetic construct
  REGION 1..6: note = Synthetic Construct
TKAYEK

SEQ ID NO: 18320 - protein, 6 aa, synthetic construct
  REGION 1..6: note = Synthetic Construct
TKAYFK

SEQ ID NO: 18321 - protein, 6 aa, synthetic construct
  REGION 1..6: note = Synthetic Construct
TKAYGK

SEQ ID NO: 18322 - protein, 6 aa, synthetic construct
  REGION 1..6: note = Synthetic Construct
TKAYHK

SEQ ID NO: 18323 - protein, 6 aa, synthetic construct
  REGION 1..6: note = Synthetic Construct
TKAYIK

SEQ ID NO: 18324 - protein, 6 aa, synthetic construct
  REGION 1..6: note = Synthetic Construct
TKAYLK

SEQ ID NO: 18325 - protein, 6 aa, synthetic construct
  REGION 1..6: note = Synthetic Construct
TKAYNK

SEQ ID NO: 18326 - protein, 6 aa, synthetic construct
  REGION 1..6: note = Synthetic Construct
TKAYQK

SEQ ID NO: 18327 - protein, 6 aa, synthetic construct
  REGION 1..6: note = Synthetic Construct
TKAYRK

SEQ ID NO: 18328 - protein, 6 aa, synthetic construct
  REGION 1..6: note = Synthetic Construct
TKAYSK

SEQ ID NO: 18329 - protein, 6 aa, synthetic construct
  REGION 1..6: note = Synthetic Construct
TKAYTK

SEQ ID NO: 18330 - protein, 6 aa, synthetic construct
  REGION 1..6: note = Synthetic Construct
TKAYYK

SEQ ID NO: 18331 - protein, 6 aa, synthetic construct
  REGION 1..6: note = Synthetic Construct
TKDAAK

SEQ ID NO: 18332 - protein, 6 aa, synthetic construct
  REGION 1..6: note = Synthetic Construct
TKDADK

SEQ ID NO: 18333 - protein, 6 aa, synthetic construct
  REGION 1..6: note = Synthetic Construct
TKDAEK

SEQ ID NO: 18334 - protein, 6 aa, synthetic construct
  REGION 1..6: note = Synthetic Construct
TKDAFK

SEQ ID NO: 18335 - protein, 6 aa, synthetic construct
  REGION 1..6: note = Synthetic Construct
TKDAGK

SEQ ID NO: 18336 - protein, 6 aa, synthetic construct
  REGION 1..6: note = Synthetic Construct
TKDAHK

SEQ ID NO: 18337 - protein, 6 aa, synthetic construct
  REGION 1..6: note = Synthetic Construct
TKDAIK

SEQ ID NO: 18338 - protein, 6 aa, synthetic construct
  REGION 1..6: note = Synthetic Construct
TKDALK

SEQ ID NO: 18339 - protein, 6 aa, synthetic construct
  REGION 1..6: note = Synthetic Construct
TKDANK

SEQ ID NO: 18340 - protein, 6 aa, synthetic construct
  REGION 1..6: note = Synthetic Construct
TKDAQK

SEQ ID NO: 18341 - protein, 6 aa, synthetic construct
  REGION 1..6: note = Synthetic Construct
TKDARK

SEQ ID NO: 18342 - protein, 6 aa, synthetic construct
  REGION 1..6: note = Synthetic Construct
TKDASK

SEQ ID NO: 18343 - protein, 6 aa, synthetic construct
  REGION 1..6: note = Synthetic Construct
TKDATK

SEQ ID NO: 18344 - protein, 6 aa, synthetic construct
  REGION 1..6: note = Synthetic Construct
TKDAYK

SEQ ID NO: 18345 - protein, 6 aa, synthetic construct
  REGION 1..6: note = Synthetic Construct
TKDDAK

SEQ ID NO: 18346 - protein, 6 aa, synthetic construct
  REGION 1..6: note = Synthetic Construct
TKDDDK

SEQ ID NO: 18347 - protein, 6 aa, synthetic construct
  REGION 1..6: note = Synthetic Construct
TKDDEK

SEQ ID NO: 18348 - protein, 6 aa, synthetic construct
  REGION 1..6: note = Synthetic Construct
TKDDFK

SEQ ID NO: 18349 - protein, 6 aa, synthetic construct
  REGION 1..6: note = Synthetic Construct
TKDDGK

SEQ ID NO: 18350 - protein, 6 aa, synthetic construct
  REGION 1..6: note = Synthetic Construct
TKDDHK

SEQ ID NO: 18351 - protein, 6 aa, synthetic construct
  REGION 1..6: note = Synthetic Construct
TKDDIK

SEQ ID NO: 18352 - protein, 6 aa, synthetic construct
  REGION 1..6: note = Synthetic Construct
TKDDLK

SEQ ID NO: 18353 - protein, 6 aa, synthetic construct
  REGION 1..6: note = Synthetic Construct
TKDDNK

SEQ ID NO: 18354 - protein, 6 aa, synthetic construct
  REGION 1..6: note = Synthetic Construct
TKDDQK

SEQ ID NO: 18355 - protein, 6 aa, synthetic construct
  REGION 1..6: note = Synthetic Construct
TKDDRK

SEQ ID NO: 18356 - protein, 6 aa, synthetic construct
  REGION 1..6: note = Synthetic Construct
TKDDSK

SEQ ID NO: 18357 - protein, 6 aa, synthetic construct
  REGION 1..6: note = Synthetic Construct
TKDDTK

SEQ ID NO: 18358 - protein, 6 aa, synthetic construct
  REGION 1..6: note = Synthetic Construct
TKDDYK

SEQ ID NO: 18359 - protein, 6 aa, synthetic construct
  REGION 1..6: note = Synthetic Construct
TKDEAK

SEQ ID NO: 18360 - protein, 6 aa, synthetic construct
  REGION 1..6: note = Synthetic Construct
TKDEDK

SEQ ID NO: 18361 - protein, 6 aa, synthetic construct
  REGION 1..6: note = Synthetic Construct
TKDEEK

SEQ ID NO: 18362 - protein, 6 aa, synthetic construct
  REGION 1..6: note = Synthetic Construct
TKDEFK

SEQ ID NO: 18363 - protein, 6 aa, synthetic construct
  REGION 1..6: note = Synthetic Construct
TKDEGK

SEQ ID NO: 18364 - protein, 6 aa, synthetic construct
  REGION 1..6: note = Synthetic Construct
TKDEHK

SEQ ID NO: 18365 - protein, 6 aa, synthetic construct
  REGION 1..6: note = Synthetic Construct
TKDEIK

SEQ ID NO: 18366 - protein, 6 aa, synthetic construct
  REGION 1..6: note = Synthetic Construct
TKDELK

SEQ ID NO: 18367 - protein, 6 aa, synthetic construct
  REGION 1..6: note = Synthetic Construct
TKDENK

SEQ ID NO: 18368 - protein, 6 aa, synthetic construct
  REGION 1..6: note = Synthetic Construct
TKDEQK

SEQ ID NO: 18369 - protein, 6 aa, synthetic construct
  REGION 1..6: note = Synthetic Construct
TKDERK

SEQ ID NO: 18370 - protein, 6 aa, synthetic construct
  REGION 1..6: note = Synthetic Construct
TKDESK

SEQ ID NO: 18371 - protein, 6 aa, synthetic construct
  REGION 1..6: note = Synthetic Construct
TKDETK

SEQ ID NO: 18372 - protein, 6 aa, synthetic construct
  REGION 1..6: note = Synthetic Construct
TKDEYK

SEQ ID NO: 18373 - protein, 6 aa, synthetic construct
  REGION 1..6: note = Synthetic Construct
TKDFAK

SEQ ID NO: 18374 - protein, 6 aa, synthetic construct
  REGION 1..6: note = Synthetic Construct
TKDFDK

SEQ ID NO: 18375 - protein, 6 aa, synthetic construct
  REGION 1..6: note = Synthetic Construct
TKDFEK

SEQ ID NO: 18376 - protein, 6 aa, synthetic construct
  REGION 1..6: note = Synthetic Construct
TKDFFK

SEQ ID NO: 18377 - protein, 6 aa, synthetic construct
  REGION 1..6: note = Synthetic Construct
TKDFGK

SEQ ID NO: 18378 - protein, 6 aa, synthetic construct
  REGION 1..6: note = Synthetic Construct
TKDFHK

SEQ ID NO: 18379 - protein, 6 aa, synthetic construct
  REGION 1..6: note = Synthetic Construct
TKDFIK

SEQ ID NO: 18380 - protein, 6 aa, synthetic construct
  REGION 1..6: note = Synthetic Construct
TKDFLK

SEQ ID NO: 18381 - protein, 6 aa, synthetic construct
  REGION 1..6: note = Synthetic Construct
TKDFNK

SEQ ID NO: 18382 - protein, 6 aa, synthetic construct
  REGION 1..6: note = Synthetic Construct
TKDFQK

SEQ ID NO: 18383 - protein, 6 aa, synthetic construct
  REGION 1..6: note = Synthetic Construct
TKDFRK

SEQ ID NO: 18384 - protein, 6 aa, synthetic construct
  REGION 1..6: note = Synthetic Construct
TKDFSK

SEQ ID NO: 18385 - protein, 6 aa, synthetic construct
  REGION 1..6: note = Synthetic Construct
TKDFTK

SEQ ID NO: 18386 - protein, 6 aa, synthetic construct
  REGION 1..6: note = Synthetic Construct
TKDFYK

SEQ ID NO: 18387 - protein, 6 aa, synthetic construct
  REGION 1..6: note = Synthetic Construct
TKDGAK

SEQ ID NO: 18388 - protein, 6 aa, synthetic construct
  REGION 1..6: note = Synthetic Construct
TKDGDK

SEQ ID NO: 18389 - protein, 6 aa, synthetic construct
  REGION 1..6: note = Synthetic Construct
TKDGEK

SEQ ID NO: 18390 - protein, 6 aa, synthetic construct
  REGION 1..6: note = Synthetic Construct
TKDGFK

SEQ ID NO: 18391 - protein, 6 aa, synthetic construct
  REGION 1..6: note = Synthetic Construct
TKDGGK

SEQ ID NO: 18392 - protein, 6 aa, synthetic construct
  REGION 1..6: note = Synthetic Construct
TKDGHK

SEQ ID NO: 18393 - protein, 6 aa, synthetic construct
  REGION 1..6: note = Synthetic Construct
TKDGIK

SEQ ID NO: 18394 - protein, 6 aa, synthetic construct
  REGION 1..6: note = Synthetic Construct
TKDGLK

SEQ ID NO: 18395 - protein, 6 aa, synthetic construct
  REGION 1..6: note = Synthetic Construct
TKDGNK

SEQ ID NO: 18396 - protein, 6 aa, synthetic construct
  REGION 1..6: note = Synthetic Construct
TKDGQK

SEQ ID NO: 18397 - protein, 6 aa, synthetic construct
  REGION 1..6: note = Synthetic Construct
TKDGRK

SEQ ID NO: 18398 - protein, 6 aa, synthetic construct
  REGION 1..6: note = Synthetic Construct
TKDGSK

SEQ ID NO: 18399 - protein, 6 aa, synthetic construct
  REGION 1..6: note = Synthetic Construct
TKDGTK

SEQ ID NO: 18400 - protein, 6 aa, synthetic construct
  REGION 1..6: note = Synthetic Construct
TKDGYK

SEQ ID NO: 18401 - protein, 6 aa, synthetic construct
  REGION 1..6: note = Synthetic Construct
TKDHAK

SEQ ID NO: 18402 - protein, 6 aa, synthetic construct
  REGION 1..6: note = Synthetic Construct
TKDHDK

SEQ ID NO: 18403 - protein, 6 aa, synthetic construct
  REGION 1..6: note = Synthetic Construct
TKDHEK

SEQ ID NO: 18404 - protein, 6 aa, synthetic construct
  REGION 1..6: note = Synthetic Construct
TKDHFK

SEQ ID NO: 18405 - protein, 6 aa, synthetic construct
  REGION 1..6: note = Synthetic Construct
TKDHGK

SEQ ID NO: 18406 - protein, 6 aa, synthetic construct
  REGION 1..6: note = Synthetic Construct
TKDHHK

SEQ ID NO: 18407 - protein, 6 aa, synthetic construct
  REGION 1..6: note = Synthetic Construct
TKDHIK

SEQ ID NO: 18408 - protein, 6 aa, synthetic construct
  REGION 1..6: note = Synthetic Construct
TKDHLK

SEQ ID NO: 18409 - protein, 6 aa, synthetic construct
  REGION 1..6: note = Synthetic Construct
TKDHNK

SEQ ID NO: 18410 - protein, 6 aa, synthetic construct
  REGION 1..6: note = Synthetic Construct
TKDHQK

SEQ ID NO: 18411 - protein, 6 aa, synthetic construct
  REGION 1..6: note = Synthetic Construct
TKDHRK

SEQ ID NO: 18412 - protein, 6 aa, synthetic construct
  REGION 1..6: note = Synthetic Construct
TKDHSK

SEQ ID NO: 18413 - protein, 6 aa, synthetic construct
  REGION 1..6: note = Synthetic Construct
TKDHTK

SEQ ID NO: 18414 - protein, 6 aa, synthetic construct
  REGION 1..6: note = Synthetic Construct
TKDHYK

SEQ ID NO: 18415 - protein, 6 aa, synthetic construct
  REGION 1..6: note = Synthetic Construct
TKDIAK

SEQ ID NO: 18416 - protein, 6 aa, synthetic construct
  REGION 1..6: note = Synthetic Construct
TKDIDK

SEQ ID NO: 18417 - protein, 6 aa, synthetic construct
  REGION 1..6: note = Synthetic Construct
TKDIEK

SEQ ID NO: 18418 - protein, 6 aa, synthetic construct
  REGION 1..6: note = Synthetic Construct
TKDIFK

SEQ ID NO: 18419 - protein, 6 aa, synthetic construct
  REGION 1..6: note = Synthetic Construct
TKDIGK

SEQ ID NO: 18420 - protein, 6 aa, synthetic construct
  REGION 1..6: note = Synthetic Construct
TKDIHK

SEQ ID NO: 18421 - protein, 6 aa, synthetic construct
  REGION 1..6: note = Synthetic Construct
TKDIIK

SEQ ID NO: 18422 - protein, 6 aa, synthetic construct
  REGION 1..6: note = Synthetic Construct
TKDILK

SEQ ID NO: 18423 - protein, 6 aa, synthetic construct
  REGION 1..6: note = Synthetic Construct
TKDINK

SEQ ID NO: 18424 - protein, 6 aa, synthetic construct
  REGION 1..6: note = Synthetic Construct
TKDIQK

SEQ ID NO: 18425 - protein, 6 aa, synthetic construct
  REGION 1..6: note = Synthetic Construct
TKDIRK

SEQ ID NO: 18426 - protein, 6 aa, synthetic construct
  REGION 1..6: note = Synthetic Construct
TKDISK

SEQ ID NO: 18427 - protein, 6 aa, synthetic construct
  REGION 1..6: note = Synthetic Construct
TKDITK

SEQ ID NO: 18428 - protein, 6 aa, synthetic construct
  REGION 1..6: note = Synthetic Construct
TKDIYK

SEQ ID NO: 18429 - protein, 6 aa, synthetic construct
  REGION 1..6: note = Synthetic Construct
TKDLAK

SEQ ID NO: 18430 - protein, 6 aa, synthetic construct
  REGION 1..6: note = Synthetic Construct
TKDLDK

SEQ ID NO: 18431 - protein, 6 aa, synthetic construct
  REGION 1..6: note = Synthetic Construct
TKDLEK

SEQ ID NO: 18432 - protein, 6 aa, synthetic construct
  REGION 1..6: note = Synthetic Construct
TKDLFK

SEQ ID NO: 18433 - protein, 6 aa, synthetic construct
  REGION 1..6: note = Synthetic Construct
TKDLGK

SEQ ID NO: 18434 - protein, 6 aa, synthetic construct
  REGION 1..6: note = Synthetic Construct
TKDLHK

SEQ ID NO: 18435 - protein, 6 aa, synthetic construct
  REGION 1..6: note = Synthetic Construct
TKDLIK

SEQ ID NO: 18436 - protein, 6 aa, synthetic construct
  REGION 1..6: note = Synthetic Construct
TKDLLK

SEQ ID NO: 18437 - protein, 6 aa, synthetic construct
  REGION 1..6: note = Synthetic Construct
TKDLNK

SEQ ID NO: 18438 - protein, 6 aa, synthetic construct
  REGION 1..6: note = Synthetic Construct
TKDLQK

SEQ ID NO: 18439 - protein, 6 aa, synthetic construct
  REGION 1..6: note = Synthetic Construct
TKDLRK

SEQ ID NO: 18440 - protein, 6 aa, synthetic construct
  REGION 1..6: note = Synthetic Construct
TKDLSK

SEQ ID NO: 18441 - protein, 6 aa, synthetic construct
  REGION 1..6: note = Synthetic Construct
TKDLTK

SEQ ID NO: 18442 - protein, 6 aa, synthetic construct
  REGION 1..6: note = Synthetic Construct
TKDLYK

SEQ ID NO: 18443 - protein, 6 aa, synthetic construct
  REGION 1..6: note = Synthetic Construct
TKDNAK

SEQ ID NO: 18444 - protein, 6 aa, synthetic construct
  REGION 1..6: note = Synthetic Construct
TKDNDK

SEQ ID NO: 18445 - protein, 6 aa, synthetic construct
  REGION 1..6: note = Synthetic Construct
TKDNEK

SEQ ID NO: 18446 - protein, 6 aa, synthetic construct
  REGION 1..6: note = Synthetic Construct
TKDNFK

SEQ ID NO: 18447 - protein, 6 aa, synthetic construct
  REGION 1..6: note = Synthetic Construct
TKDNGK

SEQ ID NO: 18448 - protein, 6 aa, synthetic construct
  REGION 1..6: note = Synthetic Construct
TKDNHK

SEQ ID NO: 18449 - protein, 6 aa, synthetic construct
  REGION 1..6: note = Synthetic Construct
TKDNIK

SEQ ID NO: 18450 - protein, 6 aa, synthetic construct
  REGION 1..6: note = Synthetic Construct
TKDNLK

SEQ ID NO: 18451 - protein, 6 aa, synthetic construct
  REGION 1..6: note = Synthetic Construct
TKDNNK

SEQ ID NO: 18452 - protein, 6 aa, synthetic construct
  REGION 1..6: note = Synthetic Construct
TKDNQK

SEQ ID NO: 18453 - protein, 6 aa, synthetic construct
  REGION 1..6: note = Synthetic Construct
TKDNRK

SEQ ID NO: 18454 - protein, 6 aa, synthetic construct
  REGION 1..6: note = Synthetic Construct
TKDNSK

SEQ ID NO: 18455 - protein, 6 aa, synthetic construct
  REGION 1..6: note = Synthetic Construct
TKDNTK

SEQ ID NO: 18456 - protein, 6 aa, synthetic construct
  REGION 1..6: note = Synthetic Construct
TKDNYK

SEQ ID NO: 18457 - protein, 6 aa, synthetic construct
  REGION 1..6: note = Synthetic Construct
TKDQAK

SEQ ID NO: 18458 - protein, 6 aa, synthetic construct
  REGION 1..6: note = Synthetic Construct
TKDQDK

SEQ ID NO: 18459 - protein, 6 aa, synthetic construct
  REGION 1..6: note = Synthetic Construct
TKDQEK

SEQ ID NO: 18460 - protein, 6 aa, synthetic construct
  REGION 1..6: note = Synthetic Construct
TKDQFK

SEQ ID NO: 18461 - protein, 6 aa, synthetic construct
  REGION 1..6: note = Synthetic Construct
TKDQGK

SEQ ID NO: 18462 - protein, 6 aa, synthetic construct
  REGION 1..6: note = Synthetic Construct
TKDQHK

SEQ ID NO: 18463 - protein, 6 aa, synthetic construct
  REGION 1..6: note = Synthetic Construct
TKDQIK

SEQ ID NO: 18464 - protein, 6 aa, synthetic construct
  REGION 1..6: note = Synthetic Construct
TKDQLK

SEQ ID NO: 18465 - protein, 6 aa, synthetic construct
  REGION 1..6: note = Synthetic Construct
TKDQNK

SEQ ID NO: 18466 - protein, 6 aa, synthetic construct
  REGION 1..6: note = Synthetic Construct
TKDQQK

SEQ ID NO: 18467 - protein, 6 aa, synthetic construct
  REGION 1..6: note = Synthetic Construct
TKDQRK

SEQ ID NO: 18468 - protein, 6 aa, synthetic construct
  REGION 1..6: note = Synthetic Construct
TKDQSK

SEQ ID NO: 18469 - protein, 6 aa, synthetic construct
  REGION 1..6: note = Synthetic Construct
TKDQTK

SEQ ID NO: 18470 - protein, 6 aa, synthetic construct
  REGION 1..6: note = Synthetic Construct
TKDQYK

SEQ ID NO: 18471 - protein, 6 aa, synthetic construct
  REGION 1..6: note = Synthetic Construct
TKDRAK

SEQ ID NO: 18472 - protein, 6 aa, synthetic construct
  REGION 1..6: note = Synthetic Construct
TKDRDK

SEQ ID NO: 18473 - protein, 6 aa, synthetic construct
  REGION 1..6: note = Synthetic Construct
TKDREK

SEQ ID NO: 18474 - protein, 6 aa, synthetic construct
  REGION 1..6: note = Synthetic Construct
TKDRFK

SEQ ID NO: 18475 - protein, 6 aa, synthetic construct
  REGION 1..6: note = Synthetic Construct
TKDRGK

SEQ ID NO: 18476 - protein, 6 aa, synthetic construct
  REGION 1..6: note = Synthetic Construct
TKDRHK

SEQ ID NO: 18477 - protein, 6 aa, synthetic construct
  REGION 1..6: note = Synthetic Construct
TKDRIK

SEQ ID NO: 18478 - protein, 6 aa, synthetic construct
  REGION 1..6: note = Synthetic Construct
TKDRLK

SEQ ID NO: 18479 - protein, 6 aa, synthetic construct
  REGION 1..6: note = Synthetic Construct
TKDRNK

SEQ ID NO: 18480 - protein, 6 aa, synthetic construct
  REGION 1..6: note = Synthetic Construct
TKDRQK

SEQ ID NO: 18481 - protein, 6 aa, synthetic construct
  REGION 1..6: note = Synthetic Construct
TKDRRK

SEQ ID NO: 18482 - protein, 6 aa, synthetic construct
  REGION 1..6: note = Synthetic Construct
TKDRSK

SEQ ID NO: 18483 - protein, 6 aa, synthetic construct
  REGION 1..6: note = Synthetic Construct
TKDRTK

SEQ ID NO: 18484 - protein, 6 aa, synthetic construct
  REGION 1..6: note = Synthetic Construct
TKDRYK

SEQ ID NO: 18485 - protein, 6 aa, synthetic construct
  REGION 1..6: note = Synthetic Construct
TKDSAK

SEQ ID NO: 18486 - protein, 6 aa, synthetic construct
  REGION 1..6: note = Synthetic Construct
TKDSDK

SEQ ID NO: 18487 - protein, 6 aa, synthetic construct
  REGION 1..6: note = Synthetic Construct
TKDSEK

SEQ ID NO: 18488 - protein, 6 aa, synthetic construct
  REGION 1..6: note = Synthetic Construct
TKDSFK

SEQ ID NO: 18489 - protein, 6 aa, synthetic construct
  REGION 1..6: note = Synthetic Construct
TKDSGK

SEQ ID NO: 18490 - protein, 6 aa, synthetic construct
  REGION 1..6: note = Synthetic Construct
TKDSHK

SEQ ID NO: 18491 - protein, 6 aa, synthetic construct
  REGION 1..6: note = Synthetic Construct
TKDSIK

SEQ ID NO: 18492 - protein, 6 aa, synthetic construct
  REGION 1..6: note = Synthetic Construct
TKDSLK

SEQ ID NO: 18493 - protein, 6 aa, synthetic construct
  REGION 1..6: note = Synthetic Construct
TKDSNK

SEQ ID NO: 18494 - protein, 6 aa, synthetic construct
  REGION 1..6: note = Synthetic Construct
TKDSQK

SEQ ID NO: 18495 - protein, 6 aa, synthetic construct
  REGION 1..6: note = Synthetic Construct
TKDSRK

SEQ ID NO: 18496 - protein, 6 aa, synthetic construct
  REGION 1..6: note = Synthetic Construct
TKDSSK

SEQ ID NO: 18497 - protein, 6 aa, synthetic construct
  REGION 1..6: note = Synthetic Construct
TKDSTK

SEQ ID NO: 18498 - protein, 6 aa, synthetic construct
  REGION 1..6: note = Synthetic Construct
TKDSYK

SEQ ID NO: 18499 - protein, 6 aa, synthetic construct
  REGION 1..6: note = Synthetic Construct
TKDTAK

SEQ ID NO: 18500 - protein, 6 aa, synthetic construct
  REGION 1..6: note = Synthetic Construct
TKDTDK

SEQ ID NO: 18501 - protein, 6 aa, synthetic construct
  REGION 1..6: note = Synthetic Construct
TKDTEK

SEQ ID NO: 18502 - protein, 6 aa, synthetic construct
  REGION 1..6: note = Synthetic Construct
TKDTFK

SEQ ID NO: 18503 - protein, 6 aa, synthetic construct
  REGION 1..6: note = Synthetic Construct
TKDTGK

SEQ ID NO: 18504 - protein, 6 aa, synthetic construct
  REGION 1..6: note = Synthetic Construct
TKDTHK

SEQ ID NO: 18505 - protein, 6 aa, synthetic construct
  REGION 1..6: note = Synthetic Construct
TKDTIK

SEQ ID NO: 18506 - protein, 6 aa, synthetic construct
  REGION 1..6: note = Synthetic Construct
TKDTLK

SEQ ID NO: 18507 - protein, 6 aa, synthetic construct
  REGION 1..6: note = Synthetic Construct
TKDTNK

SEQ ID NO: 18508 - protein, 6 aa, synthetic construct
  REGION 1..6: note = Synthetic Construct
TKDTQK

SEQ ID NO: 18509 - protein, 6 aa, synthetic construct
  REGION 1..6: note = Synthetic Construct
TKDTRK

SEQ ID NO: 18510 - protein, 6 aa, synthetic construct
  REGION 1..6: note = Synthetic Construct
TKDTSK

SEQ ID NO: 18511 - protein, 6 aa, synthetic construct
  REGION 1..6: note = Synthetic Construct
TKDTTK

SEQ ID NO: 18512 - protein, 6 aa, synthetic construct
  REGION 1..6: note = Synthetic Construct
TKDTYK

SEQ ID NO: 18513 - protein, 6 aa, synthetic construct
  REGION 1..6: note = Synthetic Construct
TKDYAK

SEQ ID NO: 18514 - protein, 6 aa, synthetic construct
  REGION 1..6: note = Synthetic Construct
TKDYDK

SEQ ID NO: 18515 - protein, 6 aa, synthetic construct
  REGION 1..6: note = Synthetic Construct
TKDYEK

SEQ ID NO: 18516 - protein, 6 aa, synthetic construct
  REGION 1..6: note = Synthetic Construct
TKDYFK

SEQ ID NO: 18517 - protein, 6 aa, synthetic construct
  REGION 1..6: note = Synthetic Construct
TKDYGK

SEQ ID NO: 18518 - protein, 6 aa, synthetic construct
  REGION 1..6: note = Synthetic Construct
TKDYHK

SEQ ID NO: 18519 - protein, 6 aa, synthetic construct
  REGION 1..6: note = Synthetic Construct
TKDYIK

SEQ ID NO: 18520 - protein, 6 aa, synthetic construct
  REGION 1..6: note = Synthetic Construct
TKDYLK

SEQ ID NO: 18521 - protein, 6 aa, synthetic construct
  REGION 1..6: note = Synthetic Construct
TKDYNK

SEQ ID NO: 18522 - protein, 6 aa, synthetic construct
  REGION 1..6: note = Synthetic Construct
TKDYQK

SEQ ID NO: 18523 - protein, 6 aa, synthetic construct
  REGION 1..6: note = Synthetic Construct
TKDYRK

SEQ ID NO: 18524 - protein, 6 aa, synthetic construct
  REGION 1..6: note = Synthetic Construct
TKDYSK

SEQ ID NO: 18525 - protein, 6 aa, synthetic construct
  REGION 1..6: note = Synthetic Construct
TKDYTK

SEQ ID NO: 18526 - protein, 6 aa, synthetic construct
  REGION 1..6: note = Synthetic Construct
TKDYYK

SEQ ID NO: 18527 - protein, 6 aa, synthetic construct
  REGION 1..6: note = Synthetic Construct
TKEAAK

SEQ ID NO: 18528 - protein, 6 aa, synthetic construct
  REGION 1..6: note = Synthetic Construct
TKEADK

SEQ ID NO: 18529 - protein, 6 aa, synthetic construct
  REGION 1..6: note = Synthetic Construct
TKEAEK

SEQ ID NO: 18530 - protein, 6 aa, synthetic construct
  REGION 1..6: note = Synthetic Construct
TKEAFK

SEQ ID NO: 18531 - protein, 6 aa, synthetic construct
  REGION 1..6: note = Synthetic Construct
TKEAGK

SEQ ID NO: 18532 - protein, 6 aa, synthetic construct
  REGION 1..6: note = Synthetic Construct
TKEAHK

SEQ ID NO: 18533 - protein, 6 aa, synthetic construct
  REGION 1..6: note = Synthetic Construct
TKEAIK

SEQ ID NO: 18534 - protein, 6 aa, synthetic construct
  REGION 1..6: note = Synthetic Construct
TKEALK

SEQ ID NO: 18535 - protein, 6 aa, synthetic construct
  REGION 1..6: note = Synthetic Construct
TKEANK

SEQ ID NO: 18536 - protein, 6 aa, synthetic construct
  REGION 1..6: note = Synthetic Construct
TKEAQK

SEQ ID NO: 18537 - protein, 6 aa, synthetic construct
  REGION 1..6: note = Synthetic Construct
TKEARK

SEQ ID NO: 18538 - protein, 6 aa, synthetic construct
  REGION 1..6: note = Synthetic Construct
TKEASK

SEQ ID NO: 18539 - protein, 6 aa, synthetic construct
  REGION 1..6: note = Synthetic Construct
TKEATK

SEQ ID NO: 18540 - protein, 6 aa, synthetic construct
  REGION 1..6: note = Synthetic Construct
TKEAYK

SEQ ID NO: 18541 - protein, 6 aa, synthetic construct
  REGION 1..6: note = Synthetic Construct
TKEDAK

SEQ ID NO: 18542 - protein, 6 aa, synthetic construct
  REGION 1..6: note = Synthetic Construct
TKEDDK

SEQ ID NO: 18543 - protein, 6 aa, synthetic construct
  REGION 1..6: note = Synthetic Construct
TKEDEK

SEQ ID NO: 18544 - protein, 6 aa, synthetic construct
  REGION 1..6: note = Synthetic Construct
TKEDFK

SEQ ID NO: 18545 - protein, 6 aa, synthetic construct
  REGION 1..6: note = Synthetic Construct
TKEDGK

SEQ ID NO: 18546 - protein, 6 aa, synthetic construct
  REGION 1..6: note = Synthetic Construct
TKEDHK

SEQ ID NO: 18547 - protein, 6 aa, synthetic construct
  REGION 1..6: note = Synthetic Construct
TKEDIK

SEQ ID NO: 18548 - protein, 6 aa, synthetic construct
  REGION 1..6: note = Synthetic Construct
TKEDLK

SEQ ID NO: 18549 - protein, 6 aa, synthetic construct
  REGION 1..6: note = Synthetic Construct
TKEDNK

SEQ ID NO: 18550 - protein, 6 aa, synthetic construct
  REGION 1..6: note = Synthetic Construct
TKEDQK

SEQ ID NO: 18551 - protein, 6 aa, synthetic construct
  REGION 1..6: note = Synthetic Construct
TKEDRK

SEQ ID NO: 18552 - protein, 6 aa, synthetic construct
  REGION 1..6: note = Synthetic Construct
TKEDSK

SEQ ID NO: 18553 - protein, 6 aa, synthetic construct
  REGION 1..6: note = Synthetic Construct
TKEDTK

SEQ ID NO: 18554 - protein, 6 aa, synthetic construct
  REGION 1..6: note = Synthetic Construct
TKEDYK

SEQ ID NO: 18555 - protein, 6 aa, synthetic construct
  REGION 1..6: note = Synthetic Construct
TKEEAK

SEQ ID NO: 18556 - protein, 6 aa, synthetic construct
  REGION 1..6: note = Synthetic Construct
TKEEDK

SEQ ID NO: 18557 - protein, 6 aa, synthetic construct
  REGION 1..6: note = Synthetic Construct
TKEEEK

SEQ ID NO: 18558 - protein, 6 aa, synthetic construct
  REGION 1..6: note = Synthetic Construct
TKEEFK

SEQ ID NO: 18559 - protein, 6 aa, synthetic construct
  REGION 1..6: note = Synthetic Construct
TKEEGK

SEQ ID NO: 18560 - protein, 6 aa, synthetic construct
  REGION 1..6: note = Synthetic Construct
TKEEHK

SEQ ID NO: 18561 - protein, 6 aa, synthetic construct
  REGION 1..6: note = Synthetic Construct
TKEEIK

SEQ ID NO: 18562 - protein, 6 aa, synthetic construct
  REGION 1..6: note = Synthetic Construct
TKEELK

SEQ ID NO: 18563 - protein, 6 aa, synthetic construct
  REGION 1..6: note = Synthetic Construct
TKEENK

SEQ ID NO: 18564 - protein, 6 aa, synthetic construct
  REGION 1..6: note = Synthetic Construct
TKEEQK

SEQ ID NO: 18565 - protein, 6 aa, synthetic construct
  REGION 1..6: note = Synthetic Construct
TKEERK

SEQ ID NO: 18566 - protein, 6 aa, synthetic construct
  REGION 1..6: note = Synthetic Construct
TKEESK

SEQ ID NO: 18567 - protein, 6 aa, synthetic construct
  REGION 1..6: note = Synthetic Construct
TKEETK

SEQ ID NO: 18568 - protein, 6 aa, synthetic construct
  REGION 1..6: note = Synthetic Construct
TKEEYK

SEQ ID NO: 18569 - protein, 6 aa, synthetic construct
  REGION 1..6: note = Synthetic Construct
TKEFAK

SEQ ID NO: 18570 - protein, 6 aa, synthetic construct
  REGION 1..6: note = Synthetic Construct
TKEFDK

SEQ ID NO: 18571 - protein, 6 aa, synthetic construct
  REGION 1..6: note = Synthetic Construct
TKEFEK

SEQ ID NO: 18572 - protein, 6 aa, synthetic construct
  REGION 1..6: note = Synthetic Construct
TKEFFK

SEQ ID NO: 18573 - protein, 6 aa, synthetic construct
  REGION 1..6: note = Synthetic Construct
TKEFGK

SEQ ID NO: 18574 - protein, 6 aa, synthetic construct
  REGION 1..6: note = Synthetic Construct
TKEFHK

SEQ ID NO: 18575 - protein, 6 aa, synthetic construct
  REGION 1..6: note = Synthetic Construct
TKEFIK

SEQ ID NO: 18576 - protein, 6 aa, synthetic construct
  REGION 1..6: note = Synthetic Construct
TKEFLK

SEQ ID NO: 18577 - protein, 6 aa, synthetic construct
  REGION 1..6: note = Synthetic Construct
TKEFNK

SEQ ID NO: 18578 - protein, 6 aa, synthetic construct
  REGION 1..6: note = Synthetic Construct
TKEFQK

SEQ ID NO: 18579 - protein, 6 aa, synthetic construct
  REGION 1..6: note = Synthetic Construct
TKEFRK

SEQ ID NO: 18580 - protein, 6 aa, synthetic construct
  REGION 1..6: note = Synthetic Construct
TKEFSK

SEQ ID NO: 18581 - protein, 6 aa, synthetic construct
  REGION 1..6: note = Synthetic Construct
TKEFTK

SEQ ID NO: 18582 - protein, 6 aa, synthetic construct
  REGION 1..6: note = Synthetic Construct
TKEFYK

SEQ ID NO: 18583 - protein, 6 aa, synthetic construct
  REGION 1..6: note = Synthetic Construct
TKEGAK

SEQ ID NO: 18584 - protein, 6 aa, synthetic construct
  REGION 1..6: note = Synthetic Construct
TKEGDK

SEQ ID NO: 18585 - protein, 6 aa, synthetic construct
  REGION 1..6: note = Synthetic Construct
TKEGEK

SEQ ID NO: 18586 - protein, 6 aa, synthetic construct
  REGION 1..6: note = Synthetic Construct
TKEGFK

SEQ ID NO: 18587 - protein, 6 aa, synthetic construct
  REGION 1..6: note = Synthetic Construct
TKEGGK

SEQ ID NO: 18588 - protein, 6 aa, synthetic construct
  REGION 1..6: note = Synthetic Construct
TKEGHK

SEQ ID NO: 18589 - protein, 6 aa, synthetic construct
  REGION 1..6: note = Synthetic Construct
TKEGIK

SEQ ID NO: 18590 - protein, 6 aa, synthetic construct
  REGION 1..6: note = Synthetic Construct
TKEGLK

SEQ ID NO: 18591 - protein, 6 aa, synthetic construct
  REGION 1..6: note = Synthetic Construct
TKEGNK

SEQ ID NO: 18592 - protein, 6 aa, synthetic construct
  REGION 1..6: note = Synthetic Construct
TKEGQK

SEQ ID NO: 18593 - protein, 6 aa, synthetic construct
  REGION 1..6: note = Synthetic Construct
TKEGRK

SEQ ID NO: 18594 - protein, 6 aa, synthetic construct
  REGION 1..6: note = Synthetic Construct
TKEGSK

SEQ ID NO: 18595 - protein, 6 aa, synthetic construct
  REGION 1..6: note = Synthetic Construct
TKEGTK

SEQ ID NO: 18596 - protein, 6 aa, synthetic construct
  REGION 1..6: note = Synthetic Construct
TKEGYK

SEQ ID NO: 18597 - protein, 6 aa, synthetic construct
  REGION 1..6: note = Synthetic Construct
TKEHAK

SEQ ID NO: 18598 - protein, 6 aa, synthetic construct
  REGION 1..6: note = Synthetic Construct
TKEHDK

SEQ ID NO: 18599 - protein, 6 aa, synthetic construct
  REGION 1..6: note = Synthetic Construct
TKEHEK

SEQ ID NO: 18600 - protein, 6 aa, synthetic construct
  REGION 1..6: note = Synthetic Construct
TKEHFK

SEQ ID NO: 18601 - protein, 6 aa, synthetic construct
  REGION 1..6: note = Synthetic Construct
TKEHGK

SEQ ID NO: 18602 - protein, 6 aa, synthetic construct
  REGION 1..6: note = Synthetic Construct
TKEHHK

SEQ ID NO: 18603 - protein, 6 aa, synthetic construct
  REGION 1..6: note = Synthetic Construct
TKEHIK

SEQ ID NO: 18604 - protein, 6 aa, synthetic construct
  REGION 1..6: note = Synthetic Construct
TKEHLK

SEQ ID NO: 18605 - protein, 6 aa, synthetic construct
  REGION 1..6: note = Synthetic Construct
TKEHNK

SEQ ID NO: 18606 - protein, 6 aa, synthetic construct
  REGION 1..6: note = Synthetic Construct
TKEHQK

SEQ ID NO: 18607 - protein, 6 aa, synthetic construct
  REGION 1..6: note = Synthetic Construct
TKEHRK

SEQ ID NO: 18608 - protein, 6 aa, synthetic construct
  REGION 1..6: note = Synthetic Construct
TKEHSK

SEQ ID NO: 18609 - protein, 6 aa, synthetic construct
  REGION 1..6: note = Synthetic Construct
TKEHTK

SEQ ID NO: 18610 - protein, 6 aa, synthetic construct
  REGION 1..6: note = Synthetic Construct
TKEHYK

SEQ ID NO: 18611 - protein, 6 aa, synthetic construct
  REGION 1..6: note = Synthetic Construct
TKEIAK

SEQ ID NO: 18612 - protein, 6 aa, synthetic construct
  REGION 1..6: note = Synthetic Construct
TKEIDK

SEQ ID NO: 18613 - protein, 6 aa, synthetic construct
  REGION 1..6: note = Synthetic Construct
TKEIEK

SEQ ID NO: 18614 - protein, 6 aa, synthetic construct
  REGION 1..6: note = Synthetic Construct
TKEIFK

SEQ ID NO: 18615 - protein, 6 aa, synthetic construct
  REGION 1..6: note = Synthetic Construct
TKEIGK

SEQ ID NO: 18616 - protein, 6 aa, synthetic construct
  REGION 1..6: note = Synthetic Construct
TKEIHK

SEQ ID NO: 18617 - protein, 6 aa, synthetic construct
  REGION 1..6: note = Synthetic Construct
TKEIIK

SEQ ID NO: 18618 - protein, 6 aa, synthetic construct
  REGION 1..6: note = Synthetic Construct
TKEILK

SEQ ID NO: 18619 - protein, 6 aa, synthetic construct
  REGION 1..6: note = Synthetic Construct
TKEINK

SEQ ID NO: 18620 - protein, 6 aa, synthetic construct
  REGION 1..6: note = Synthetic Construct
TKEIQK

SEQ ID NO: 18621 - protein, 6 aa, synthetic construct
  REGION 1..6: note = Synthetic Construct
TKEIRK

SEQ ID NO: 18622 - protein, 6 aa, synthetic construct
  REGION 1..6: note = Synthetic Construct
TKEISK

SEQ ID NO: 18623 - protein, 6 aa, synthetic construct
  REGION 1..6: note = Synthetic Construct
TKEITK

SEQ ID NO: 18624 - protein, 6 aa, synthetic construct
  REGION 1..6: note = Synthetic Construct
TKEIYK

SEQ ID NO: 18625 - protein, 6 aa, synthetic construct
  REGION 1..6: note = Synthetic Construct
TKELAK

SEQ ID NO: 18626 - protein, 6 aa, synthetic construct
  REGION 1..6: note = Synthetic Construct
TKELDK

SEQ ID NO: 18627 - protein, 6 aa, synthetic construct
  REGION 1..6: note = Synthetic Construct
TKELEK

SEQ ID NO: 18628 - protein, 6 aa, synthetic construct
  REGION 1..6: note = Synthetic Construct
TKELFK

SEQ ID NO: 18629 - protein, 6 aa, synthetic construct
  REGION 1..6: note = Synthetic Construct
TKELGK

SEQ ID NO: 18630 - protein, 6 aa, synthetic construct
  REGION 1..6: note = Synthetic Construct
TKELHK

SEQ ID NO: 18631 - protein, 6 aa, synthetic construct
  REGION 1..6: note = Synthetic Construct
TKELIK

SEQ ID NO: 18632 - protein, 6 aa, synthetic construct
  REGION 1..6: note = Synthetic Construct
TKELLK

SEQ ID NO: 18633 - protein, 6 aa, synthetic construct
  REGION 1..6: note = Synthetic Construct
TKELNK

SEQ ID NO: 18634 - protein, 6 aa, synthetic construct
  REGION 1..6: note = Synthetic Construct
TKELQK

SEQ ID NO: 18635 - protein, 6 aa, synthetic construct
  REGION 1..6: note = Synthetic Construct
TKELRK

SEQ ID NO: 18636 - protein, 6 aa, synthetic construct
  REGION 1..6: note = Synthetic Construct
TKELSK

SEQ ID NO: 18637 - protein, 6 aa, synthetic construct
  REGION 1..6: note = Synthetic Construct
TKELTK

SEQ ID NO: 18638 - protein, 6 aa, synthetic construct
  REGION 1..6: note = Synthetic Construct
TKELYK

SEQ ID NO: 18639 - protein, 6 aa, synthetic construct
  REGION 1..6: note = Synthetic Construct
TKENAK

SEQ ID NO: 18640 - protein, 6 aa, synthetic construct
  REGION 1..6: note = Synthetic Construct
TKENDK

SEQ ID NO: 18641 - protein, 6 aa, synthetic construct
  REGION 1..6: note = Synthetic Construct
TKENEK

SEQ ID NO: 18642 - protein, 6 aa, synthetic construct
  REGION 1..6: note = Synthetic Construct
TKENFK

SEQ ID NO: 18643 - protein, 6 aa, synthetic construct
  REGION 1..6: note = Synthetic Construct
TKENGK

SEQ ID NO: 18644 - protein, 6 aa, synthetic construct
  REGION 1..6: note = Synthetic Construct
TKENHK

SEQ ID NO: 18645 - protein, 6 aa, synthetic construct
  REGION 1..6: note = Synthetic Construct
TKENIK

SEQ ID NO: 18646 - protein, 6 aa, synthetic construct
  REGION 1..6: note = Synthetic Construct
TKENLK

SEQ ID NO: 18647 - protein, 6 aa, synthetic construct
  REGION 1..6: note = Synthetic Construct
TKENNK

SEQ ID NO: 18648 - protein, 6 aa, synthetic construct
  REGION 1..6: note = Synthetic Construct
TKENQK

SEQ ID NO: 18649 - protein, 6 aa, synthetic construct
  REGION 1..6: note = Synthetic Construct
TKENRK

SEQ ID NO: 18650 - protein, 6 aa, synthetic construct
  REGION 1..6: note = Synthetic Construct
TKENSK

SEQ ID NO: 18651 - protein, 6 aa, synthetic construct
  REGION 1..6: note = Synthetic Construct
TKENTK

SEQ ID NO: 18652 - protein, 6 aa, synthetic construct
  REGION 1..6: note = Synthetic Construct
TKENYK

SEQ ID NO: 18653 - protein, 6 aa, synthetic construct
  REGION 1..6: note = Synthetic Construct
TKEQAK

SEQ ID NO: 18654 - protein, 6 aa, synthetic construct
  REGION 1..6: note = Synthetic Construct
TKEQDK

SEQ ID NO: 18655 - protein, 6 aa, synthetic construct
  REGION 1..6: note = Synthetic Construct
TKEQEK

SEQ ID NO: 18656 - protein, 6 aa, synthetic construct
  REGION 1..6: note = Synthetic Construct
TKEQFK

SEQ ID NO: 18657 - protein, 6 aa, synthetic construct
  REGION 1..6: note = Synthetic Construct
TKEQGK

SEQ ID NO: 18658 - protein, 6 aa, synthetic construct
  REGION 1..6: note = Synthetic Construct
TKEQHK

SEQ ID NO: 18659 - protein, 6 aa, synthetic construct
  REGION 1..6: note = Synthetic Construct
TKEQIK

SEQ ID NO: 18660 - protein, 6 aa, synthetic construct
  REGION 1..6: note = Synthetic Construct
TKEQLK

SEQ ID NO: 18661 - protein, 6 aa, synthetic construct
  REGION 1..6: note = Synthetic Construct
TKEQNK

SEQ ID NO: 18662 - protein, 6 aa, synthetic construct
  REGION 1..6: note = Synthetic Construct
TKEQQK

SEQ ID NO: 18663 - protein, 6 aa, synthetic construct
  REGION 1..6: note = Synthetic Construct
TKEQRK

SEQ ID NO: 18664 - protein, 6 aa, synthetic construct
  REGION 1..6: note = Synthetic Construct
TKEQSK

SEQ ID NO: 18665 - protein, 6 aa, synthetic construct
  REGION 1..6: note = Synthetic Construct
TKEQTK

SEQ ID NO: 18666 - protein, 6 aa, synthetic construct
  REGION 1..6: note = Synthetic Construct
TKEQYK

SEQ ID NO: 18667 - protein, 6 aa, synthetic construct
  REGION 1..6: note = Synthetic Construct
TKERAK

SEQ ID NO: 18668 - protein, 6 aa, synthetic construct
  REGION 1..6: note = Synthetic Construct
TKERDK

SEQ ID NO: 18669 - protein, 6 aa, synthetic construct
  REGION 1..6: note = Synthetic Construct
TKEREK

SEQ ID NO: 18670 - protein, 6 aa, synthetic construct
  REGION 1..6: note = Synthetic Construct
TKERFK

SEQ ID NO: 18671 - protein, 6 aa, synthetic construct
  REGION 1..6: note = Synthetic Construct
TKERGK

SEQ ID NO: 18672 - protein, 6 aa, synthetic construct
  REGION 1..6: note = Synthetic Construct
TKERHK

SEQ ID NO: 18673 - protein, 6 aa, synthetic construct
  REGION 1..6: note = Synthetic Construct
TKERIK

SEQ ID NO: 18674 - protein, 6 aa, synthetic construct
  REGION 1..6: note = Synthetic Construct
TKERLK

SEQ ID NO: 18675 - protein, 6 aa, synthetic construct
  REGION 1..6: note = Synthetic Construct
TKERNK

SEQ ID NO: 18676 - protein, 6 aa, synthetic construct
  REGION 1..6: note = Synthetic Construct
TKERQK

SEQ ID NO: 18677 - protein, 6 aa, synthetic construct
  REGION 1..6: note = Synthetic Construct
TKERRK

SEQ ID NO: 18678 - protein, 6 aa, synthetic construct
  REGION 1..6: note = Synthetic Construct
TKERSK

SEQ ID NO: 18679 - protein, 6 aa, synthetic construct
  REGION 1..6: note = Synthetic Construct
TKERTK

SEQ ID NO: 18680 - protein, 6 aa, synthetic construct
  REGION 1..6: note = Synthetic Construct
TKERYK

SEQ ID NO: 18681 - protein, 6 aa, synthetic construct
  REGION 1..6: note = Synthetic Construct
TKESAK

SEQ ID NO: 18682 - protein, 6 aa, synthetic construct
  REGION 1..6: note = Synthetic Construct
TKESDK

SEQ ID NO: 18683 - protein, 6 aa, synthetic construct
  REGION 1..6: note = Synthetic Construct
TKESEK

SEQ ID NO: 18684 - protein, 6 aa, synthetic construct
  REGION 1..6: note = Synthetic Construct
TKESFK

SEQ ID NO: 18685 - protein, 6 aa, synthetic construct
  REGION 1..6: note = Synthetic Construct
TKESGK

SEQ ID NO: 18686 - protein, 6 aa, synthetic construct
  REGION 1..6: note = Synthetic Construct
TKESHK

SEQ ID NO: 18687 - protein, 6 aa, synthetic construct
  REGION 1..6: note = Synthetic Construct
TKESIK

SEQ ID NO: 18688 - protein, 6 aa, synthetic construct
  REGION 1..6: note = Synthetic Construct
TKESLK

SEQ ID NO: 18689 - protein, 6 aa, synthetic construct
  REGION 1..6: note = Synthetic Construct
TKESNK

SEQ ID NO: 18690 - protein, 6 aa, synthetic construct
  REGION 1..6: note = Synthetic Construct
TKESQK

SEQ ID NO: 18691 - protein, 6 aa, synthetic construct
  REGION 1..6: note = Synthetic Construct
TKESRK

SEQ ID NO: 18692 - protein, 6 aa, synthetic construct
  REGION 1..6: note = Synthetic Construct
TKESSK

SEQ ID NO: 18693 - protein, 6 aa, synthetic construct
  REGION 1..6: note = Synthetic Construct
TKESTK

SEQ ID NO: 18694 - protein, 6 aa, synthetic construct
  REGION 1..6: note = Synthetic Construct
TKESYK

SEQ ID NO: 18695 - protein, 6 aa, synthetic construct
  REGION 1..6: note = Synthetic Construct
TKETAK

SEQ ID NO: 18696 - protein, 6 aa, synthetic construct
  REGION 1..6: note = Synthetic Construct
TKETDK

SEQ ID NO: 18697 - protein, 6 aa, synthetic construct
  REGION 1..6: note = Synthetic Construct
TKETEK

SEQ ID NO: 18698 - protein, 6 aa, synthetic construct
  REGION 1..6: note = Synthetic Construct
TKETFK

SEQ ID NO: 18699 - protein, 6 aa, synthetic construct
  REGION 1..6: note = Synthetic Construct
TKETGK

SEQ ID NO: 18700 - protein, 6 aa, synthetic construct
  REGION 1..6: note = Synthetic Construct
TKETHK

SEQ ID NO: 18701 - protein, 6 aa, synthetic construct
  REGION 1..6: note = Synthetic Construct
TKETIK

SEQ ID NO: 18702 - protein, 6 aa, synthetic construct
  REGION 1..6: note = Synthetic Construct
TKETLK

SEQ ID NO: 18703 - protein, 6 aa, synthetic construct
  REGION 1..6: note = Synthetic Construct
TKETNK

SEQ ID NO: 18704 - protein, 6 aa, synthetic construct
  REGION 1..6: note = Synthetic Construct
TKETQK

SEQ ID NO: 18705 - protein, 6 aa, synthetic construct
  REGION 1..6: note = Synthetic Construct
TKETRK

SEQ ID NO: 18706 - protein, 6 aa, synthetic construct
  REGION 1..6: note = Synthetic Construct
TKETSK

SEQ ID NO: 18707 - protein, 6 aa, synthetic construct
  REGION 1..6: note = Synthetic Construct
TKETTK

SEQ ID NO: 18708 - protein, 6 aa, synthetic construct
  REGION 1..6: note = Synthetic Construct
TKETYK

SEQ ID NO: 18709 - protein, 6 aa, synthetic construct
  REGION 1..6: note = Synthetic Construct
TKEYAK

SEQ ID NO: 18710 - protein, 6 aa, synthetic construct
  REGION 1..6: note = Synthetic Construct
TKEYDK

SEQ ID NO: 18711 - protein, 6 aa, synthetic construct
  REGION 1..6: note = Synthetic Construct
TKEYEK

SEQ ID NO: 18712 - protein, 6 aa, synthetic construct
  REGION 1..6: note = Synthetic Construct
TKEYFK

SEQ ID NO: 18713 - protein, 6 aa, synthetic construct
  REGION 1..6: note = Synthetic Construct
TKEYGK

SEQ ID NO: 18714 - protein, 6 aa, synthetic construct
  REGION 1..6: note = Synthetic Construct
TKEYHK

SEQ ID NO: 18715 - protein, 6 aa, synthetic construct
  REGION 1..6: note = Synthetic Construct
TKEYIK

SEQ ID NO: 18716 - protein, 6 aa, synthetic construct
  REGION 1..6: note = Synthetic Construct
TKEYLK

SEQ ID NO: 18717 - protein, 6 aa, synthetic construct
  REGION 1..6: note = Synthetic Construct
TKEYNK

SEQ ID NO: 18718 - protein, 6 aa, synthetic construct
  REGION 1..6: note = Synthetic Construct
TKEYQK

SEQ ID NO: 18719 - protein, 6 aa, synthetic construct
  REGION 1..6: note = Synthetic Construct
TKEYRK

SEQ ID NO: 18720 - protein, 6 aa, synthetic construct
  REGION 1..6: note = Synthetic Construct
TKEYSK

SEQ ID NO: 18721 - protein, 6 aa, synthetic construct
  REGION 1..6: note = Synthetic Construct
TKEYTK

SEQ ID NO: 18722 - protein, 6 aa, synthetic construct
  REGION 1..6: note = Synthetic Construct
TKEYYK

SEQ ID NO: 18723 - protein, 6 aa, synthetic construct
  REGION 1..6: note = Synthetic Construct
TKFAAK

SEQ ID NO: 18724 - protein, 6 aa, synthetic construct
  REGION 1..6: note = Synthetic Construct
TKFADK

SEQ ID NO: 18725 - protein, 6 aa, synthetic construct
  REGION 1..6: note = Synthetic Construct
TKFAEK

SEQ ID NO: 18726 - protein, 6 aa, synthetic construct
  REGION 1..6: note = Synthetic Construct
TKFAFK

SEQ ID NO: 18727 - protein, 6 aa, synthetic construct
  REGION 1..6: note = Synthetic Construct
TKFAGK

SEQ ID NO: 18728 - protein, 6 aa, synthetic construct
  REGION 1..6: note = Synthetic Construct
TKFAHK

SEQ ID NO: 18729 - protein, 6 aa, synthetic construct
  REGION 1..6: note = Synthetic Construct
TKFAIK

SEQ ID NO: 18730 - protein, 6 aa, synthetic construct
  REGION 1..6: note = Synthetic Construct
TKFALK

SEQ ID NO: 18731 - protein, 6 aa, synthetic construct
  REGION 1..6: note = Synthetic Construct
TKFANK

SEQ ID NO: 18732 - protein, 6 aa, synthetic construct
  REGION 1..6: note = Synthetic Construct
TKFAQK

SEQ ID NO: 18733 - protein, 6 aa, synthetic construct
  REGION 1..6: note = Synthetic Construct
TKFARK

SEQ ID NO: 18734 - protein, 6 aa, synthetic construct
  REGION 1..6: note = Synthetic Construct
TKFASK

SEQ ID NO: 18735 - protein, 6 aa, synthetic construct
  REGION 1..6: note = Synthetic Construct
TKFATK

SEQ ID NO: 18736 - protein, 6 aa, synthetic construct
  REGION 1..6: note = Synthetic Construct
TKFAYK

SEQ ID NO: 18737 - protein, 6 aa, synthetic construct
  REGION 1..6: note = Synthetic Construct
TKFDAK

SEQ ID NO: 18738 - protein, 6 aa, synthetic construct
  REGION 1..6: note = Synthetic Construct
TKFDDK

SEQ ID NO: 18739 - protein, 6 aa, synthetic construct
  REGION 1..6: note = Synthetic Construct
TKFDEK

SEQ ID NO: 18740 - protein, 6 aa, synthetic construct
  REGION 1..6: note = Synthetic Construct
TKFDFK

SEQ ID NO: 18741 - protein, 6 aa, synthetic construct
  REGION 1..6: note = Synthetic Construct
TKFDGK

SEQ ID NO: 18742 - protein, 6 aa, synthetic construct
  REGION 1..6: note = Synthetic Construct
TKFDHK

SEQ ID NO: 18743 - protein, 6 aa, synthetic construct
  REGION 1..6: note = Synthetic Construct
TKFDIK

SEQ ID NO: 18744 - protein, 6 aa, synthetic construct
  REGION 1..6: note = Synthetic Construct
TKFDLK

SEQ ID NO: 18745 - protein, 6 aa, synthetic construct
  REGION 1..6: note = Synthetic Construct
TKFDNK

SEQ ID NO: 18746 - protein, 6 aa, synthetic construct
  REGION 1..6: note = Synthetic Construct
TKFDQK

SEQ ID NO: 18747 - protein, 6 aa, synthetic construct
  REGION 1..6: note = Synthetic Construct
TKFDRK

SEQ ID NO: 18748 - protein, 6 aa, synthetic construct
  REGION 1..6: note = Synthetic Construct
TKFDSK

SEQ ID NO: 18749 - protein, 6 aa, synthetic construct
  REGION 1..6: note = Synthetic Construct
TKFDTK

SEQ ID NO: 18750 - protein, 6 aa, synthetic construct
  REGION 1..6: note = Synthetic Construct
TKFDYK

SEQ ID NO: 18751 - protein, 6 aa, synthetic construct
  REGION 1..6: note = Synthetic Construct
TKFEAK

SEQ ID NO: 18752 - protein, 6 aa, synthetic construct
  REGION 1..6: note = Synthetic Construct
TKFEDK

SEQ ID NO: 18753 - protein, 6 aa, synthetic construct
  REGION 1..6: note = Synthetic Construct
TKFEEK

SEQ ID NO: 18754 - protein, 6 aa, synthetic construct
  REGION 1..6: note = Synthetic Construct
TKFEFK

SEQ ID NO: 18755 - protein, 6 aa, synthetic construct
  REGION 1..6: note = Synthetic Construct
TKFEGK

SEQ ID NO: 18756 - protein, 6 aa, synthetic construct
  REGION 1..6: note = Synthetic Construct
TKFEHK

SEQ ID NO: 18757 - protein, 6 aa, synthetic construct
  REGION 1..6: note = Synthetic Construct
TKFEIK

SEQ ID NO: 18758 - protein, 6 aa, synthetic construct
  REGION 1..6: note = Synthetic Construct
TKFELK

SEQ ID NO: 18759 - protein, 6 aa, synthetic construct
  REGION 1..6: note = Synthetic Construct
TKFENK

SEQ ID NO: 18760 - protein, 6 aa, synthetic construct
  REGION 1..6: note = Synthetic Construct
TKFEQK

SEQ ID NO: 18761 - protein, 6 aa, synthetic construct
  REGION 1..6: note = Synthetic Construct
TKFERK

SEQ ID NO: 18762 - protein, 6 aa, synthetic construct
  REGION 1..6: note = Synthetic Construct
TKFESK

SEQ ID NO: 18763 - protein, 6 aa, synthetic construct
  REGION 1..6: note = Synthetic Construct
TKFETK

SEQ ID NO: 18764 - protein, 6 aa, synthetic construct
  REGION 1..6: note = Synthetic Construct
TKFEYK

SEQ ID NO: 18765 - protein, 6 aa, synthetic construct
  REGION 1..6: note = Synthetic Construct
TKFFAK

SEQ ID NO: 18766 - protein, 6 aa, synthetic construct
  REGION 1..6: note = Synthetic Construct
TKFFDK

SEQ ID NO: 18767 - protein, 6 aa, synthetic construct
  REGION 1..6: note = Synthetic Construct
TKFFEK

SEQ ID NO: 18768 - protein, 6 aa, synthetic construct
  REGION 1..6: note = Synthetic Construct
TKFFFK

SEQ ID NO: 18769 - protein, 6 aa, synthetic construct
  REGION 1..6: note = Synthetic Construct
TKFFGK

SEQ ID NO: 18770 - protein, 6 aa, synthetic construct
  REGION 1..6: note = Synthetic Construct
TKFFHK

SEQ ID NO: 18771 - protein, 6 aa, synthetic construct
  REGION 1..6: note = Synthetic Construct
TKFFIK

SEQ ID NO: 18772 - protein, 6 aa, synthetic construct
  REGION 1..6: note = Synthetic Construct
TKFFLK

SEQ ID NO: 18773 - protein, 6 aa, synthetic construct
  REGION 1..6: note = Synthetic Construct
TKFFNK

SEQ ID NO: 18774 - protein, 6 aa, synthetic construct
  REGION 1..6: note = Synthetic Construct
TKFFQK

SEQ ID NO: 18775 - protein, 6 aa, synthetic construct
  REGION 1..6: note = Synthetic Construct
TKFFRK

SEQ ID NO: 18776 - protein, 6 aa, synthetic construct
  REGION 1..6: note = Synthetic Construct
TKFFSK

SEQ ID NO: 18777 - protein, 6 aa, synthetic construct
  REGION 1..6: note = Synthetic Construct
TKFFTK

SEQ ID NO: 18778 - protein, 6 aa, synthetic construct
  REGION 1..6: note = Synthetic Construct
TKFFYK

SEQ ID NO: 18779 - protein, 6 aa, synthetic construct
  REGION 1..6: note = Synthetic Construct
TKFGAK

SEQ ID NO: 18780 - protein, 6 aa, synthetic construct
  REGION 1..6: note = Synthetic Construct
TKFGDK

SEQ ID NO: 18781 - protein, 6 aa, synthetic construct
  REGION 1..6: note = Synthetic Construct
TKFGEK

SEQ ID NO: 18782 - protein, 6 aa, synthetic construct
  REGION 1..6: note = Synthetic Construct
TKFGFK

SEQ ID NO: 18783 - protein, 6 aa, synthetic construct
  REGION 1..6: note = Synthetic Construct
TKFGGK

SEQ ID NO: 18784 - protein, 6 aa, synthetic construct
  REGION 1..6: note = Synthetic Construct
TKFGHK

SEQ ID NO: 18785 - protein, 6 aa, synthetic construct
  REGION 1..6: note = Synthetic Construct
TKFGIK

SEQ ID NO: 18786 - protein, 6 aa, synthetic construct
  REGION 1..6: note = Synthetic Construct
TKFGLK

SEQ ID NO: 18787 - protein, 6 aa, synthetic construct
  REGION 1..6: note = Synthetic Construct
TKFGNK

SEQ ID NO: 18788 - protein, 6 aa, synthetic construct
  REGION 1..6: note = Synthetic Construct
TKFGQK

SEQ ID NO: 18789 - protein, 6 aa, synthetic construct
  REGION 1..6: note = Synthetic Construct
TKFGRK

SEQ ID NO: 18790 - protein, 6 aa, synthetic construct
  REGION 1..6: note = Synthetic Construct
TKFGSK

SEQ ID NO: 18791 - protein, 6 aa, synthetic construct
  REGION 1..6: note = Synthetic Construct
TKFGTK

SEQ ID NO: 18792 - protein, 6 aa, synthetic construct
  REGION 1..6: note = Synthetic Construct
TKFGYK

SEQ ID NO: 18793 - protein, 6 aa, synthetic construct
  REGION 1..6: note = Synthetic Construct
TKFHAK

SEQ ID NO: 18794 - protein, 6 aa, synthetic construct
  REGION 1..6: note = Synthetic Construct
TKFHDK

SEQ ID NO: 18795 - protein, 6 aa, synthetic construct
  REGION 1..6: note = Synthetic Construct
TKFHEK

SEQ ID NO: 18796 - protein, 6 aa, synthetic construct
  REGION 1..6: note = Synthetic Construct
TKFHFK

SEQ ID NO: 18797 - protein, 6 aa, synthetic construct
  REGION 1..6: note = Synthetic Construct
TKFHGK

SEQ ID NO: 18798 - protein, 6 aa, synthetic construct
  REGION 1..6: note = Synthetic Construct
TKFHHK

SEQ ID NO: 18799 - protein, 6 aa, synthetic construct
  REGION 1..6: note = Synthetic Construct
TKFHIK

SEQ ID NO: 18800 - protein, 6 aa, synthetic construct
  REGION 1..6: note = Synthetic Construct
TKFHLK

SEQ ID NO: 18801 - protein, 6 aa, synthetic construct
  REGION 1..6: note = Synthetic Construct
TKFHNK

SEQ ID NO: 18802 - protein, 6 aa, synthetic construct
  REGION 1..6: note = Synthetic Construct
TKFHQK

SEQ ID NO: 18803 - protein, 6 aa, synthetic construct
  REGION 1..6: note = Synthetic Construct
TKFHRK

SEQ ID NO: 18804 - protein, 6 aa, synthetic construct
  REGION 1..6: note = Synthetic Construct
TKFHSK

SEQ ID NO: 18805 - protein, 6 aa, synthetic construct
  REGION 1..6: note = Synthetic Construct
TKFHTK

SEQ ID NO: 18806 - protein, 6 aa, synthetic construct
  REGION 1..6: note = Synthetic Construct
TKFHYK

SEQ ID NO: 18807 - protein, 6 aa, synthetic construct
  REGION 1..6: note = Synthetic Construct
TKFIAK

SEQ ID NO: 18808 - protein, 6 aa, synthetic construct
  REGION 1..6: note = Synthetic Construct
TKFIDK

SEQ ID NO: 18809 - protein, 6 aa, synthetic construct
  REGION 1..6: note = Synthetic Construct
TKFIEK

SEQ ID NO: 18810 - protein, 6 aa, synthetic construct
  REGION 1..6: note = Synthetic Construct
TKFIFK

SEQ ID NO: 18811 - protein, 6 aa, synthetic construct
  REGION 1..6: note = Synthetic Construct
TKFIGK

SEQ ID NO: 18812 - protein, 6 aa, synthetic construct
  REGION 1..6: note = Synthetic Construct
TKFIHK

SEQ ID NO: 18813 - protein, 6 aa, synthetic construct
  REGION 1..6: note = Synthetic Construct
TKFIIK

SEQ ID NO: 18814 - protein, 6 aa, synthetic construct
  REGION 1..6: note = Synthetic Construct
TKFILK

SEQ ID NO: 18815 - protein, 6 aa, synthetic construct
  REGION 1..6: note = Synthetic Construct
TKFINK

SEQ ID NO: 18816 - protein, 6 aa, synthetic construct
  REGION 1..6: note = Synthetic Construct
TKFIQK

SEQ ID NO: 18817 - protein, 6 aa, synthetic construct
  REGION 1..6: note = Synthetic Construct
TKFIRK

SEQ ID NO: 18818 - protein, 6 aa, synthetic construct
  REGION 1..6: note = Synthetic Construct
TKFISK

SEQ ID NO: 18819 - protein, 6 aa, synthetic construct
  REGION 1..6: note = Synthetic Construct
TKFITK

SEQ ID NO: 18820 - protein, 6 aa, synthetic construct
  REGION 1..6: note = Synthetic Construct
TKFIYK

SEQ ID NO: 18821 - protein, 6 aa, synthetic construct
  REGION 1..6: note = Synthetic Construct
TKFLAK

SEQ ID NO: 18822 - protein, 6 aa, synthetic construct
  REGION 1..6: note = Synthetic Construct
TKFLDK

SEQ ID NO: 18823 - protein, 6 aa, synthetic construct
  REGION 1..6: note = Synthetic Construct
TKFLEK

SEQ ID NO: 18824 - protein, 6 aa, synthetic construct
  REGION 1..6: note = Synthetic Construct
TKFLFK

SEQ ID NO: 18825 - protein, 6 aa, synthetic construct
  REGION 1..6: note = Synthetic Construct
TKFLGK

SEQ ID NO: 18826 - protein, 6 aa, synthetic construct
  REGION 1..6: note = Synthetic Construct
TKFLHK

SEQ ID NO: 18827 - protein, 6 aa, synthetic construct
  REGION 1..6: note = Synthetic Construct
TKFLIK

SEQ ID NO: 18828 - protein, 6 aa, synthetic construct
  REGION 1..6: note = Synthetic Construct
TKFLLK

SEQ ID NO: 18829 - protein, 6 aa, synthetic construct
  REGION 1..6: note = Synthetic Construct
TKFLNK

SEQ ID NO: 18830 - protein, 6 aa, synthetic construct
  REGION 1..6: note = Synthetic Construct
TKFLQK

SEQ ID NO: 18831 - protein, 6 aa, synthetic construct
  REGION 1..6: note = Synthetic Construct
TKFLRK

SEQ ID NO: 18832 - protein, 6 aa, synthetic construct
  REGION 1..6: note = Synthetic Construct
TKFLSK

SEQ ID NO: 18833 - protein, 6 aa, synthetic construct
  REGION 1..6: note = Synthetic Construct
TKFLTK

SEQ ID NO: 18834 - protein, 6 aa, synthetic construct
  REGION 1..6: note = Synthetic Construct
TKFLYK

SEQ ID NO: 18835 - protein, 6 aa, synthetic construct
  REGION 1..6: note = Synthetic Construct
TKFNAK

SEQ ID NO: 18836 - protein, 6 aa, synthetic construct
  REGION 1..6: note = Synthetic Construct
TKFNDK

SEQ ID NO: 18837 - protein, 6 aa, synthetic construct
  REGION 1..6: note = Synthetic Construct
TKFNEK

SEQ ID NO: 18838 - protein, 6 aa, synthetic construct
  REGION 1..6: note = Synthetic Construct
TKFNFK

SEQ ID NO: 18839 - protein, 6 aa, synthetic construct
  REGION 1..6: note = Synthetic Construct
TKFNGK

SEQ ID NO: 18840 - protein, 6 aa, synthetic construct
  REGION 1..6: note = Synthetic Construct
TKFNHK

SEQ ID NO: 18841 - protein, 6 aa, synthetic construct
  REGION 1..6: note = Synthetic Construct
TKFNIK

SEQ ID NO: 18842 - protein, 6 aa, synthetic construct
  REGION 1..6: note = Synthetic Construct
TKFNLK

SEQ ID NO: 18843 - protein, 6 aa, synthetic construct
  REGION 1..6: note = Synthetic Construct
TKFNNK

SEQ ID NO: 18844 - protein, 6 aa, synthetic construct
  REGION 1..6: note = Synthetic Construct
TKFNQK

SEQ ID NO: 18845 - protein, 6 aa, synthetic construct
  REGION 1..6: note = Synthetic Construct
TKFNRK

SEQ ID NO: 18846 - protein, 6 aa, synthetic construct
  REGION 1..6: note = Synthetic Construct
TKFNSK

SEQ ID NO: 18847 - protein, 6 aa, synthetic construct
  REGION 1..6: note = Synthetic Construct
TKFNTK

SEQ ID NO: 18848 - protein, 6 aa, synthetic construct
  REGION 1..6: note = Synthetic Construct
TKFNYK

SEQ ID NO: 18849 - protein, 6 aa, synthetic construct
  REGION 1..6: note = Synthetic Construct
TKFQAK

SEQ ID NO: 18850 - protein, 6 aa, synthetic construct
  REGION 1..6: note = Synthetic Construct
TKFQDK

SEQ ID NO: 18851 - protein, 6 aa, synthetic construct
  REGION 1..6: note = Synthetic Construct
TKFQEK

SEQ ID NO: 18852 - protein, 6 aa, synthetic construct
  REGION 1..6: note = Synthetic Construct
TKFQFK

SEQ ID NO: 18853 - protein, 6 aa, synthetic construct
  REGION 1..6: note = Synthetic Construct
TKFQGK

SEQ ID NO: 18854 - protein, 6 aa, synthetic construct
  REGION 1..6: note = Synthetic Construct
TKFQHK

SEQ ID NO: 18855 - protein, 6 aa, synthetic construct
  REGION 1..6: note = Synthetic Construct
TKFQIK

SEQ ID NO: 18856 - protein, 6 aa, synthetic construct
  REGION 1..6: note = Synthetic Construct
TKFQLK

SEQ ID NO: 18857 - protein, 6 aa, synthetic construct
  REGION 1..6: note = Synthetic Construct
TKFQNK

SEQ ID NO: 18858 - protein, 6 aa, synthetic construct
  REGION 1..6: note = Synthetic Construct
TKFQQK

SEQ ID NO: 18859 - protein, 6 aa, synthetic construct
  REGION 1..6: note = Synthetic Construct
TKFQRK

SEQ ID NO: 18860 - protein, 6 aa, synthetic construct
  REGION 1..6: note = Synthetic Construct
TKFQSK

SEQ ID NO: 18861 - protein, 6 aa, synthetic construct
  REGION 1..6: note = Synthetic Construct
TKFQTK

SEQ ID NO: 18862 - protein, 6 aa, synthetic construct
  REGION 1..6: note = Synthetic Construct
TKFQYK

SEQ ID NO: 18863 - protein, 6 aa, synthetic construct
  REGION 1..6: note = Synthetic Construct
TKFRAK

SEQ ID NO: 18864 - protein, 6 aa, synthetic construct
  REGION 1..6: note = Synthetic Construct
TKFRDK

SEQ ID NO: 18865 - protein, 6 aa, synthetic construct
  REGION 1..6: note = Synthetic Construct
TKFREK

SEQ ID NO: 18866 - protein, 6 aa, synthetic construct
  REGION 1..6: note = Synthetic Construct
TKFRFK

SEQ ID NO: 18867 - protein, 6 aa, synthetic construct
  REGION 1..6: note = Synthetic Construct
TKFRGK

SEQ ID NO: 18868 - protein, 6 aa, synthetic construct
  REGION 1..6: note = Synthetic Construct
TKFRHK

SEQ ID NO: 18869 - protein, 6 aa, synthetic construct
  REGION 1..6: note = Synthetic Construct
TKFRIK

SEQ ID NO: 18870 - protein, 6 aa, synthetic construct
  REGION 1..6: note = Synthetic Construct
TKFRLK

SEQ ID NO: 18871 - protein, 6 aa, synthetic construct
  REGION 1..6: note = Synthetic Construct
TKFRNK

SEQ ID NO: 18872 - protein, 6 aa, synthetic construct
  REGION 1..6: note = Synthetic Construct
TKFRQK

SEQ ID NO: 18873 - protein, 6 aa, synthetic construct
  REGION 1..6: note = Synthetic Construct
TKFRRK

SEQ ID NO: 18874 - protein, 6 aa, synthetic construct
  REGION 1..6: note = Synthetic Construct
TKFRSK

SEQ ID NO: 18875 - protein, 6 aa, synthetic construct
  REGION 1..6: note = Synthetic Construct
TKFRTK

SEQ ID NO: 18876 - protein, 6 aa, synthetic construct
  REGION 1..6: note = Synthetic Construct
TKFRYK

SEQ ID NO: 18877 - protein, 6 aa, synthetic construct
  REGION 1..6: note = Synthetic Construct
TKFSAK

SEQ ID NO: 18878 - protein, 6 aa, synthetic construct
  REGION 1..6: note = Synthetic Construct
TKFSDK

SEQ ID NO: 18879 - protein, 6 aa, synthetic construct
  REGION 1..6: note = Synthetic Construct
TKFSEK

SEQ ID NO: 18880 - protein, 6 aa, synthetic construct
  REGION 1..6: note = Synthetic Construct
TKFSFK

SEQ ID NO: 18881 - protein, 6 aa, synthetic construct
  REGION 1..6: note = Synthetic Construct
TKFSGK

SEQ ID NO: 18882 - protein, 6 aa, synthetic construct
  REGION 1..6: note = Synthetic Construct
TKFSHK

SEQ ID NO: 18883 - protein, 6 aa, synthetic construct
  REGION 1..6: note = Synthetic Construct
TKFSIK

SEQ ID NO: 18884 - protein, 6 aa, synthetic construct
  REGION 1..6: note = Synthetic Construct
TKFSLK

SEQ ID NO: 18885 - protein, 6 aa, synthetic construct
  REGION 1..6: note = Synthetic Construct
TKFSNK

SEQ ID NO: 18886 - protein, 6 aa, synthetic construct
  REGION 1..6: note = Synthetic Construct
TKFSQK

SEQ ID NO: 18887 - protein, 6 aa, synthetic construct
  REGION 1..6: note = Synthetic Construct
TKFSRK

SEQ ID NO: 18888 - protein, 6 aa, synthetic construct
  REGION 1..6: note = Synthetic Construct
TKFSSK

SEQ ID NO: 18889 - protein, 6 aa, synthetic construct
  REGION 1..6: note = Synthetic Construct
TKFSTK

SEQ ID NO: 18890 - protein, 6 aa, synthetic construct
  REGION 1..6: note = Synthetic Construct
TKFSYK

SEQ ID NO: 18891 - protein, 6 aa, synthetic construct
  REGION 1..6: note = Synthetic Construct
TKFTAK

SEQ ID NO: 18892 - protein, 6 aa, synthetic construct
  REGION 1..6: note = Synthetic Construct
TKFTDK

SEQ ID NO: 18893 - protein, 6 aa, synthetic construct
  REGION 1..6: note = Synthetic Construct
TKFTEK

SEQ ID NO: 18894 - protein, 6 aa, synthetic construct
  REGION 1..6: note = Synthetic Construct
TKFTFK

SEQ ID NO: 18895 - protein, 6 aa, synthetic construct
  REGION 1..6: note = Synthetic Construct
TKFTGK

SEQ ID NO: 18896 - protein, 6 aa, synthetic construct
  REGION 1..6: note = Synthetic Construct
TKFTHK

SEQ ID NO: 18897 - protein, 6 aa, synthetic construct
  REGION 1..6: note = Synthetic Construct
TKFTIK

SEQ ID NO: 18898 - protein, 6 aa, synthetic construct
  REGION 1..6: note = Synthetic Construct
TKFTLK

SEQ ID NO: 18899 - protein, 6 aa, synthetic construct
  REGION 1..6: note = Synthetic Construct
TKFTNK

SEQ ID NO: 18900 - protein, 6 aa, synthetic construct
  REGION 1..6: note = Synthetic Construct
TKFTQK

SEQ ID NO: 18901 - protein, 6 aa, synthetic construct
  REGION 1..6: note = Synthetic Construct
TKFTRK

SEQ ID NO: 18902 - protein, 6 aa, synthetic construct
  REGION 1..6: note = Synthetic Construct
TKFTSK

SEQ ID NO: 18903 - protein, 6 aa, synthetic construct
  REGION 1..6: note = Synthetic Construct
TKFTTK

SEQ ID NO: 18904 - protein, 6 aa, synthetic construct
  REGION 1..6: note = Synthetic Construct
TKFTYK

SEQ ID NO: 18905 - protein, 6 aa, synthetic construct
  REGION 1..6: note = Synthetic Construct
TKFYAK

SEQ ID NO: 18906 - protein, 6 aa, synthetic construct
  REGION 1..6: note = Synthetic Construct
TKFYDK

SEQ ID NO: 18907 - protein, 6 aa, synthetic construct
  REGION 1..6: note = Synthetic Construct
TKFYEK

SEQ ID NO: 18908 - protein, 6 aa, synthetic construct
  REGION 1..6: note = Synthetic Construct
TKFYFK

SEQ ID NO: 18909 - protein, 6 aa, synthetic construct
  REGION 1..6: note = Synthetic Construct
TKFYGK

SEQ ID NO: 18910 - protein, 6 aa, synthetic construct
  REGION 1..6: note = Synthetic Construct
TKFYHK

SEQ ID NO: 18911 - protein, 6 aa, synthetic construct
  REGION 1..6: note = Synthetic Construct
TKFYIK

SEQ ID NO: 18912 - protein, 6 aa, synthetic construct
  REGION 1..6: note = Synthetic Construct
TKFYLK

SEQ ID NO: 18913 - protein, 6 aa, synthetic construct
  REGION 1..6: note = Synthetic Construct
TKFYNK

SEQ ID NO: 18914 - protein, 6 aa, synthetic construct
  REGION 1..6: note = Synthetic Construct
TKFYQK

SEQ ID NO: 18915 - protein, 6 aa, synthetic construct
  REGION 1..6: note = Synthetic Construct
TKFYRK

SEQ ID NO: 18916 - protein, 6 aa, synthetic construct
  REGION 1..6: note = Synthetic Construct
TKFYSK

SEQ ID NO: 18917 - protein, 6 aa, synthetic construct
  REGION 1..6: note = Synthetic Construct
TKFYTK

SEQ ID NO: 18918 - protein, 6 aa, synthetic construct
  REGION 1..6: note = Synthetic Construct
TKFYYK

SEQ ID NO: 18919 - protein, 6 aa, synthetic construct
  REGION 1..6: note = Synthetic Construct
TKGAAK

SEQ ID NO: 18920 - protein, 6 aa, synthetic construct
  REGION 1..6: note = Synthetic Construct
TKGADK

SEQ ID NO: 18921 - protein, 6 aa, synthetic construct
  REGION 1..6: note = Synthetic Construct
TKGAEK

SEQ ID NO: 18922 - protein, 6 aa, synthetic construct
  REGION 1..6: note = Synthetic Construct
TKGAFK

SEQ ID NO: 18923 - protein, 6 aa, synthetic construct
  REGION 1..6: note = Synthetic Construct
TKGAGK

SEQ ID NO: 18924 - protein, 6 aa, synthetic construct
  REGION 1..6: note = Synthetic Construct
TKGAHK

SEQ ID NO: 18925 - protein, 6 aa, synthetic construct
  REGION 1..6: note = Synthetic Construct
TKGAIK

SEQ ID NO: 18926 - protein, 6 aa, synthetic construct
  REGION 1..6: note = Synthetic Construct
TKGALK

SEQ ID NO: 18927 - protein, 6 aa, synthetic construct
  REGION 1..6: note = Synthetic Construct
TKGANK

SEQ ID NO: 18928 - protein, 6 aa, synthetic construct
  REGION 1..6: note = Synthetic Construct
TKGAQK

SEQ ID NO: 18929 - protein, 6 aa, synthetic construct
  REGION 1..6: note = Synthetic Construct
TKGARK

SEQ ID NO: 18930 - protein, 6 aa, synthetic construct
  REGION 1..6: note = Synthetic Construct
TKGASK

SEQ ID NO: 18931 - protein, 6 aa, synthetic construct
  REGION 1..6: note = Synthetic Construct
TKGATK

SEQ ID NO: 18932 - protein, 6 aa, synthetic construct
  REGION 1..6: note = Synthetic Construct
TKGAYK

SEQ ID NO: 18933 - protein, 6 aa, synthetic construct
  REGION 1..6: note = Synthetic Construct
TKGDAK

SEQ ID NO: 18934 - protein, 6 aa, synthetic construct
  REGION 1..6: note = Synthetic Construct
TKGDDK

SEQ ID NO: 18935 - protein, 6 aa, synthetic construct
  REGION 1..6: note = Synthetic Construct
TKGDEK

SEQ ID NO: 18936 - protein, 6 aa, synthetic construct
  REGION 1..6: note = Synthetic Construct
TKGDFK

SEQ ID NO: 18937 - protein, 6 aa, synthetic construct
  REGION 1..6: note = Synthetic Construct
TKGDGK

SEQ ID NO: 18938 - protein, 6 aa, synthetic construct
  REGION 1..6: note = Synthetic Construct
TKGDHK

SEQ ID NO: 18939 - protein, 6 aa, synthetic construct
  REGION 1..6: note = Synthetic Construct
TKGDIK

SEQ ID NO: 18940 - protein, 6 aa, synthetic construct
  REGION 1..6: note = Synthetic Construct
TKGDLK

SEQ ID NO: 18941 - protein, 6 aa, synthetic construct
  REGION 1..6: note = Synthetic Construct
TKGDNK

SEQ ID NO: 18942 - protein, 6 aa, synthetic construct
  REGION 1..6: note = Synthetic Construct
TKGDQK

SEQ ID NO: 18943 - protein, 6 aa, synthetic construct
  REGION 1..6: note = Synthetic Construct
TKGDRK

SEQ ID NO: 18944 - protein, 6 aa, synthetic construct
  REGION 1..6: note = Synthetic Construct
TKGDSK

SEQ ID NO: 18945 - protein, 6 aa, synthetic construct
  REGION 1..6: note = Synthetic Construct
TKGDTK

SEQ ID NO: 18946 - protein, 6 aa, synthetic construct
  REGION 1..6: note = Synthetic Construct
TKGDYK

SEQ ID NO: 18947 - protein, 6 aa, synthetic construct
  REGION 1..6: note = Synthetic Construct
TKGEAK

SEQ ID NO: 18948 - protein, 6 aa, synthetic construct
  REGION 1..6: note = Synthetic Construct
TKGEDK

SEQ ID NO: 18949 - protein, 6 aa, synthetic construct
  REGION 1..6: note = Synthetic Construct
TKGEEK

SEQ ID NO: 18950 - protein, 6 aa, synthetic construct
  REGION 1..6: note = Synthetic Construct
TKGEFK

SEQ ID NO: 18951 - protein, 6 aa, synthetic construct
  REGION 1..6: note = Synthetic Construct
TKGEGK

SEQ ID NO: 18952 - protein, 6 aa, synthetic construct
  REGION 1..6: note = Synthetic Construct
TKGEHK

SEQ ID NO: 18953 - protein, 6 aa, synthetic construct
  REGION 1..6: note = Synthetic Construct
TKGEIK

SEQ ID NO: 18954 - protein, 6 aa, synthetic construct
  REGION 1..6: note = Synthetic Construct
TKGELK

SEQ ID NO: 18955 - protein, 6 aa, synthetic construct
  REGION 1..6: note = Synthetic Construct
TKGENK

SEQ ID NO: 18956 - protein, 6 aa, synthetic construct
  REGION 1..6: note = Synthetic Construct
TKGEQK

SEQ ID NO: 18957 - protein, 6 aa, synthetic construct
  REGION 1..6: note = Synthetic Construct
TKGERK

SEQ ID NO: 18958 - protein, 6 aa, synthetic construct
  REGION 1..6: note = Synthetic Construct
TKGESK

SEQ ID NO: 18959 - protein, 6 aa, synthetic construct
  REGION 1..6: note = Synthetic Construct
TKGETK

SEQ ID NO: 18960 - protein, 6 aa, synthetic construct
  REGION 1..6: note = Synthetic Construct
TKGEYK

SEQ ID NO: 18961 - protein, 6 aa, synthetic construct
  REGION 1..6: note = Synthetic Construct
TKGFAK

SEQ ID NO: 18962 - protein, 6 aa, synthetic construct
  REGION 1..6: note = Synthetic Construct
TKGFDK

SEQ ID NO: 18963 - protein, 6 aa, synthetic construct
  REGION 1..6: note = Synthetic Construct
TKGFEK

SEQ ID NO: 18964 - protein, 6 aa, synthetic construct
  REGION 1..6: note = Synthetic Construct
TKGFFK

SEQ ID NO: 18965 - protein, 6 aa, synthetic construct
  REGION 1..6: note = Synthetic Construct
TKGFGK

SEQ ID NO: 18966 - protein, 6 aa, synthetic construct
  REGION 1..6: note = Synthetic Construct
TKGFHK

SEQ ID NO: 18967 - protein, 6 aa, synthetic construct
  REGION 1..6: note = Synthetic Construct
TKGFIK

SEQ ID NO: 18968 - protein, 6 aa, synthetic construct
  REGION 1..6: note = Synthetic Construct
TKGFLK

SEQ ID NO: 18969 - protein, 6 aa, synthetic construct
  REGION 1..6: note = Synthetic Construct
TKGFNK

SEQ ID NO: 18970 - protein, 6 aa, synthetic construct
  REGION 1..6: note = Synthetic Construct
TKGFQK

SEQ ID NO: 18971 - protein, 6 aa, synthetic construct
  REGION 1..6: note = Synthetic Construct
TKGFRK

SEQ ID NO: 18972 - protein, 6 aa, synthetic construct
  REGION 1..6: note = Synthetic Construct
TKGFSK

SEQ ID NO: 18973 - protein, 6 aa, synthetic construct
  REGION 1..6: note = Synthetic Construct
TKGFTK

SEQ ID NO: 18974 - protein, 6 aa, synthetic construct
  REGION 1..6: note = Synthetic Construct
TKGFYK

SEQ ID NO: 18975 - protein, 6 aa, synthetic construct
  REGION 1..6: note = Synthetic Construct
TKGGAK

SEQ ID NO: 18976 - protein, 6 aa, synthetic construct
  REGION 1..6: note = Synthetic Construct
TKGGDK

SEQ ID NO: 18977 - protein, 6 aa, synthetic construct
  REGION 1..6: note = Synthetic Construct
TKGGEK

SEQ ID NO: 18978 - protein, 6 aa, synthetic construct
  REGION 1..6: note = Synthetic Construct
TKGGFK

SEQ ID NO: 18979 - protein, 6 aa, synthetic construct
  REGION 1..6: note = Synthetic Construct
TKGGGK

SEQ ID NO: 18980 - protein, 6 aa, synthetic construct
  REGION 1..6: note = Synthetic Construct
TKGGHK

SEQ ID NO: 18981 - protein, 6 aa, synthetic construct
  REGION 1..6: note = Synthetic Construct
TKGGIK

SEQ ID NO: 18982 - protein, 6 aa, synthetic construct
  REGION 1..6: note = Synthetic Construct
TKGGLK

SEQ ID NO: 18983 - protein, 6 aa, synthetic construct
  REGION 1..6: note = Synthetic Construct
TKGGNK

SEQ ID NO: 18984 - protein, 6 aa, synthetic construct
  REGION 1..6: note = Synthetic Construct
TKGGQK

SEQ ID NO: 18985 - protein, 6 aa, synthetic construct
  REGION 1..6: note = Synthetic Construct
TKGGRK

SEQ ID NO: 18986 - protein, 6 aa, synthetic construct
  REGION 1..6: note = Synthetic Construct
TKGGSK

SEQ ID NO: 18987 - protein, 6 aa, synthetic construct
  REGION 1..6: note = Synthetic Construct
TKGGTK

SEQ ID NO: 18988 - protein, 6 aa, synthetic construct
  REGION 1..6: note = Synthetic Construct
TKGGYK

SEQ ID NO: 18989 - protein, 6 aa, synthetic construct
  REGION 1..6: note = Synthetic Construct
TKGHAK

SEQ ID NO: 18990 - protein, 6 aa, synthetic construct
  REGION 1..6: note = Synthetic Construct
TKGHDK

SEQ ID NO: 18991 - protein, 6 aa, synthetic construct
  REGION 1..6: note = Synthetic Construct
TKGHEK

SEQ ID NO: 18992 - protein, 6 aa, synthetic construct
  REGION 1..6: note = Synthetic Construct
TKGHFK

SEQ ID NO: 18993 - protein, 6 aa, synthetic construct
  REGION 1..6: note = Synthetic Construct
TKGHGK

SEQ ID NO: 18994 - protein, 6 aa, synthetic construct
  REGION 1..6: note = Synthetic Construct
TKGHHK

SEQ ID NO: 18995 - protein, 6 aa, synthetic construct
  REGION 1..6: note = Synthetic Construct
TKGHIK

SEQ ID NO: 18996 - protein, 6 aa, synthetic construct
  REGION 1..6: note = Synthetic Construct
TKGHLK

SEQ ID NO: 18997 - protein, 6 aa, synthetic construct
  REGION 1..6: note = Synthetic Construct
TKGHNK

SEQ ID NO: 18998 - protein, 6 aa, synthetic construct
  REGION 1..6: note = Synthetic Construct
TKGHQK

SEQ ID NO: 18999 - protein, 6 aa, synthetic construct
  REGION 1..6: note = Synthetic Construct
TKGHRK

SEQ ID NO: 19000 - protein, 6 aa, synthetic construct
  REGION 1..6: note = Synthetic Construct
TKGHSK

SEQ ID NO: 19001 - protein, 6 aa, synthetic construct
  REGION 1..6: note = Synthetic Construct
TKGHTK

SEQ ID NO: 19002 - protein, 6 aa, synthetic construct
  REGION 1..6: note = Synthetic Construct
TKGHYK

SEQ ID NO: 19003 - protein, 6 aa, synthetic construct
  REGION 1..6: note = Synthetic Construct
TKGIAK

SEQ ID NO: 19004 - protein, 6 aa, synthetic construct
  REGION 1..6: note = Synthetic Construct
TKGIDK

SEQ ID NO: 19005 - protein, 6 aa, synthetic construct
  REGION 1..6: note = Synthetic Construct
TKGIEK

SEQ ID NO: 19006 - protein, 6 aa, synthetic construct
  REGION 1..6: note = Synthetic Construct
TKGIFK

SEQ ID NO: 19007 - protein, 6 aa, synthetic construct
  REGION 1..6: note = Synthetic Construct
TKGIGK

SEQ ID NO: 19008 - protein, 6 aa, synthetic construct
  REGION 1..6: note = Synthetic Construct
TKGIHK

SEQ ID NO: 19009 - protein, 6 aa, synthetic construct
  REGION 1..6: note = Synthetic Construct
TKGIIK

SEQ ID NO: 19010 - protein, 6 aa, synthetic construct
  REGION 1..6: note = Synthetic Construct
TKGILK

SEQ ID NO: 19011 - protein, 6 aa, synthetic construct
  REGION 1..6: note = Synthetic Construct
TKGINK

SEQ ID NO: 19012 - protein, 6 aa, synthetic construct
  REGION 1..6: note = Synthetic Construct
TKGIQK

SEQ ID NO: 19013 - protein, 6 aa, synthetic construct
  REGION 1..6: note = Synthetic Construct
TKGIRK

SEQ ID NO: 19014 - protein, 6 aa, synthetic construct
  REGION 1..6: note = Synthetic Construct
TKGISK

SEQ ID NO: 19015 - protein, 6 aa, synthetic construct
  REGION 1..6: note = Synthetic Construct
TKGITK

SEQ ID NO: 19016 - protein, 6 aa, synthetic construct
  REGION 1..6: note = Synthetic Construct
TKGIYK

SEQ ID NO: 19017 - protein, 6 aa, synthetic construct
  REGION 1..6: note = Synthetic Construct
TKGLAK

SEQ ID NO: 19018 - protein, 6 aa, synthetic construct
  REGION 1..6: note = Synthetic Construct
TKGLDK

SEQ ID NO: 19019 - protein, 6 aa, synthetic construct
  REGION 1..6: note = Synthetic Construct
TKGLEK

SEQ ID NO: 19020 - protein, 6 aa, synthetic construct
  REGION 1..6: note = Synthetic Construct
TKGLFK

SEQ ID NO: 19021 - protein, 6 aa, synthetic construct
  REGION 1..6: note = Synthetic Construct
TKGLGK

SEQ ID NO: 19022 - protein, 6 aa, synthetic construct
  REGION 1..6: note = Synthetic Construct
TKGLHK

SEQ ID NO: 19023 - protein, 6 aa, synthetic construct
  REGION 1..6: note = Synthetic Construct
TKGLIK

SEQ ID NO: 19024 - protein, 6 aa, synthetic construct
  REGION 1..6: note = Synthetic Construct
TKGLLK

SEQ ID NO: 19025 - protein, 6 aa, synthetic construct
  REGION 1..6: note = Synthetic Construct
TKGLNK

SEQ ID NO: 19026 - protein, 6 aa, synthetic construct
  REGION 1..6: note = Synthetic Construct
TKGLQK

SEQ ID NO: 19027 - protein, 6 aa, synthetic construct
  REGION 1..6: note = Synthetic Construct
TKGLRK

SEQ ID NO: 19028 - protein, 6 aa, synthetic construct
  REGION 1..6: note = Synthetic Construct
TKGLSK

SEQ ID NO: 19029 - protein, 6 aa, synthetic construct
  REGION 1..6: note = Synthetic Construct
TKGLTK

SEQ ID NO: 19030 - protein, 6 aa, synthetic construct
  REGION 1..6: note = Synthetic Construct
TKGLYK

SEQ ID NO: 19031 - protein, 6 aa, synthetic construct
  REGION 1..6: note = Synthetic Construct
TKGNAK

SEQ ID NO: 19032 - protein, 6 aa, synthetic construct
  REGION 1..6: note = Synthetic Construct
TKGNDK

SEQ ID NO: 19033 - protein, 6 aa, synthetic construct
  REGION 1..6: note = Synthetic Construct
TKGNEK

SEQ ID NO: 19034 - protein, 6 aa, synthetic construct
  REGION 1..6: note = Synthetic Construct
TKGNFK

SEQ ID NO: 19035 - protein, 6 aa, synthetic construct
  REGION 1..6: note = Synthetic Construct
TKGNGK

SEQ ID NO: 19036 - protein, 6 aa, synthetic construct
  REGION 1..6: note = Synthetic Construct
TKGNHK

SEQ ID NO: 19037 - protein, 6 aa, synthetic construct
  REGION 1..6: note = Synthetic Construct
TKGNIK

SEQ ID NO: 19038 - protein, 6 aa, synthetic construct
  REGION 1..6: note = Synthetic Construct
TKGNLK

SEQ ID NO: 19039 - protein, 6 aa, synthetic construct
  REGION 1..6: note = Synthetic Construct
TKGNNK

SEQ ID NO: 19040 - protein, 6 aa, synthetic construct
  REGION 1..6: note = Synthetic Construct
TKGNQK

SEQ ID NO: 19041 - protein, 6 aa, synthetic construct
  REGION 1..6: note = Synthetic Construct
TKGNRK

SEQ ID NO: 19042 - protein, 6 aa, synthetic construct
  REGION 1..6: note = Synthetic Construct
TKGNSK

SEQ ID NO: 19043 - protein, 6 aa, synthetic construct
  REGION 1..6: note = Synthetic Construct
TKGNTK

SEQ ID NO: 19044 - protein, 6 aa, synthetic construct
  REGION 1..6: note = Synthetic Construct
TKGNYK

SEQ ID NO: 19045 - protein, 6 aa, synthetic construct
  REGION 1..6: note = Synthetic Construct
TKGQAK

SEQ ID NO: 19046 - protein, 6 aa, synthetic construct
  REGION 1..6: note = Synthetic Construct
TKGQDK

SEQ ID NO: 19047 - protein, 6 aa, synthetic construct
  REGION 1..6: note = Synthetic Construct
TKGQEK

SEQ ID NO: 19048 - protein, 6 aa, synthetic construct
  REGION 1..6: note = Synthetic Construct
TKGQFK

SEQ ID NO: 19049 - protein, 6 aa, synthetic construct
  REGION 1..6: note = Synthetic Construct
TKGQGK

SEQ ID NO: 19050 - protein, 6 aa, synthetic construct
  REGION 1..6: note = Synthetic Construct
TKGQHK

SEQ ID NO: 19051 - protein, 6 aa, synthetic construct
  REGION 1..6: note = Synthetic Construct
TKGQIK

SEQ ID NO: 19052 - protein, 6 aa, synthetic construct
  REGION 1..6: note = Synthetic Construct
TKGQLK

SEQ ID NO: 19053 - protein, 6 aa, synthetic construct
  REGION 1..6: note = Synthetic Construct
TKGQNK

SEQ ID NO: 19054 - protein, 6 aa, synthetic construct
  REGION 1..6: note = Synthetic Construct
TKGQQK

SEQ ID NO: 19055 - protein, 6 aa, synthetic construct
  REGION 1..6: note = Synthetic Construct
TKGQRK

SEQ ID NO: 19056 - protein, 6 aa, synthetic construct
  REGION 1..6: note = Synthetic Construct
TKGQSK

SEQ ID NO: 19057 - protein, 6 aa, synthetic construct
  REGION 1..6: note = Synthetic Construct
TKGQTK

SEQ ID NO: 19058 - protein, 6 aa, synthetic construct
  REGION 1..6: note = Synthetic Construct
TKGQYK

SEQ ID NO: 19059 - protein, 6 aa, synthetic construct
  REGION 1..6: note = Synthetic Construct
TKGRAK

SEQ ID NO: 19060 - protein, 6 aa, synthetic construct
  REGION 1..6: note = Synthetic Construct
TKGRDK

SEQ ID NO: 19061 - protein, 6 aa, synthetic construct
  REGION 1..6: note = Synthetic Construct
TKGREK

SEQ ID NO: 19062 - protein, 6 aa, synthetic construct
  REGION 1..6: note = Synthetic Construct
TKGRFK

SEQ ID NO: 19063 - protein, 6 aa, synthetic construct
  REGION 1..6: note = Synthetic Construct
TKGRGK

SEQ ID NO: 19064 - protein, 6 aa, synthetic construct
  REGION 1..6: note = Synthetic Construct
TKGRHK

SEQ ID NO: 19065 - protein, 6 aa, synthetic construct
  REGION 1..6: note = Synthetic Construct
TKGRIK

SEQ ID NO: 19066 - protein, 6 aa, synthetic construct
  REGION 1..6: note = Synthetic Construct
TKGRLK

SEQ ID NO: 19067 - protein, 6 aa, synthetic construct
  REGION 1..6: note = Synthetic Construct
TKGRNK

SEQ ID NO: 19068 - protein, 6 aa, synthetic construct
  REGION 1..6: note = Synthetic Construct
TKGRQK

SEQ ID NO: 19069 - protein, 6 aa, synthetic construct
  REGION 1..6: note = Synthetic Construct
TKGRRK

SEQ ID NO: 19070 - protein, 6 aa, synthetic construct
  REGION 1..6: note = Synthetic Construct
TKGRSK

SEQ ID NO: 19071 - protein, 6 aa, synthetic construct
  REGION 1..6: note = Synthetic Construct
TKGRTK

SEQ ID NO: 19072 - protein, 6 aa, synthetic construct
  REGION 1..6: note = Synthetic Construct
TKGRYK

SEQ ID NO: 19073 - protein, 6 aa, synthetic construct
  REGION 1..6: note = Synthetic Construct
TKGSAK

SEQ ID NO: 19074 - protein, 6 aa, synthetic construct
  REGION 1..6: note = Synthetic Construct
TKGSDK

SEQ ID NO: 19075 - protein, 6 aa, synthetic construct
  REGION 1..6: note = Synthetic Construct
TKGSEK

SEQ ID NO: 19076 - protein, 6 aa, synthetic construct
  REGION 1..6: note = Synthetic Construct
TKGSFK

SEQ ID NO: 19077 - protein, 6 aa, synthetic construct
  REGION 1..6: note = Synthetic Construct
TKGSGK

SEQ ID NO: 19078 - protein, 6 aa, synthetic construct
  REGION 1..6: note = Synthetic Construct
TKGSHK

SEQ ID NO: 19079 - protein, 6 aa, synthetic construct
  REGION 1..6: note = Synthetic Construct
TKGSIK

SEQ ID NO: 19080 - protein, 6 aa, synthetic construct
  REGION 1..6: note = Synthetic Construct
TKGSLK

SEQ ID NO: 19081 - protein, 6 aa, synthetic construct
  REGION 1..6: note = Synthetic Construct
TKGSNK

SEQ ID NO: 19082 - protein, 6 aa, synthetic construct
  REGION 1..6: note = Synthetic Construct
TKGSQK

SEQ ID NO: 19083 - protein, 6 aa, synthetic construct
  REGION 1..6: note = Synthetic Construct
TKGSRK

SEQ ID NO: 19084 - protein, 6 aa, synthetic construct
  REGION 1..6: note = Synthetic Construct
TKGSSK

SEQ ID NO: 19085 - protein, 6 aa, synthetic construct
  REGION 1..6: note = Synthetic Construct
TKGSTK

SEQ ID NO: 19086 - protein, 6 aa, synthetic construct
  REGION 1..6: note = Synthetic Construct
TKGSYK

SEQ ID NO: 19087 - protein, 6 aa, synthetic construct
  REGION 1..6: note = Synthetic Construct
TKGTAK

SEQ ID NO: 19088 - protein, 6 aa, synthetic construct
  REGION 1..6: note = Synthetic Construct
TKGTDK

SEQ ID NO: 19089 - protein, 6 aa, synthetic construct
  REGION 1..6: note = Synthetic Construct
TKGTEK

SEQ ID NO: 19090 - protein, 6 aa, synthetic construct
  REGION 1..6: note = Synthetic Construct
TKGTFK

SEQ ID NO: 19091 - protein, 6 aa, synthetic construct
  REGION 1..6: note = Synthetic Construct
TKGTGK

SEQ ID NO: 19092 - protein, 6 aa, synthetic construct
  REGION 1..6: note = Synthetic Construct
TKGTHK

SEQ ID NO: 19093 - protein, 6 aa, synthetic construct
  REGION 1..6: note = Synthetic Construct
TKGTIK

SEQ ID NO: 19094 - protein, 6 aa, synthetic construct
  REGION 1..6: note = Synthetic Construct
TKGTLK

SEQ ID NO: 19095 - protein, 6 aa, synthetic construct
  REGION 1..6: note = Synthetic Construct
TKGTNK

SEQ ID NO: 19096 - protein, 6 aa, synthetic construct
  REGION 1..6: note = Synthetic Construct
TKGTQK

SEQ ID NO: 19097 - protein, 6 aa, synthetic construct
  REGION 1..6: note = Synthetic Construct
TKGTRK

SEQ ID NO: 19098 - protein, 6 aa, synthetic construct
  REGION 1..6: note = Synthetic Construct
TKGTSK

SEQ ID NO: 19099 - protein, 6 aa, synthetic construct
  REGION 1..6: note = Synthetic Construct
TKGTTK

SEQ ID NO: 19100 - protein, 6 aa, synthetic construct
  REGION 1..6: note = Synthetic Construct
TKGTYK

SEQ ID NO: 19101 - protein, 6 aa, synthetic construct
  REGION 1..6: note = Synthetic Construct
TKGYAK

SEQ ID NO: 19102 - protein, 6 aa, synthetic construct
  REGION 1..6: note = Synthetic Construct
TKGYDK

SEQ ID NO: 19103 - protein, 6 aa, synthetic construct
  REGION 1..6: note = Synthetic Construct
TKGYEK

SEQ ID NO: 19104 - protein, 6 aa, synthetic construct
  REGION 1..6: note = Synthetic Construct
TKGYFK

SEQ ID NO: 19105 - protein, 6 aa, synthetic construct
  REGION 1..6: note = Synthetic Construct
TKGYGK

SEQ ID NO: 19106 - protein, 6 aa, synthetic construct
  REGION 1..6: note = Synthetic Construct
TKGYHK

SEQ ID NO: 19107 - protein, 6 aa, synthetic construct
  REGION 1..6: note = Synthetic Construct
TKGYIK

SEQ ID NO: 19108 - protein, 6 aa, synthetic construct
  REGION 1..6: note = Synthetic Construct
TKGYLK

SEQ ID NO: 19109 - protein, 6 aa, synthetic construct
  REGION 1..6: note = Synthetic Construct
TKGYNK

SEQ ID NO: 19110 - protein, 6 aa, synthetic construct
  REGION 1..6: note = Synthetic Construct
TKGYQK

SEQ ID NO: 19111 - protein, 6 aa, synthetic construct
  REGION 1..6: note = Synthetic Construct
TKGYRK

SEQ ID NO: 19112 - protein, 6 aa, synthetic construct
  REGION 1..6: note = Synthetic Construct
TKGYSK

SEQ ID NO: 19113 - protein, 6 aa, synthetic construct
  REGION 1..6: note = Synthetic Construct
TKGYTK

SEQ ID NO: 19114 - protein, 6 aa, synthetic construct
  REGION 1..6: note = Synthetic Construct
TKGYYK

SEQ ID NO: 19115 - protein, 6 aa, synthetic construct
  REGION 1..6: note = Synthetic Construct
TKHAAK

SEQ ID NO: 19116 - protein, 6 aa, synthetic construct
  REGION 1..6: note = Synthetic Construct
TKHADK

SEQ ID NO: 19117 - protein, 6 aa, synthetic construct
  REGION 1..6: note = Synthetic Construct
TKHAEK

SEQ ID NO: 19118 - protein, 6 aa, synthetic construct
  REGION 1..6: note = Synthetic Construct
TKHAFK

SEQ ID NO: 19119 - protein, 6 aa, synthetic construct
  REGION 1..6: note = Synthetic Construct
TKHAGK

SEQ ID NO: 19120 - protein, 6 aa, synthetic construct
  REGION 1..6: note = Synthetic Construct
TKHAHK

SEQ ID NO: 19121 - protein, 6 aa, synthetic construct
  REGION 1..6: note = Synthetic Construct
TKHAIK

SEQ ID NO: 19122 - protein, 6 aa, synthetic construct
  REGION 1..6: note = Synthetic Construct
TKHALK

SEQ ID NO: 19123 - protein, 6 aa, synthetic construct
  REGION 1..6: note = Synthetic Construct
TKHANK

SEQ ID NO: 19124 - protein, 6 aa, synthetic construct
  REGION 1..6: note = Synthetic Construct
TKHAQK

SEQ ID NO: 19125 - protein, 6 aa, synthetic construct
  REGION 1..6: note = Synthetic Construct
TKHARK

SEQ ID NO: 19126 - protein, 6 aa, synthetic construct
  REGION 1..6: note = Synthetic Construct
TKHASK

SEQ ID NO: 19127 - protein, 6 aa, synthetic construct
  REGION 1..6: note = Synthetic Construct
TKHATK

SEQ ID NO: 19128 - protein, 6 aa, synthetic construct
  REGION 1..6: note = Synthetic Construct
TKHAYK

SEQ ID NO: 19129 - protein, 6 aa, synthetic construct
  REGION 1..6: note = Synthetic Construct
TKHDAK

SEQ ID NO: 19130 - protein, 6 aa, synthetic construct
  REGION 1..6: note = Synthetic Construct
TKHDDK

SEQ ID NO: 19131 - protein, 6 aa, synthetic construct
  REGION 1..6: note = Synthetic Construct
TKHDEK

SEQ ID NO: 19132 - protein, 6 aa, synthetic construct
  REGION 1..6: note = Synthetic Construct
TKHDFK

SEQ ID NO: 19133 - protein, 6 aa, synthetic construct
  REGION 1..6: note = Synthetic Construct
TKHDGK

SEQ ID NO: 19134 - protein, 6 aa, synthetic construct
  REGION 1..6: note = Synthetic Construct
TKHDHK

SEQ ID NO: 19135 - protein, 6 aa, synthetic construct
  REGION 1..6: note = Synthetic Construct
TKHDIK

SEQ ID NO: 19136 - protein, 6 aa, synthetic construct
  REGION 1..6: note = Synthetic Construct
TKHDLK

SEQ ID NO: 19137 - protein, 6 aa, synthetic construct
  REGION 1..6: note = Synthetic Construct
TKHDNK

SEQ ID NO: 19138 - protein, 6 aa, synthetic construct
  REGION 1..6: note = Synthetic Construct
TKHDQK

SEQ ID NO: 19139 - protein, 6 aa, synthetic construct
  REGION 1..6: note = Synthetic Construct
TKHDRK

SEQ ID NO: 19140 - protein, 6 aa, synthetic construct
  REGION 1..6: note = Synthetic Construct
TKHDSK

SEQ ID NO: 19141 - protein, 6 aa, synthetic construct
  REGION 1..6: note = Synthetic Construct
TKHDTK

SEQ ID NO: 19142 - protein, 6 aa, synthetic construct
  REGION 1..6: note = Synthetic Construct
TKHDYK

SEQ ID NO: 19143 - protein, 6 aa, synthetic construct
  REGION 1..6: note = Synthetic Construct
TKHEAK

SEQ ID NO: 19144 - protein, 6 aa, synthetic construct
  REGION 1..6: note = Synthetic Construct
TKHEDK

SEQ ID NO: 19145 - protein, 6 aa, synthetic construct
  REGION 1..6: note = Synthetic Construct
TKHEEK

SEQ ID NO: 19146 - protein, 6 aa, synthetic construct
  REGION 1..6: note = Synthetic Construct
TKHEFK

SEQ ID NO: 19147 - protein, 6 aa, synthetic construct
  REGION 1..6: note = Synthetic Construct
TKHEGK

SEQ ID NO: 19148 - protein, 6 aa, synthetic construct
  REGION 1..6: note = Synthetic Construct
TKHEHK

SEQ ID NO: 19149 - protein, 6 aa, synthetic construct
  REGION 1..6: note = Synthetic Construct
TKHEIK

SEQ ID NO: 19150 - protein, 6 aa, synthetic construct
  REGION 1..6: note = Synthetic Construct
TKHELK

SEQ ID NO: 19151 - protein, 6 aa, synthetic construct
  REGION 1..6: note = Synthetic Construct
TKHENK

SEQ ID NO: 19152 - protein, 6 aa, synthetic construct
  REGION 1..6: note = Synthetic Construct
TKHEQK

SEQ ID NO: 19153 - protein, 6 aa, synthetic construct
  REGION 1..6: note = Synthetic Construct
TKHERK

SEQ ID NO: 19154 - protein, 6 aa, synthetic construct
  REGION 1..6: note = Synthetic Construct
TKHESK

SEQ ID NO: 19155 - protein, 6 aa, synthetic construct
  REGION 1..6: note = Synthetic Construct
TKHETK

SEQ ID NO: 19156 - protein, 6 aa, synthetic construct
  REGION 1..6: note = Synthetic Construct
TKHEYK

SEQ ID NO: 19157 - protein, 6 aa, synthetic construct
  REGION 1..6: note = Synthetic Construct
TKHFAK

SEQ ID NO: 19158 - protein, 6 aa, synthetic construct
  REGION 1..6: note = Synthetic Construct
TKHFDK

SEQ ID NO: 19159 - protein, 6 aa, synthetic construct
  REGION 1..6: note = Synthetic Construct
TKHFEK

SEQ ID NO: 19160 - protein, 6 aa, synthetic construct
  REGION 1..6: note = Synthetic Construct
TKHFFK

SEQ ID NO: 19161 - protein, 6 aa, synthetic construct
  REGION 1..6: note = Synthetic Construct
TKHFGK

SEQ ID NO: 19162 - protein, 6 aa, synthetic construct
  REGION 1..6: note = Synthetic Construct
TKHFHK

SEQ ID NO: 19163 - protein, 6 aa, synthetic construct
  REGION 1..6: note = Synthetic Construct
TKHFIK

SEQ ID NO: 19164 - protein, 6 aa, synthetic construct
  REGION 1..6: note = Synthetic Construct
TKHFLK

SEQ ID NO: 19165 - protein, 6 aa, synthetic construct
  REGION 1..6: note = Synthetic Construct
TKHFNK

SEQ ID NO: 19166 - protein, 6 aa, synthetic construct
  REGION 1..6: note = Synthetic Construct
TKHFQK

SEQ ID NO: 19167 - protein, 6 aa, synthetic construct
  REGION 1..6: note = Synthetic Construct
TKHFRK

SEQ ID NO: 19168 - protein, 6 aa, synthetic construct
  REGION 1..6: note = Synthetic Construct
TKHFSK

SEQ ID NO: 19169 - protein, 6 aa, synthetic construct
  REGION 1..6: note = Synthetic Construct
TKHFTK

SEQ ID NO: 19170 - protein, 6 aa, synthetic construct
  REGION 1..6: note = Synthetic Construct
TKHFYK

SEQ ID NO: 19171 - protein, 6 aa, synthetic construct
  REGION 1..6: note = Synthetic Construct
TKHGAK

SEQ ID NO: 19172 - protein, 6 aa, synthetic construct
  REGION 1..6: note = Synthetic Construct
TKHGDK

SEQ ID NO: 19173 - protein, 6 aa, synthetic construct
  REGION 1..6: note = Synthetic Construct
TKHGEK

SEQ ID NO: 19174 - protein, 6 aa, synthetic construct
  REGION 1..6: note = Synthetic Construct
TKHGFK

SEQ ID NO: 19175 - protein, 6 aa, synthetic construct
  REGION 1..6: note = Synthetic Construct
TKHGGK

SEQ ID NO: 19176 - protein, 6 aa, synthetic construct
  REGION 1..6: note = Synthetic Construct
TKHGHK

SEQ ID NO: 19177 - protein, 6 aa, synthetic construct
  REGION 1..6: note = Synthetic Construct
TKHGIK

SEQ ID NO: 19178 - protein, 6 aa, synthetic construct
  REGION 1..6: note = Synthetic Construct
TKHGLK

SEQ ID NO: 19179 - protein, 6 aa, synthetic construct
  REGION 1..6: note = Synthetic Construct
TKHGNK

SEQ ID NO: 19180 - protein, 6 aa, synthetic construct
  REGION 1..6: note = Synthetic Construct
TKHGQK

SEQ ID NO: 19181 - protein, 6 aa, synthetic construct
  REGION 1..6: note = Synthetic Construct
TKHGRK

SEQ ID NO: 19182 - protein, 6 aa, synthetic construct
  REGION 1..6: note = Synthetic Construct
TKHGSK

SEQ ID NO: 19183 - protein, 6 aa, synthetic construct
  REGION 1..6: note = Synthetic Construct
TKHGTK

SEQ ID NO: 19184 - protein, 6 aa, synthetic construct
  REGION 1..6: note = Synthetic Construct
TKHGYK

SEQ ID NO: 19185 - protein, 6 aa, synthetic construct
  REGION 1..6: note = Synthetic Construct
TKHHAK

SEQ ID NO: 19186 - protein, 6 aa, synthetic construct
  REGION 1..6: note = Synthetic Construct
TKHHDK

SEQ ID NO: 19187 - protein, 6 aa, synthetic construct
  REGION 1..6: note = Synthetic Construct
TKHHEK

SEQ ID NO: 19188 - protein, 6 aa, synthetic construct
  REGION 1..6: note = Synthetic Construct
TKHHFK

SEQ ID NO: 19189 - protein, 6 aa, synthetic construct
  REGION 1..6: note = Synthetic Construct
TKHHGK

SEQ ID NO: 19190 - protein, 6 aa, synthetic construct
  REGION 1..6: note = Synthetic Construct
TKHHHK

SEQ ID NO: 19191 - protein, 6 aa, synthetic construct
  REGION 1..6: note = Synthetic Construct
TKHHIK

SEQ ID NO: 19192 - protein, 6 aa, synthetic construct
  REGION 1..6: note = Synthetic Construct
TKHHLK

SEQ ID NO: 19193 - protein, 6 aa, synthetic construct
  REGION 1..6: note = Synthetic Construct
TKHHNK

SEQ ID NO: 19194 - protein, 6 aa, synthetic construct
  REGION 1..6: note = Synthetic Construct
TKHHQK

SEQ ID NO: 19195 - protein, 6 aa, synthetic construct
  REGION 1..6: note = Synthetic Construct
TKHHRK

SEQ ID NO: 19196 - protein, 6 aa, synthetic construct
  REGION 1..6: note = Synthetic Construct
TKHHSK

SEQ ID NO: 19197 - protein, 6 aa, synthetic construct
  REGION 1..6: note = Synthetic Construct
TKHHTK

SEQ ID NO: 19198 - protein, 6 aa, synthetic construct
  REGION 1..6: note = Synthetic Construct
TKHHYK

SEQ ID NO: 19199 - protein, 6 aa, synthetic construct
  REGION 1..6: note = Synthetic Construct
TKHIAK

SEQ ID NO: 19200 - protein, 6 aa, synthetic construct
  REGION 1..6: note = Synthetic Construct
TKHIDK

SEQ ID NO: 19201 - protein, 6 aa, synthetic construct
  REGION 1..6: note = Synthetic Construct
TKHIEK

SEQ ID NO: 19202 - protein, 6 aa, synthetic construct
  REGION 1..6: note = Synthetic Construct
TKHIFK

SEQ ID NO: 19203 - protein, 6 aa, synthetic construct
  REGION 1..6: note = Synthetic Construct
TKHIGK

SEQ ID NO: 19204 - protein, 6 aa, synthetic construct
  REGION 1..6: note = Synthetic Construct
TKHIHK

SEQ ID NO: 19205 - protein, 6 aa, synthetic construct
  REGION 1..6: note = Synthetic Construct
TKHIIK

SEQ ID NO: 19206 - protein, 6 aa, synthetic construct
  REGION 1..6: note = Synthetic Construct
TKHILK

SEQ ID NO: 19207 - protein, 6 aa, synthetic construct
  REGION 1..6: note = Synthetic Construct
TKHINK

SEQ ID NO: 19208 - protein, 6 aa, synthetic construct
  REGION 1..6: note = Synthetic Construct
TKHIQK

SEQ ID NO: 19209 - protein, 6 aa, synthetic construct
  REGION 1..6: note = Synthetic Construct
TKHIRK

SEQ ID NO: 19210 - protein, 6 aa, synthetic construct
  REGION 1..6: note = Synthetic Construct
TKHISK

SEQ ID NO: 19211 - protein, 6 aa, synthetic construct
  REGION 1..6: note = Synthetic Construct
TKHITK

SEQ ID NO: 19212 - protein, 6 aa, synthetic construct
  REGION 1..6: note = Synthetic Construct
TKHIYK

SEQ ID NO: 19213 - protein, 6 aa, synthetic construct
  REGION 1..6: note = Synthetic Construct
TKHLAK

SEQ ID NO: 19214 - protein, 6 aa, synthetic construct
  REGION 1..6: note = Synthetic Construct
TKHLDK

SEQ ID NO: 19215 - protein, 6 aa, synthetic construct
  REGION 1..6: note = Synthetic Construct
TKHLEK

SEQ ID NO: 19216 - protein, 6 aa, synthetic construct
  REGION 1..6: note = Synthetic Construct
TKHLFK

SEQ ID NO: 19217 - protein, 6 aa, synthetic construct
  REGION 1..6: note = Synthetic Construct
TKHLGK

SEQ ID NO: 19218 - protein, 6 aa, synthetic construct
  REGION 1..6: note = Synthetic Construct
TKHLHK

SEQ ID NO: 19219 - protein, 6 aa, synthetic construct
  REGION 1..6: note = Synthetic Construct
TKHLIK

SEQ ID NO: 19220 - protein, 6 aa, synthetic construct
  REGION 1..6: note = Synthetic Construct
TKHLLK

SEQ ID NO: 19221 - protein, 6 aa, synthetic construct
  REGION 1..6: note = Synthetic Construct
TKHLNK

SEQ ID NO: 19222 - protein, 6 aa, synthetic construct
  REGION 1..6: note = Synthetic Construct
TKHLQK

SEQ ID NO: 19223 - protein, 6 aa, synthetic construct
  REGION 1..6: note = Synthetic Construct
TKHLRK

SEQ ID NO: 19224 - protein, 6 aa, synthetic construct
  REGION 1..6: note = Synthetic Construct
TKHLSK

SEQ ID NO: 19225 - protein, 6 aa, synthetic construct
  REGION 1..6: note = Synthetic Construct
TKHLTK

SEQ ID NO: 19226 - protein, 6 aa, synthetic construct
  REGION 1..6: note = Synthetic Construct
TKHLYK

SEQ ID NO: 19227 - protein, 6 aa, synthetic construct
  REGION 1..6: note = Synthetic Construct
TKHNAK

SEQ ID NO: 19228 - protein, 6 aa, synthetic construct
  REGION 1..6: note = Synthetic Construct
TKHNDK

SEQ ID NO: 19229 - protein, 6 aa, synthetic construct
  REGION 1..6: note = Synthetic Construct
TKHNEK

SEQ ID NO: 19230 - protein, 6 aa, synthetic construct
  REGION 1..6: note = Synthetic Construct
TKHNFK

SEQ ID NO: 19231 - protein, 6 aa, synthetic construct
  REGION 1..6: note = Synthetic Construct
TKHNGK

SEQ ID NO: 19232 - protein, 6 aa, synthetic construct
  REGION 1..6: note = Synthetic Construct
TKHNHK

SEQ ID NO: 19233 - protein, 6 aa, synthetic construct
  REGION 1..6: note = Synthetic Construct
TKHNIK

SEQ ID NO: 19234 - protein, 6 aa, synthetic construct
  REGION 1..6: note = Synthetic Construct
TKHNLK

SEQ ID NO: 19235 - protein, 6 aa, synthetic construct
  REGION 1..6: note = Synthetic Construct
TKHNNK

SEQ ID NO: 19236 - protein, 6 aa, synthetic construct
  REGION 1..6: note = Synthetic Construct
TKHNQK

SEQ ID NO: 19237 - protein, 6 aa, synthetic construct
  REGION 1..6: note = Synthetic Construct
TKHNRK

SEQ ID NO: 19238 - protein, 6 aa, synthetic construct
  REGION 1..6: note = Synthetic Construct
TKHNSK

SEQ ID NO: 19239 - protein, 6 aa, synthetic construct
  REGION 1..6: note = Synthetic Construct
TKHNTK

SEQ ID NO: 19240 - protein, 6 aa, synthetic construct
  REGION 1..6: note = Synthetic Construct
TKHNYK

SEQ ID NO: 19241 - protein, 6 aa, synthetic construct
  REGION 1..6: note = Synthetic Construct
TKHQAK

SEQ ID NO: 19242 - protein, 6 aa, synthetic construct
  REGION 1..6: note = Synthetic Construct
TKHQDK

SEQ ID NO: 19243 - protein, 6 aa, synthetic construct
  REGION 1..6: note = Synthetic Construct
TKHQEK

SEQ ID NO: 19244 - protein, 6 aa, synthetic construct
  REGION 1..6: note = Synthetic Construct
TKHQFK

SEQ ID NO: 19245 - protein, 6 aa, synthetic construct
  REGION 1..6: note = Synthetic Construct
TKHQGK

SEQ ID NO: 19246 - protein, 6 aa, synthetic construct
  REGION 1..6: note = Synthetic Construct
TKHQHK

SEQ ID NO: 19247 - protein, 6 aa, synthetic construct
  REGION 1..6: note = Synthetic Construct
TKHQIK

SEQ ID NO: 19248 - protein, 6 aa, synthetic construct
  REGION 1..6: note = Synthetic Construct
TKHQLK

SEQ ID NO: 19249 - protein, 6 aa, synthetic construct
  REGION 1..6: note = Synthetic Construct
TKHQNK

SEQ ID NO: 19250 - protein, 6 aa, synthetic construct
  REGION 1..6: note = Synthetic Construct
TKHQQK

SEQ ID NO: 19251 - protein, 6 aa, synthetic construct
  REGION 1..6: note = Synthetic Construct
TKHQRK

SEQ ID NO: 19252 - protein, 6 aa, synthetic construct
  REGION 1..6: note = Synthetic Construct
TKHQSK

SEQ ID NO: 19253 - protein, 6 aa, synthetic construct
  REGION 1..6: note = Synthetic Construct
TKHQTK

SEQ ID NO: 19254 - protein, 6 aa, synthetic construct
  REGION 1..6: note = Synthetic Construct
TKHQYK

SEQ ID NO: 19255 - protein, 6 aa, synthetic construct
  REGION 1..6: note = Synthetic Construct
TKHRAK

SEQ ID NO: 19256 - protein, 6 aa, synthetic construct
  REGION 1..6: note = Synthetic Construct
TKHRDK

SEQ ID NO: 19257 - protein, 6 aa, synthetic construct
  REGION 1..6: note = Synthetic Construct
TKHREK

SEQ ID NO: 19258 - protein, 6 aa, synthetic construct
  REGION 1..6: note = Synthetic Construct
TKHRFK

SEQ ID NO: 19259 - protein, 6 aa, synthetic construct
  REGION 1..6: note = Synthetic Construct
TKHRGK

SEQ ID NO: 19260 - protein, 6 aa, synthetic construct
  REGION 1..6: note = Synthetic Construct
TKHRHK

SEQ ID NO: 19261 - protein, 6 aa, synthetic construct
  REGION 1..6: note = Synthetic Construct
TKHRIK

SEQ ID NO: 19262 - protein, 6 aa, synthetic construct
  REGION 1..6: note = Synthetic Construct
TKHRLK

SEQ ID NO: 19263 - protein, 6 aa, synthetic construct
  REGION 1..6: note = Synthetic Construct
TKHRNK

SEQ ID NO: 19264 - protein, 6 aa, synthetic construct
  REGION 1..6: note = Synthetic Construct
TKHRQK

SEQ ID NO: 19265 - protein, 6 aa, synthetic construct
  REGION 1..6: note = Synthetic Construct
TKHRRK

SEQ ID NO: 19266 - protein, 6 aa, synthetic construct
  REGION 1..6: note = Synthetic Construct
TKHRSK

SEQ ID NO: 19267 - protein, 6 aa, synthetic construct
  REGION 1..6: note = Synthetic Construct
TKHRTK

SEQ ID NO: 19268 - protein, 6 aa, synthetic construct
  REGION 1..6: note = Synthetic Construct
TKHRYK

SEQ ID NO: 19269 - protein, 6 aa, synthetic construct
  REGION 1..6: note = Synthetic Construct
TKHSAK

SEQ ID NO: 19270 - protein, 6 aa, synthetic construct
  REGION 1..6: note = Synthetic Construct
TKHSDK

SEQ ID NO: 19271 - protein, 6 aa, synthetic construct
  REGION 1..6: note = Synthetic Construct
TKHSEK

SEQ ID NO: 19272 - protein, 6 aa, synthetic construct
  REGION 1..6: note = Synthetic Construct
TKHSFK

SEQ ID NO: 19273 - protein, 6 aa, synthetic construct
  REGION 1..6: note = Synthetic Construct
TKHSGK

SEQ ID NO: 19274 - protein, 6 aa, synthetic construct
  REGION 1..6: note = Synthetic Construct
TKHSHK

SEQ ID NO: 19275 - protein, 6 aa, synthetic construct
  REGION 1..6: note = Synthetic Construct
TKHSIK

SEQ ID NO: 19276 - protein, 6 aa, synthetic construct
  REGION 1..6: note = Synthetic Construct
TKHSLK

SEQ ID NO: 19277 - protein, 6 aa, synthetic construct
  REGION 1..6: note = Synthetic Construct
TKHSNK

SEQ ID NO: 19278 - protein, 6 aa, synthetic construct
  REGION 1..6: note = Synthetic Construct
TKHSQK

SEQ ID NO: 19279 - protein, 6 aa, synthetic construct
  REGION 1..6: note = Synthetic Construct
TKHSRK

SEQ ID NO: 19280 - protein, 6 aa, synthetic construct
  REGION 1..6: note = Synthetic Construct
TKHSSK

SEQ ID NO: 19281 - protein, 6 aa, synthetic construct
  REGION 1..6: note = Synthetic Construct
TKHSTK

SEQ ID NO: 19282 - protein, 6 aa, synthetic construct
  REGION 1..6: note = Synthetic Construct
TKHSYK

SEQ ID NO: 19283 - protein, 6 aa, synthetic construct
  REGION 1..6: note = Synthetic Construct
TKHTAK

SEQ ID NO: 19284 - protein, 6 aa, synthetic construct
  REGION 1..6: note = Synthetic Construct
TKHTDK

SEQ ID NO: 19285 - protein, 6 aa, synthetic construct
  REGION 1..6: note = Synthetic Construct
TKHTEK

SEQ ID NO: 19286 - protein, 6 aa, synthetic construct
  REGION 1..6: note = Synthetic Construct
TKHTFK

SEQ ID NO: 19287 - protein, 6 aa, synthetic construct
  REGION 1..6: note = Synthetic Construct
TKHTGK

SEQ ID NO: 19288 - protein, 6 aa, synthetic construct
  REGION 1..6: note = Synthetic Construct
TKHTHK

SEQ ID NO: 19289 - protein, 6 aa, synthetic construct
  REGION 1..6: note = Synthetic Construct
TKHTIK

SEQ ID NO: 19290 - protein, 6 aa, synthetic construct
  REGION 1..6: note = Synthetic Construct
TKHTLK

SEQ ID NO: 19291 - protein, 6 aa, synthetic construct
  REGION 1..6: note = Synthetic Construct
TKHTNK

SEQ ID NO: 19292 - protein, 6 aa, synthetic construct
  REGION 1..6: note = Synthetic Construct
TKHTQK

SEQ ID NO: 19293 - protein, 6 aa, synthetic construct
  REGION 1..6: note = Synthetic Construct
TKHTRK

SEQ ID NO: 19294 - protein, 6 aa, synthetic construct
  REGION 1..6: note = Synthetic Construct
TKHTSK

SEQ ID NO: 19295 - protein, 6 aa, synthetic construct
  REGION 1..6: note = Synthetic Construct
TKHTTK

SEQ ID NO: 19296 - protein, 6 aa, synthetic construct
  REGION 1..6: note = Synthetic Construct
TKHTYK

SEQ ID NO: 19297 - protein, 6 aa, synthetic construct
  REGION 1..6: note = Synthetic Construct
TKHYAK

SEQ ID NO: 19298 - protein, 6 aa, synthetic construct
  REGION 1..6: note = Synthetic Construct
TKHYDK

SEQ ID NO: 19299 - protein, 6 aa, synthetic construct
  REGION 1..6: note = Synthetic Construct
TKHYEK

SEQ ID NO: 19300 - protein, 6 aa, synthetic construct
  REGION 1..6: note = Synthetic Construct
TKHYFK

SEQ ID NO: 19301 - protein, 6 aa, synthetic construct
  REGION 1..6: note = Synthetic Construct
TKHYGK

SEQ ID NO: 19302 - protein, 6 aa, synthetic construct
  REGION 1..6: note = Synthetic Construct
TKHYHK

SEQ ID NO: 19303 - protein, 6 aa, synthetic construct
  REGION 1..6: note = Synthetic Construct
TKHYIK

SEQ ID NO: 19304 - protein, 6 aa, synthetic construct
  REGION 1..6: note = Synthetic Construct
TKHYLK

SEQ ID NO: 19305 - protein, 6 aa, synthetic construct
  REGION 1..6: note = Synthetic Construct
TKHYNK

SEQ ID NO: 19306 - protein, 6 aa, synthetic construct
  REGION 1..6: note = Synthetic Construct
TKHYQK

SEQ ID NO: 19307 - protein, 6 aa, synthetic construct
  REGION 1..6: note = Synthetic Construct
TKHYRK

SEQ ID NO: 19308 - protein, 6 aa, synthetic construct
  REGION 1..6: note = Synthetic Construct
TKHYSK

SEQ ID NO: 19309 - protein, 6 aa, synthetic construct
  REGION 1..6: note = Synthetic Construct
TKHYTK

SEQ ID NO: 19310 - protein, 6 aa, synthetic construct
  REGION 1..6: note = Synthetic Construct
TKHYYK

SEQ ID NO: 19311 - protein, 6 aa, synthetic construct
  REGION 1..6: note = Synthetic Construct
TKIAAK

SEQ ID NO: 19312 - protein, 6 aa, synthetic construct
  REGION 1..6: note = Synthetic Construct
TKIADK

SEQ ID NO: 19313 - protein, 6 aa, synthetic construct
  REGION 1..6: note = Synthetic Construct
TKIAEK

SEQ ID NO: 19314 - protein, 6 aa, synthetic construct
  REGION 1..6: note = Synthetic Construct
TKIAFK

SEQ ID NO: 19315 - protein, 6 aa, synthetic construct
  REGION 1..6: note = Synthetic Construct
TKIAGK

SEQ ID NO: 19316 - protein, 6 aa, synthetic construct
  REGION 1..6: note = Synthetic Construct
TKIAHK

SEQ ID NO: 19317 - protein, 6 aa, synthetic construct
  REGION 1..6: note = Synthetic Construct
TKIAIK

SEQ ID NO: 19318 - protein, 6 aa, synthetic construct
  REGION 1..6: note = Synthetic Construct
TKIALK

SEQ ID NO: 19319 - protein, 6 aa, synthetic construct
  REGION 1..6: note = Synthetic Construct
TKIANK

SEQ ID NO: 19320 - protein, 6 aa, synthetic construct
  REGION 1..6: note = Synthetic Construct
TKIAQK

SEQ ID NO: 19321 - protein, 6 aa, synthetic construct
  REGION 1..6: note = Synthetic Construct
TKIARK

SEQ ID NO: 19322 - protein, 6 aa, synthetic construct
  REGION 1..6: note = Synthetic Construct
TKIASK

SEQ ID NO: 19323 - protein, 6 aa, synthetic construct
  REGION 1..6: note = Synthetic Construct
TKIATK

SEQ ID NO: 19324 - protein, 6 aa, synthetic construct
  REGION 1..6: note = Synthetic Construct
TKIAYK

SEQ ID NO: 19325 - protein, 6 aa, synthetic construct
  REGION 1..6: note = Synthetic Construct
TKIDAK

SEQ ID NO: 19326 - protein, 6 aa, synthetic construct
  REGION 1..6: note = Synthetic Construct
TKIDDK

SEQ ID NO: 19327 - protein, 6 aa, synthetic construct
  REGION 1..6: note = Synthetic Construct
TKIDEK

SEQ ID NO: 19328 - protein, 6 aa, synthetic construct
  REGION 1..6: note = Synthetic Construct
TKIDFK

SEQ ID NO: 19329 - protein, 6 aa, synthetic construct
  REGION 1..6: note = Synthetic Construct
TKIDGK

SEQ ID NO: 19330 - protein, 6 aa, synthetic construct
  REGION 1..6: note = Synthetic Construct
TKIDHK

SEQ ID NO: 19331 - protein, 6 aa, synthetic construct
  REGION 1..6: note = Synthetic Construct
TKIDIK

SEQ ID NO: 19332 - protein, 6 aa, synthetic construct
  REGION 1..6: note = Synthetic Construct
TKIDLK

SEQ ID NO: 19333 - protein, 6 aa, synthetic construct
  REGION 1..6: note = Synthetic Construct
TKIDNK

SEQ ID NO: 19334 - protein, 6 aa, synthetic construct
  REGION 1..6: note = Synthetic Construct
TKIDQK

SEQ ID NO: 19335 - protein, 6 aa, synthetic construct
  REGION 1..6: note = Synthetic Construct
TKIDRK

SEQ ID NO: 19336 - protein, 6 aa, synthetic construct
  REGION 1..6: note = Synthetic Construct
TKIDSK

SEQ ID NO: 19337 - protein, 6 aa, synthetic construct
  REGION 1..6: note = Synthetic Construct
TKIDTK

SEQ ID NO: 19338 - protein, 6 aa, synthetic construct
  REGION 1..6: note = Synthetic Construct
TKIDYK

SEQ ID NO: 19339 - protein, 6 aa, synthetic construct
  REGION 1..6: note = Synthetic Construct
TKIEAK

SEQ ID NO: 19340 - protein, 6 aa, synthetic construct
  REGION 1..6: note = Synthetic Construct
TKIEDK

SEQ ID NO: 19341 - protein, 6 aa, synthetic construct
  REGION 1..6: note = Synthetic Construct
TKIEEK

SEQ ID NO: 19342 - protein, 6 aa, synthetic construct
  REGION 1..6: note = Synthetic Construct
TKIEFK

SEQ ID NO: 19343 - protein, 6 aa, synthetic construct
  REGION 1..6: note = Synthetic Construct
TKIEGK

SEQ ID NO: 19344 - protein, 6 aa, synthetic construct
  REGION 1..6: note = Synthetic Construct
TKIEHK

SEQ ID NO: 19345 - protein, 6 aa, synthetic construct
  REGION 1..6: note = Synthetic Construct
TKIEIK

SEQ ID NO: 19346 - protein, 6 aa, synthetic construct
  REGION 1..6: note = Synthetic Construct
TKIELK

SEQ ID NO: 19347 - protein, 6 aa, synthetic construct
  REGION 1..6: note = Synthetic Construct
TKIENK

SEQ ID NO: 19348 - protein, 6 aa, synthetic construct
  REGION 1..6: note = Synthetic Construct
TKIEQK

SEQ ID NO: 19349 - protein, 6 aa, synthetic construct
  REGION 1..6: note = Synthetic Construct
TKIERK

SEQ ID NO: 19350 - protein, 6 aa, synthetic construct
  REGION 1..6: note = Synthetic Construct
TKIESK

SEQ ID NO: 19351 - protein, 6 aa, synthetic construct
  REGION 1..6: note = Synthetic Construct
TKIETK

SEQ ID NO: 19352 - protein, 6 aa, synthetic construct
  REGION 1..6: note = Synthetic Construct
TKIEYK

SEQ ID NO: 19353 - protein, 6 aa, synthetic construct
  REGION 1..6: note = Synthetic Construct
TKIFAK

SEQ ID NO: 19354 - protein, 6 aa, synthetic construct
  REGION 1..6: note = Synthetic Construct
TKIFDK

SEQ ID NO: 19355 - protein, 6 aa, synthetic construct
  REGION 1..6: note = Synthetic Construct
TKIFEK

SEQ ID NO: 19356 - protein, 6 aa, synthetic construct
  REGION 1..6: note = Synthetic Construct
TKIFFK

SEQ ID NO: 19357 - protein, 6 aa, synthetic construct
  REGION 1..6: note = Synthetic Construct
TKIFGK

SEQ ID NO: 19358 - protein, 6 aa, synthetic construct
  REGION 1..6: note = Synthetic Construct
TKIFHK

SEQ ID NO: 19359 - protein, 6 aa, synthetic construct
  REGION 1..6: note = Synthetic Construct
TKIFIK

SEQ ID NO: 19360 - protein, 6 aa, synthetic construct
  REGION 1..6: note = Synthetic Construct
TKIFLK

SEQ ID NO: 19361 - protein, 6 aa, synthetic construct
  REGION 1..6: note = Synthetic Construct
TKIFNK

SEQ ID NO: 19362 - protein, 6 aa, synthetic construct
  REGION 1..6: note = Synthetic Construct
TKIFQK

SEQ ID NO: 19363 - protein, 6 aa, synthetic construct
  REGION 1..6: note = Synthetic Construct
TKIFRK

SEQ ID NO: 19364 - protein, 6 aa, synthetic construct
  REGION 1..6: note = Synthetic Construct
TKIFSK

SEQ ID NO: 19365 - protein, 6 aa, synthetic construct
  REGION 1..6: note = Synthetic Construct
TKIFTK

SEQ ID NO: 19366 - protein, 6 aa, synthetic construct
  REGION 1..6: note = Synthetic Construct
TKIFYK

SEQ ID NO: 19367 - protein, 6 aa, synthetic construct
  REGION 1..6: note = Synthetic Construct
TKIGAK

SEQ ID NO: 19368 - protein, 6 aa, synthetic construct
  REGION 1..6: note = Synthetic Construct
TKIGDK

SEQ ID NO: 19369 - protein, 6 aa, synthetic construct
  REGION 1..6: note = Synthetic Construct
TKIGEK

SEQ ID NO: 19370 - protein, 6 aa, synthetic construct
  REGION 1..6: note = Synthetic Construct
TKIGFK

SEQ ID NO: 19371 - protein, 6 aa, synthetic construct
  REGION 1..6: note = Synthetic Construct
TKIGGK

SEQ ID NO: 19372 - protein, 6 aa, synthetic construct
  REGION 1..6: note = Synthetic Construct
TKIGHK

SEQ ID NO: 19373 - protein, 6 aa, synthetic construct
  REGION 1..6: note = Synthetic Construct
TKIGIK

SEQ ID NO: 19374 - protein, 6 aa, synthetic construct
  REGION 1..6: note = Synthetic Construct
TKIGLK

SEQ ID NO: 19375 - protein, 6 aa, synthetic construct
  REGION 1..6: note = Synthetic Construct
TKIGNK

SEQ ID NO: 19376 - protein, 6 aa, synthetic construct
  REGION 1..6: note = Synthetic Construct
TKIGQK

SEQ ID NO: 19377 - protein, 6 aa, synthetic construct
  REGION 1..6: note = Synthetic Construct
TKIGRK

SEQ ID NO: 19378 - protein, 6 aa, synthetic construct
  REGION 1..6: note = Synthetic Construct
TKIGSK

SEQ ID NO: 19379 - protein, 6 aa, synthetic construct
  REGION 1..6: note = Synthetic Construct
TKIGTK

SEQ ID NO: 19380 - protein, 6 aa, synthetic construct
  REGION 1..6: note = Synthetic Construct
TKIGYK

SEQ ID NO: 19381 - protein, 6 aa, synthetic construct
  REGION 1..6: note = Synthetic Construct
TKIHAK

SEQ ID NO: 19382 - protein, 6 aa, synthetic construct
  REGION 1..6: note = Synthetic Construct
TKIHDK

SEQ ID NO: 19383 - protein, 6 aa, synthetic construct
  REGION 1..6: note = Synthetic Construct
TKIHEK

SEQ ID NO: 19384 - protein, 6 aa, synthetic construct
  REGION 1..6: note = Synthetic Construct
TKIHFK

SEQ ID NO: 19385 - protein, 6 aa, synthetic construct
  REGION 1..6: note = Synthetic Construct
TKIHGK

SEQ ID NO: 19386 - protein, 6 aa, synthetic construct
  REGION 1..6: note = Synthetic Construct
TKIHHK

SEQ ID NO: 19387 - protein, 6 aa, synthetic construct
  REGION 1..6: note = Synthetic Construct
TKIHIK

SEQ ID NO: 19388 - protein, 6 aa, synthetic construct
  REGION 1..6: note = Synthetic Construct
TKIHLK

SEQ ID NO: 19389 - protein, 6 aa, synthetic construct
  REGION 1..6: note = Synthetic Construct
TKIHNK

SEQ ID NO: 19390 - protein, 6 aa, synthetic construct
  REGION 1..6: note = Synthetic Construct
TKIHQK

SEQ ID NO: 19391 - protein, 6 aa, synthetic construct
  REGION 1..6: note = Synthetic Construct
TKIHRK

SEQ ID NO: 19392 - protein, 6 aa, synthetic construct
  REGION 1..6: note = Synthetic Construct
TKIHSK

SEQ ID NO: 19393 - protein, 6 aa, synthetic construct
  REGION 1..6: note = Synthetic Construct
TKIHTK

SEQ ID NO: 19394 - protein, 6 aa, synthetic construct
  REGION 1..6: note = Synthetic Construct
TKIHYK

SEQ ID NO: 19395 - protein, 6 aa, synthetic construct
  REGION 1..6: note = Synthetic Construct
TKIIAK

SEQ ID NO: 19396 - protein, 6 aa, synthetic construct
  REGION 1..6: note = Synthetic Construct
TKIIDK

SEQ ID NO: 19397 - protein, 6 aa, synthetic construct
  REGION 1..6: note = Synthetic Construct
TKIIEK

SEQ ID NO: 19398 - protein, 6 aa, synthetic construct
  REGION 1..6: note = Synthetic Construct
TKIIFK

SEQ ID NO: 19399 - protein, 6 aa, synthetic construct
  REGION 1..6: note = Synthetic Construct
TKIIGK

SEQ ID NO: 19400 - protein, 6 aa, synthetic construct
  REGION 1..6: note = Synthetic Construct
TKIIHK

SEQ ID NO: 19401 - protein, 6 aa, synthetic construct
  REGION 1..6: note = Synthetic Construct
TKIIIK

SEQ ID NO: 19402 - protein, 6 aa, synthetic construct
  REGION 1..6: note = Synthetic Construct
TKIILK

SEQ ID NO: 19403 - protein, 6 aa, synthetic construct
  REGION 1..6: note = Synthetic Construct
TKIINK

SEQ ID NO: 19404 - protein, 6 aa, synthetic construct
  REGION 1..6: note = Synthetic Construct
TKIIQK

SEQ ID NO: 19405 - protein, 6 aa, synthetic construct
  REGION 1..6: note = Synthetic Construct
TKIIRK

SEQ ID NO: 19406 - protein, 6 aa, synthetic construct
  REGION 1..6: note = Synthetic Construct
TKIISK

SEQ ID NO: 19407 - protein, 6 aa, synthetic construct
  REGION 1..6: note = Synthetic Construct
TKIITK

SEQ ID NO: 19408 - protein, 6 aa, synthetic construct
  REGION 1..6: note = Synthetic Construct
TKIIYK

SEQ ID NO: 19409 - protein, 6 aa, synthetic construct
  REGION 1..6: note = Synthetic Construct
TKILAK

SEQ ID NO: 19410 - protein, 6 aa, synthetic construct
  REGION 1..6: note = Synthetic Construct
TKILDK

SEQ ID NO: 19411 - protein, 6 aa, synthetic construct
  REGION 1..6: note = Synthetic Construct
TKILEK

SEQ ID NO: 19412 - protein, 6 aa, synthetic construct
  REGION 1..6: note = Synthetic Construct
TKILFK

SEQ ID NO: 19413 - protein, 6 aa, synthetic construct
  REGION 1..6: note = Synthetic Construct
TKILGK

SEQ ID NO: 19414 - protein, 6 aa, synthetic construct
  REGION 1..6: note = Synthetic Construct
TKILHK

SEQ ID NO: 19415 - protein, 6 aa, synthetic construct
  REGION 1..6: note = Synthetic Construct
TKILIK

SEQ ID NO: 19416 - protein, 6 aa, synthetic construct
  REGION 1..6: note = Synthetic Construct
TKILLK

SEQ ID NO: 19417 - protein, 6 aa, synthetic construct
  REGION 1..6: note = Synthetic Construct
TKILNK

SEQ ID NO: 19418 - protein, 6 aa, synthetic construct
  REGION 1..6: note = Synthetic Construct
TKILQK

SEQ ID NO: 19419 - protein, 6 aa, synthetic construct
  REGION 1..6: note = Synthetic Construct
TKILRK

SEQ ID NO: 19420 - protein, 6 aa, synthetic construct
  REGION 1..6: note = Synthetic Construct
TKILSK

SEQ ID NO: 19421 - protein, 6 aa, synthetic construct
  REGION 1..6: note = Synthetic Construct
TKILTK

SEQ ID NO: 19422 - protein, 6 aa, synthetic construct
  REGION 1..6: note = Synthetic Construct
TKILYK

SEQ ID NO: 19423 - protein, 6 aa, synthetic construct
  REGION 1..6: note = Synthetic Construct
TKINAK

SEQ ID NO: 19424 - protein, 6 aa, synthetic construct
  REGION 1..6: note = Synthetic Construct
TKINDK

SEQ ID NO: 19425 - protein, 6 aa, synthetic construct
  REGION 1..6: note = Synthetic Construct
TKINEK

SEQ ID NO: 19426 - protein, 6 aa, synthetic construct
  REGION 1..6: note = Synthetic Construct
TKINFK

SEQ ID NO: 19427 - protein, 6 aa, synthetic construct
  REGION 1..6: note = Synthetic Construct
TKINGK

SEQ ID NO: 19428 - protein, 6 aa, synthetic construct
  REGION 1..6: note = Synthetic Construct
TKINHK

SEQ ID NO: 19429 - protein, 6 aa, synthetic construct
  REGION 1..6: note = Synthetic Construct
TKINIK

SEQ ID NO: 19430 - protein, 6 aa, synthetic construct
  REGION 1..6: note = Synthetic Construct
TKINLK

SEQ ID NO: 19431 - protein, 6 aa, synthetic construct
  REGION 1..6: note = Synthetic Construct
TKINNK

SEQ ID NO: 19432 - protein, 6 aa, synthetic construct
  REGION 1..6: note = Synthetic Construct
TKINQK

SEQ ID NO: 19433 - protein, 6 aa, synthetic construct
  REGION 1..6: note = Synthetic Construct
TKINRK

SEQ ID NO: 19434 - protein, 6 aa, synthetic construct
  REGION 1..6: note = Synthetic Construct
TKINSK

SEQ ID NO: 19435 - protein, 6 aa, synthetic construct
  REGION 1..6: note = Synthetic Construct
TKINTK

SEQ ID NO: 19436 - protein, 6 aa, synthetic construct
  REGION 1..6: note = Synthetic Construct
TKINYK

SEQ ID NO: 19437 - protein, 6 aa, synthetic construct
  REGION 1..6: note = Synthetic Construct
TKIQAK

SEQ ID NO: 19438 - protein, 6 aa, synthetic construct
  REGION 1..6: note = Synthetic Construct
TKIQDK

SEQ ID NO: 19439 - protein, 6 aa, synthetic construct
  REGION 1..6: note = Synthetic Construct
TKIQEK

SEQ ID NO: 19440 - protein, 6 aa, synthetic construct
  REGION 1..6: note = Synthetic Construct
TKIQFK

SEQ ID NO: 19441 - protein, 6 aa, synthetic construct
  REGION 1..6: note = Synthetic Construct
TKIQGK

SEQ ID NO: 19442 - protein, 6 aa, synthetic construct
  REGION 1..6: note = Synthetic Construct
TKIQHK

SEQ ID NO: 19443 - protein, 6 aa, synthetic construct
  REGION 1..6: note = Synthetic Construct
TKIQIK

SEQ ID NO: 19444 - protein, 6 aa, synthetic construct
  REGION 1..6: note = Synthetic Construct
TKIQLK

SEQ ID NO: 19445 - protein, 6 aa, synthetic construct
  REGION 1..6: note = Synthetic Construct
TKIQNK

SEQ ID NO: 19446 - protein, 6 aa, synthetic construct
  REGION 1..6: note = Synthetic Construct
TKIQQK

SEQ ID NO: 19447 - protein, 6 aa, synthetic construct
  REGION 1..6: note = Synthetic Construct
TKIQRK

SEQ ID NO: 19448 - protein, 6 aa, synthetic construct
  REGION 1..6: note = Synthetic Construct
TKIQSK

SEQ ID NO: 19449 - protein, 6 aa, synthetic construct
  REGION 1..6: note = Synthetic Construct
TKIQTK

SEQ ID NO: 19450 - protein, 6 aa, synthetic construct
  REGION 1..6: note = Synthetic Construct
TKIQYK

SEQ ID NO: 19451 - protein, 6 aa, synthetic construct
  REGION 1..6: note = Synthetic Construct
TKIRAK

SEQ ID NO: 19452 - protein, 6 aa, synthetic construct
  REGION 1..6: note = Synthetic Construct
TKIRDK

SEQ ID NO: 19453 - protein, 6 aa, synthetic construct
  REGION 1..6: note = Synthetic Construct
TKIREK

SEQ ID NO: 19454 - protein, 6 aa, synthetic construct
  REGION 1..6: note = Synthetic Construct
TKIRFK

SEQ ID NO: 19455 - protein, 6 aa, synthetic construct
  REGION 1..6: note = Synthetic Construct
TKIRGK

SEQ ID NO: 19456 - protein, 6 aa, synthetic construct
  REGION 1..6: note = Synthetic Construct
TKIRHK

SEQ ID NO: 19457 - protein, 6 aa, synthetic construct
  REGION 1..6: note = Synthetic Construct
TKIRIK

SEQ ID NO: 19458 - protein, 6 aa, synthetic construct
  REGION 1..6: note = Synthetic Construct
TKIRLK

SEQ ID NO: 19459 - protein, 6 aa, synthetic construct
  REGION 1..6: note = Synthetic Construct
TKIRNK

SEQ ID NO: 19460 - protein, 6 aa, synthetic construct
  REGION 1..6: note = Synthetic Construct
TKIRQK

SEQ ID NO: 19461 - protein, 6 aa, synthetic construct
  REGION 1..6: note = Synthetic Construct
TKIRRK

SEQ ID NO: 19462 - protein, 6 aa, synthetic construct
  REGION 1..6: note = Synthetic Construct
TKIRSK

SEQ ID NO: 19463 - protein, 6 aa, synthetic construct
  REGION 1..6: note = Synthetic Construct
TKIRTK

SEQ ID NO: 19464 - protein, 6 aa, synthetic construct
  REGION 1..6: note = Synthetic Construct
TKIRYK

SEQ ID NO: 19465 - protein, 6 aa, synthetic construct
  REGION 1..6: note = Synthetic Construct
TKISAK

SEQ ID NO: 19466 - protein, 6 aa, synthetic construct
  REGION 1..6: note = Synthetic Construct
TKISDK

SEQ ID NO: 19467 - protein, 6 aa, synthetic construct
  REGION 1..6: note = Synthetic Construct
TKISEK

SEQ ID NO: 19468 - protein, 6 aa, synthetic construct
  REGION 1..6: note = Synthetic Construct
TKISFK

SEQ ID NO: 19469 - protein, 6 aa, synthetic construct
  REGION 1..6: note = Synthetic Construct
TKISGK

SEQ ID NO: 19470 - protein, 6 aa, synthetic construct
  REGION 1..6: note = Synthetic Construct
TKISHK

SEQ ID NO: 19471 - protein, 6 aa, synthetic construct
  REGION 1..6: note = Synthetic Construct
TKISIK

SEQ ID NO: 19472 - protein, 6 aa, synthetic construct
  REGION 1..6: note = Synthetic Construct
TKISLK

SEQ ID NO: 19473 - protein, 6 aa, synthetic construct
  REGION 1..6: note = Synthetic Construct
TKISNK

SEQ ID NO: 19474 - protein, 6 aa, synthetic construct
  REGION 1..6: note = Synthetic Construct
TKISQK

SEQ ID NO: 19475 - protein, 6 aa, synthetic construct
  REGION 1..6: note = Synthetic Construct
TKISRK

SEQ ID NO: 19476 - protein, 6 aa, synthetic construct
  REGION 1..6: note = Synthetic Construct
TKISSK

SEQ ID NO: 19477 - protein, 6 aa, synthetic construct
  REGION 1..6: note = Synthetic Construct
TKISTK

SEQ ID NO: 19478 - protein, 6 aa, synthetic construct
  REGION 1..6: note = Synthetic Construct
TKISYK

SEQ ID NO: 19479 - protein, 6 aa, synthetic construct
  REGION 1..6: note = Synthetic Construct
TKITAK

SEQ ID NO: 19480 - protein, 6 aa, synthetic construct
  REGION 1..6: note = Synthetic Construct
TKITDK

SEQ ID NO: 19481 - protein, 6 aa, synthetic construct
  REGION 1..6: note = Synthetic Construct
TKITEK

SEQ ID NO: 19482 - protein, 6 aa, synthetic construct
  REGION 1..6: note = Synthetic Construct
TKITFK

SEQ ID NO: 19483 - protein, 6 aa, synthetic construct
  REGION 1..6: note = Synthetic Construct
TKITGK

SEQ ID NO: 19484 - protein, 6 aa, synthetic construct
  REGION 1..6: note = Synthetic Construct
TKITHK

SEQ ID NO: 19485 - protein, 6 aa, synthetic construct
  REGION 1..6: note = Synthetic Construct
TKITIK

SEQ ID NO: 19486 - protein, 6 aa, synthetic construct
  REGION 1..6: note = Synthetic Construct
TKITLK

SEQ ID NO: 19487 - protein, 6 aa, synthetic construct
  REGION 1..6: note = Synthetic Construct
TKITNK

SEQ ID NO: 19488 - protein, 6 aa, synthetic construct
  REGION 1..6: note = Synthetic Construct
TKITQK

SEQ ID NO: 19489 - protein, 6 aa, synthetic construct
  REGION 1..6: note = Synthetic Construct
TKITRK

SEQ ID NO: 19490 - protein, 6 aa, synthetic construct
  REGION 1..6: note = Synthetic Construct
TKITSK

SEQ ID NO: 19491 - protein, 6 aa, synthetic construct
  REGION 1..6: note = Synthetic Construct
TKITTK

SEQ ID NO: 19492 - protein, 6 aa, synthetic construct
  REGION 1..6: note = Synthetic Construct
TKITYK

SEQ ID NO: 19493 - protein, 6 aa, synthetic construct
  REGION 1..6: note = Synthetic Construct
TKIYAK

SEQ ID NO: 19494 - protein, 6 aa, synthetic construct
  REGION 1..6: note = Synthetic Construct
TKIYDK

SEQ ID NO: 19495 - protein, 6 aa, synthetic construct
  REGION 1..6: note = Synthetic Construct
TKIYEK

SEQ ID NO: 19496 - protein, 6 aa, synthetic construct
  REGION 1..6: note = Synthetic Construct
TKIYFK

SEQ ID NO: 19497 - protein, 6 aa, synthetic construct
  REGION 1..6: note = Synthetic Construct
TKIYGK

SEQ ID NO: 19498 - protein, 6 aa, synthetic construct
  REGION 1..6: note = Synthetic Construct
TKIYHK

SEQ ID NO: 19499 - protein, 6 aa, synthetic construct
  REGION 1..6: note = Synthetic Construct
TKIYIK

SEQ ID NO: 19500 - protein, 6 aa, synthetic construct
  REGION 1..6: note = Synthetic Construct
TKIYLK

SEQ ID NO: 19501 - protein, 6 aa, synthetic construct
  REGION 1..6: note = Synthetic Construct
TKIYNK

SEQ ID NO: 19502 - protein, 6 aa, synthetic construct
  REGION 1..6: note = Synthetic Construct
TKIYQK

SEQ ID NO: 19503 - protein, 6 aa, synthetic construct
  REGION 1..6: note = Synthetic Construct
TKIYRK

SEQ ID NO: 19504 - protein, 6 aa, synthetic construct
  REGION 1..6: note = Synthetic Construct
TKIYSK

SEQ ID NO: 19505 - protein, 6 aa, synthetic construct
  REGION 1..6: note = Synthetic Construct
TKIYTK

SEQ ID NO: 19506 - protein, 6 aa, synthetic construct
  REGION 1..6: note = Synthetic Construct
TKIYYK

SEQ ID NO: 19507 - protein, 6 aa, synthetic construct
  REGION 1..6: note = Synthetic Construct
TKLAAK

SEQ ID NO: 19508 - protein, 6 aa, synthetic construct
  REGION 1..6: note = Synthetic Construct
TKLADK

SEQ ID NO: 19509 - protein, 6 aa, synthetic construct
  REGION 1..6: note = Synthetic Construct
TKLAEK

SEQ ID NO: 19510 - protein, 6 aa, synthetic construct
  REGION 1..6: note = Synthetic Construct
TKLAFK

SEQ ID NO: 19511 - protein, 6 aa, synthetic construct
  REGION 1..6: note = Synthetic Construct
TKLAGK

SEQ ID NO: 19512 - protein, 6 aa, synthetic construct
  REGION 1..6: note = Synthetic Construct
TKLAHK

SEQ ID NO: 19513 - protein, 6 aa, synthetic construct
  REGION 1..6: note = Synthetic Construct
TKLAIK

SEQ ID NO: 19514 - protein, 6 aa, synthetic construct
  REGION 1..6: note = Synthetic Construct
TKLALK

SEQ ID NO: 19515 - protein, 6 aa, synthetic construct
  REGION 1..6: note = Synthetic Construct
TKLANK

SEQ ID NO: 19516 - protein, 6 aa, synthetic construct
  REGION 1..6: note = Synthetic Construct
TKLAQK

SEQ ID NO: 19517 - protein, 6 aa, synthetic construct
  REGION 1..6: note = Synthetic Construct
TKLARK

SEQ ID NO: 19518 - protein, 6 aa, synthetic construct
  REGION 1..6: note = Synthetic Construct
TKLASK

SEQ ID NO: 19519 - protein, 6 aa, synthetic construct
  REGION 1..6: note = Synthetic Construct
TKLATK

SEQ ID NO: 19520 - protein, 6 aa, synthetic construct
  REGION 1..6: note = Synthetic Construct
TKLAYK

SEQ ID NO: 19521 - protein, 6 aa, synthetic construct
  REGION 1..6: note = Synthetic Construct
TKLDAK

SEQ ID NO: 19522 - protein, 6 aa, synthetic construct
  REGION 1..6: note = Synthetic Construct
TKLDDK

SEQ ID NO: 19523 - protein, 6 aa, synthetic construct
  REGION 1..6: note = Synthetic Construct
TKLDEK

SEQ ID NO: 19524 - protein, 6 aa, synthetic construct
  REGION 1..6: note = Synthetic Construct
TKLDFK

SEQ ID NO: 19525 - protein, 6 aa, synthetic construct
  REGION 1..6: note = Synthetic Construct
TKLDGK

SEQ ID NO: 19526 - protein, 6 aa, synthetic construct
  REGION 1..6: note = Synthetic Construct
TKLDHK

SEQ ID NO: 19527 - protein, 6 aa, synthetic construct
  REGION 1..6: note = Synthetic Construct
TKLDIK

SEQ ID NO: 19528 - protein, 6 aa, synthetic construct
  REGION 1..6: note = Synthetic Construct
TKLDLK

SEQ ID NO: 19529 - protein, 6 aa, synthetic construct
  REGION 1..6: note = Synthetic Construct
TKLDNK

SEQ ID NO: 19530 - protein, 6 aa, synthetic construct
  REGION 1..6: note = Synthetic Construct
TKLDQK

SEQ ID NO: 19531 - protein, 6 aa, synthetic construct
  REGION 1..6: note = Synthetic Construct
TKLDRK

SEQ ID NO: 19532 - protein, 6 aa, synthetic construct
  REGION 1..6: note = Synthetic Construct
TKLDSK

SEQ ID NO: 19533 - protein, 6 aa, synthetic construct
  REGION 1..6: note = Synthetic Construct
TKLDTK

SEQ ID NO: 19534 - protein, 6 aa, synthetic construct
  REGION 1..6: note = Synthetic Construct
TKLDYK

SEQ ID NO: 19535 - protein, 6 aa, synthetic construct
  REGION 1..6: note = Synthetic Construct
TKLEAK

SEQ ID NO: 19536 - protein, 6 aa, synthetic construct
  REGION 1..6: note = Synthetic Construct
TKLEDK

SEQ ID NO: 19537 - protein, 6 aa, synthetic construct
  REGION 1..6: note = Synthetic Construct
TKLEEK

SEQ ID NO: 19538 - protein, 6 aa, synthetic construct
  REGION 1..6: note = Synthetic Construct
TKLEFK

SEQ ID NO: 19539 - protein, 6 aa, synthetic construct
  REGION 1..6: note = Synthetic Construct
TKLEGK

SEQ ID NO: 19540 - protein, 6 aa, synthetic construct
  REGION 1..6: note = Synthetic Construct
TKLEHK

SEQ ID NO: 19541 - protein, 6 aa, synthetic construct
  REGION 1..6: note = Synthetic Construct
TKLEIK

SEQ ID NO: 19542 - protein, 6 aa, synthetic construct
  REGION 1..6: note = Synthetic Construct
TKLELK

SEQ ID NO: 19543 - protein, 6 aa, synthetic construct
  REGION 1..6: note = Synthetic Construct
TKLENK

SEQ ID NO: 19544 - protein, 6 aa, synthetic construct
  REGION 1..6: note = Synthetic Construct
TKLEQK

SEQ ID NO: 19545 - protein, 6 aa, synthetic construct
  REGION 1..6: note = Synthetic Construct
TKLERK

SEQ ID NO: 19546 - protein, 6 aa, synthetic construct
  REGION 1..6: note = Synthetic Construct
TKLESK

SEQ ID NO: 19547 - protein, 6 aa, synthetic construct
  REGION 1..6: note = Synthetic Construct
TKLETK

SEQ ID NO: 19548 - protein, 6 aa, synthetic construct
  REGION 1..6: note = Synthetic Construct
TKLEYK

SEQ ID NO: 19549 - protein, 6 aa, synthetic construct
  REGION 1..6: note = Synthetic Construct
TKLFAK

SEQ ID NO: 19550 - protein, 6 aa, synthetic construct
  REGION 1..6: note = Synthetic Construct
TKLFDK

SEQ ID NO: 19551 - protein, 6 aa, synthetic construct
  REGION 1..6: note = Synthetic Construct
TKLFEK

SEQ ID NO: 19552 - protein, 6 aa, synthetic construct
  REGION 1..6: note = Synthetic Construct
TKLFFK

SEQ ID NO: 19553 - protein, 6 aa, synthetic construct
  REGION 1..6: note = Synthetic Construct
TKLFGK

SEQ ID NO: 19554 - protein, 6 aa, synthetic construct
  REGION 1..6: note = Synthetic Construct
TKLFHK

SEQ ID NO: 19555 - protein, 6 aa, synthetic construct
  REGION 1..6: note = Synthetic Construct
TKLFIK

SEQ ID NO: 19556 - protein, 6 aa, synthetic construct
  REGION 1..6: note = Synthetic Construct
TKLFLK

SEQ ID NO: 19557 - protein, 6 aa, synthetic construct
  REGION 1..6: note = Synthetic Construct
TKLFNK

SEQ ID NO: 19558 - protein, 6 aa, synthetic construct
  REGION 1..6: note = Synthetic Construct
TKLFQK

SEQ ID NO: 19559 - protein, 6 aa, synthetic construct
  REGION 1..6: note = Synthetic Construct
TKLFRK

SEQ ID NO: 19560 - protein, 6 aa, synthetic construct
  REGION 1..6: note = Synthetic Construct
TKLFSK

SEQ ID NO: 19561 - protein, 6 aa, synthetic construct
  REGION 1..6: note = Synthetic Construct
TKLFTK

SEQ ID NO: 19562 - protein, 6 aa, synthetic construct
  REGION 1..6: note = Synthetic Construct
TKLFYK

SEQ ID NO: 19563 - protein, 6 aa, synthetic construct
  REGION 1..6: note = Synthetic Construct
TKLGAK

SEQ ID NO: 19564 - protein, 6 aa, synthetic construct
  REGION 1..6: note = Synthetic Construct
TKLGDK

SEQ ID NO: 19565 - protein, 6 aa, synthetic construct
  REGION 1..6: note = Synthetic Construct
TKLGEK

SEQ ID NO: 19566 - protein, 6 aa, synthetic construct
  REGION 1..6: note = Synthetic Construct
TKLGFK

SEQ ID NO: 19567 - protein, 6 aa, synthetic construct
  REGION 1..6: note = Synthetic Construct
TKLGGK

SEQ ID NO: 19568 - protein, 6 aa, synthetic construct
  REGION 1..6: note = Synthetic Construct
TKLGHK

SEQ ID NO: 19569 - protein, 6 aa, synthetic construct
  REGION 1..6: note = Synthetic Construct
TKLGIK

SEQ ID NO: 19570 - protein, 6 aa, synthetic construct
  REGION 1..6: note = Synthetic Construct
TKLGLK

SEQ ID NO: 19571 - protein, 6 aa, synthetic construct
  REGION 1..6: note = Synthetic Construct
TKLGNK

SEQ ID NO: 19572 - protein, 6 aa, synthetic construct
  REGION 1..6: note = Synthetic Construct
TKLGQK

SEQ ID NO: 19573 - protein, 6 aa, synthetic construct
  REGION 1..6: note = Synthetic Construct
TKLGRK

SEQ ID NO: 19574 - protein, 6 aa, synthetic construct
  REGION 1..6: note = Synthetic Construct
TKLGSK

SEQ ID NO: 19575 - protein, 6 aa, synthetic construct
  REGION 1..6: note = Synthetic Construct
TKLGTK

SEQ ID NO: 19576 - protein, 6 aa, synthetic construct
  REGION 1..6: note = Synthetic Construct
TKLGYK

SEQ ID NO: 19577 - protein, 6 aa, synthetic construct
  REGION 1..6: note = Synthetic Construct
TKLHAK

SEQ ID NO: 19578 - protein, 6 aa, synthetic construct
  REGION 1..6: note = Synthetic Construct
TKLHDK

SEQ ID NO: 19579 - protein, 6 aa, synthetic construct
  REGION 1..6: note = Synthetic Construct
TKLHEK

SEQ ID NO: 19580 - protein, 6 aa, synthetic construct
  REGION 1..6: note = Synthetic Construct
TKLHFK

SEQ ID NO: 19581 - protein, 6 aa, synthetic construct
  REGION 1..6: note = Synthetic Construct
TKLHGK

SEQ ID NO: 19582 - protein, 6 aa, synthetic construct
  REGION 1..6: note = Synthetic Construct
TKLHHK

SEQ ID NO: 19583 - protein, 6 aa, synthetic construct
  REGION 1..6: note = Synthetic Construct
TKLHIK

SEQ ID NO: 19584 - protein, 6 aa, synthetic construct
  REGION 1..6: note = Synthetic Construct
TKLHLK

SEQ ID NO: 19585 - protein, 6 aa, synthetic construct
  REGION 1..6: note = Synthetic Construct
TKLHNK

SEQ ID NO: 19586 - protein, 6 aa, synthetic construct
  REGION 1..6: note = Synthetic Construct
TKLHQK

SEQ ID NO: 19587 - protein, 6 aa, synthetic construct
  REGION 1..6: note = Synthetic Construct
TKLHRK

SEQ ID NO: 19588 - protein, 6 aa, synthetic construct
  REGION 1..6: note = Synthetic Construct
TKLHSK

SEQ ID NO: 19589 - protein, 6 aa, synthetic construct
  REGION 1..6: note = Synthetic Construct
TKLHTK

SEQ ID NO: 19590 - protein, 6 aa, synthetic construct
  REGION 1..6: note = Synthetic Construct
TKLHYK

SEQ ID NO: 19591 - protein, 6 aa, synthetic construct
  REGION 1..6: note = Synthetic Construct
TKLIAK

SEQ ID NO: 19592 - protein, 6 aa, synthetic construct
  REGION 1..6: note = Synthetic Construct
TKLIDK

SEQ ID NO: 19593 - protein, 6 aa, synthetic construct
  REGION 1..6: note = Synthetic Construct
TKLIEK

SEQ ID NO: 19594 - protein, 6 aa, synthetic construct
  REGION 1..6: note = Synthetic Construct
TKLIFK

SEQ ID NO: 19595 - protein, 6 aa, synthetic construct
  REGION 1..6: note = Synthetic Construct
TKLIGK

SEQ ID NO: 19596 - protein, 6 aa, synthetic construct
  REGION 1..6: note = Synthetic Construct
TKLIHK

SEQ ID NO: 19597 - protein, 6 aa, synthetic construct
  REGION 1..6: note = Synthetic Construct
TKLIIK

SEQ ID NO: 19598 - protein, 6 aa, synthetic construct
  REGION 1..6: note = Synthetic Construct
TKLILK

SEQ ID NO: 19599 - protein, 6 aa, synthetic construct
  REGION 1..6: note = Synthetic Construct
TKLINK

SEQ ID NO: 19600 - protein, 6 aa, synthetic construct
  REGION 1..6: note = Synthetic Construct
TKLIQK

SEQ ID NO: 19601 - protein, 6 aa, synthetic construct
  REGION 1..6: note = Synthetic Construct
TKLIRK

SEQ ID NO: 19602 - protein, 6 aa, synthetic construct
  REGION 1..6: note = Synthetic Construct
TKLISK

SEQ ID NO: 19603 - protein, 6 aa, synthetic construct
  REGION 1..6: note = Synthetic Construct
TKLITK

SEQ ID NO: 19604 - protein, 6 aa, synthetic construct
  REGION 1..6: note = Synthetic Construct
TKLIYK

SEQ ID NO: 19605 - protein, 6 aa, synthetic construct
  REGION 1..6: note = Synthetic Construct
TKLLAK

SEQ ID NO: 19606 - protein, 6 aa, synthetic construct
  REGION 1..6: note = Synthetic Construct
TKLLDK

SEQ ID NO: 19607 - protein, 6 aa, synthetic construct
  REGION 1..6: note = Synthetic Construct
TKLLEK

SEQ ID NO: 19608 - protein, 6 aa, synthetic construct
  REGION 1..6: note = Synthetic Construct
TKLLFK

SEQ ID NO: 19609 - protein, 6 aa, synthetic construct
  REGION 1..6: note = Synthetic Construct
TKLLGK

SEQ ID NO: 19610 - protein, 6 aa, synthetic construct
  REGION 1..6: note = Synthetic Construct
TKLLHK

SEQ ID NO: 19611 - protein, 6 aa, synthetic construct
  REGION 1..6: note = Synthetic Construct
TKLLIK

SEQ ID NO: 19612 - protein, 6 aa, synthetic construct
  REGION 1..6: note = Synthetic Construct
TKLLLK

SEQ ID NO: 19613 - protein, 6 aa, synthetic construct
  REGION 1..6: note = Synthetic Construct
TKLLNK

SEQ ID NO: 19614 - protein, 6 aa, synthetic construct
  REGION 1..6: note = Synthetic Construct
TKLLQK

SEQ ID NO: 19615 - protein, 6 aa, synthetic construct
  REGION 1..6: note = Synthetic Construct
TKLLRK

SEQ ID NO: 19616 - protein, 6 aa, synthetic construct
  REGION 1..6: note = Synthetic Construct
TKLLSK

SEQ ID NO: 19617 - protein, 6 aa, synthetic construct
  REGION 1..6: note = Synthetic Construct
TKLLTK

SEQ ID NO: 19618 - protein, 6 aa, synthetic construct
  REGION 1..6: note = Synthetic Construct
TKLLYK

SEQ ID NO: 19619 - protein, 6 aa, synthetic construct
  REGION 1..6: note = Synthetic Construct
TKLNAK

SEQ ID NO: 19620 - protein, 6 aa, synthetic construct
  REGION 1..6: note = Synthetic Construct
TKLNDK

SEQ ID NO: 19621 - protein, 6 aa, synthetic construct
  REGION 1..6: note = Synthetic Construct
TKLNEK

SEQ ID NO: 19622 - protein, 6 aa, synthetic construct
  REGION 1..6: note = Synthetic Construct
TKLNFK

SEQ ID NO: 19623 - protein, 6 aa, synthetic construct
  REGION 1..6: note = Synthetic Construct
TKLNGK

SEQ ID NO: 19624 - protein, 6 aa, synthetic construct
  REGION 1..6: note = Synthetic Construct
TKLNHK

SEQ ID NO: 19625 - protein, 6 aa, synthetic construct
  REGION 1..6: note = Synthetic Construct
TKLNIK

SEQ ID NO: 19626 - protein, 6 aa, synthetic construct
  REGION 1..6: note = Synthetic Construct
TKLNLK

SEQ ID NO: 19627 - protein, 6 aa, synthetic construct
  REGION 1..6: note = Synthetic Construct
TKLNNK

SEQ ID NO: 19628 - protein, 6 aa, synthetic construct
  REGION 1..6: note = Synthetic Construct
TKLNQK

SEQ ID NO: 19629 - protein, 6 aa, synthetic construct
  REGION 1..6: note = Synthetic Construct
TKLNRK

SEQ ID NO: 19630 - protein, 6 aa, synthetic construct
  REGION 1..6: note = Synthetic Construct
TKLNSK

SEQ ID NO: 19631 - protein, 6 aa, synthetic construct
  REGION 1..6: note = Synthetic Construct
TKLNTK

SEQ ID NO: 19632 - protein, 6 aa, synthetic construct
  REGION 1..6: note = Synthetic Construct
TKLNYK

SEQ ID NO: 19633 - protein, 6 aa, synthetic construct
  REGION 1..6: note = Synthetic Construct
TKLQAK

SEQ ID NO: 19634 - protein, 6 aa, synthetic construct
  REGION 1..6: note = Synthetic Construct
TKLQDK

SEQ ID NO: 19635 - protein, 6 aa, synthetic construct
  REGION 1..6: note = Synthetic Construct
TKLQEK

SEQ ID NO: 19636 - protein, 6 aa, synthetic construct
  REGION 1..6: note = Synthetic Construct
TKLQFK

SEQ ID NO: 19637 - protein, 6 aa, synthetic construct
  REGION 1..6: note = Synthetic Construct
TKLQGK

SEQ ID NO: 19638 - protein, 6 aa, synthetic construct
  REGION 1..6: note = Synthetic Construct
TKLQHK

SEQ ID NO: 19639 - protein, 6 aa, synthetic construct
  REGION 1..6: note = Synthetic Construct
TKLQIK

SEQ ID NO: 19640 - protein, 6 aa, synthetic construct
  REGION 1..6: note = Synthetic Construct
TKLQLK

SEQ ID NO: 19641 - protein, 6 aa, synthetic construct
  REGION 1..6: note = Synthetic Construct
TKLQNK

SEQ ID NO: 19642 - protein, 6 aa, synthetic construct
  REGION 1..6: note = Synthetic Construct
TKLQQK

SEQ ID NO: 19643 - protein, 6 aa, synthetic construct
  REGION 1..6: note = Synthetic Construct
TKLQRK

SEQ ID NO: 19644 - protein, 6 aa, synthetic construct
  REGION 1..6: note = Synthetic Construct
TKLQSK

SEQ ID NO: 19645 - protein, 6 aa, synthetic construct
  REGION 1..6: note = Synthetic Construct
TKLQTK

SEQ ID NO: 19646 - protein, 6 aa, synthetic construct
  REGION 1..6: note = Synthetic Construct
TKLQYK

SEQ ID NO: 19647 - protein, 6 aa, synthetic construct
  REGION 1..6: note = Synthetic Construct
TKLRAK

SEQ ID NO: 19648 - protein, 6 aa, synthetic construct
  REGION 1..6: note = Synthetic Construct
TKLRDK

SEQ ID NO: 19649 - protein, 6 aa, synthetic construct
  REGION 1..6: note = Synthetic Construct
TKLREK

SEQ ID NO: 19650 - protein, 6 aa, synthetic construct
  REGION 1..6: note = Synthetic Construct
TKLRFK

SEQ ID NO: 19651 - protein, 6 aa, synthetic construct
  REGION 1..6: note = Synthetic Construct
TKLRGK

SEQ ID NO: 19652 - protein, 6 aa, synthetic construct
  REGION 1..6: note = Synthetic Construct
TKLRHK

SEQ ID NO: 19653 - protein, 6 aa, synthetic construct
  REGION 1..6: note = Synthetic Construct
TKLRIK

SEQ ID NO: 19654 - protein, 6 aa, synthetic construct
  REGION 1..6: note = Synthetic Construct
TKLRLK

SEQ ID NO: 19655 - protein, 6 aa, synthetic construct
  REGION 1..6: note = Synthetic Construct
TKLRNK

SEQ ID NO: 19656 - protein, 6 aa, synthetic construct
  REGION 1..6: note = Synthetic Construct
TKLRQK

SEQ ID NO: 19657 - protein, 6 aa, synthetic construct
  REGION 1..6: note = Synthetic Construct
TKLRRK

SEQ ID NO: 19658 - protein, 6 aa, synthetic construct
  REGION 1..6: note = Synthetic Construct
TKLRSK

SEQ ID NO: 19659 - protein, 6 aa, synthetic construct
  REGION 1..6: note = Synthetic Construct
TKLRTK

SEQ ID NO: 19660 - protein, 6 aa, synthetic construct
  REGION 1..6: note = Synthetic Construct
TKLRYK

SEQ ID NO: 19661 - protein, 6 aa, synthetic construct
  REGION 1..6: note = Synthetic Construct
TKLSAK

SEQ ID NO: 19662 - protein, 6 aa, synthetic construct
  REGION 1..6: note = Synthetic Construct
TKLSDK

SEQ ID NO: 19663 - protein, 6 aa, synthetic construct
  REGION 1..6: note = Synthetic Construct
TKLSEK

SEQ ID NO: 19664 - protein, 6 aa, synthetic construct
  REGION 1..6: note = Synthetic Construct
TKLSFK

SEQ ID NO: 19665 - protein, 6 aa, synthetic construct
  REGION 1..6: note = Synthetic Construct
TKLSGK

SEQ ID NO: 19666 - protein, 6 aa, synthetic construct
  REGION 1..6: note = Synthetic Construct
TKLSHK

SEQ ID NO: 19667 - protein, 6 aa, synthetic construct
  REGION 1..6: note = Synthetic Construct
TKLSIK

SEQ ID NO: 19668 - protein, 6 aa, synthetic construct
  REGION 1..6: note = Synthetic Construct
TKLSLK

SEQ ID NO: 19669 - protein, 6 aa, synthetic construct
  REGION 1..6: note = Synthetic Construct
TKLSNK

SEQ ID NO: 19670 - protein, 6 aa, synthetic construct
  REGION 1..6: note = Synthetic Construct
TKLSQK

SEQ ID NO: 19671 - protein, 6 aa, synthetic construct
  REGION 1..6: note = Synthetic Construct
TKLSRK

SEQ ID NO: 19672 - protein, 6 aa, synthetic construct
  REGION 1..6: note = Synthetic Construct
TKLSSK

SEQ ID NO: 19673 - protein, 6 aa, synthetic construct
  REGION 1..6: note = Synthetic Construct
TKLSTK

SEQ ID NO: 19674 - protein, 6 aa, synthetic construct
  REGION 1..6: note = Synthetic Construct
TKLSYK

SEQ ID NO: 19675 - protein, 6 aa, synthetic construct
  REGION 1..6: note = Synthetic Construct
TKLTAK

SEQ ID NO: 19676 - protein, 6 aa, synthetic construct
  REGION 1..6: note = Synthetic Construct
TKLTDK

SEQ ID NO: 19677 - protein, 6 aa, synthetic construct
  REGION 1..6: note = Synthetic Construct
TKLTEK

SEQ ID NO: 19678 - protein, 6 aa, synthetic construct
  REGION 1..6: note = Synthetic Construct
TKLTFK

SEQ ID NO: 19679 - protein, 6 aa, synthetic construct
  REGION 1..6: note = Synthetic Construct
TKLTGK

SEQ ID NO: 19680 - protein, 6 aa, synthetic construct
  REGION 1..6: note = Synthetic Construct
TKLTHK

SEQ ID NO: 19681 - protein, 6 aa, synthetic construct
  REGION 1..6: note = Synthetic Construct
TKLTIK

SEQ ID NO: 19682 - protein, 6 aa, synthetic construct
  REGION 1..6: note = Synthetic Construct
TKLTLK

SEQ ID NO: 19683 - protein, 6 aa, synthetic construct
  REGION 1..6: note = Synthetic Construct
TKLTNK

SEQ ID NO: 19684 - protein, 6 aa, synthetic construct
  REGION 1..6: note = Synthetic Construct
TKLTQK

SEQ ID NO: 19685 - protein, 6 aa, synthetic construct
  REGION 1..6: note = Synthetic Construct
TKLTRK

SEQ ID NO: 19686 - protein, 6 aa, synthetic construct
  REGION 1..6: note = Synthetic Construct
TKLTSK

SEQ ID NO: 19687 - protein, 6 aa, synthetic construct
  REGION 1..6: note = Synthetic Construct
TKLTTK

SEQ ID NO: 19688 - protein, 6 aa, synthetic construct
  REGION 1..6: note = Synthetic Construct
TKLTYK

SEQ ID NO: 19689 - protein, 6 aa, synthetic construct
  REGION 1..6: note = Synthetic Construct
TKLYAK

SEQ ID NO: 19690 - protein, 6 aa, synthetic construct
  REGION 1..6: note = Synthetic Construct
TKLYDK

SEQ ID NO: 19691 - protein, 6 aa, synthetic construct
  REGION 1..6: note = Synthetic Construct
TKLYEK

SEQ ID NO: 19692 - protein, 6 aa, synthetic construct
  REGION 1..6: note = Synthetic Construct
TKLYFK

SEQ ID NO: 19693 - protein, 6 aa, synthetic construct
  REGION 1..6: note = Synthetic Construct
TKLYGK

SEQ ID NO: 19694 - protein, 6 aa, synthetic construct
  REGION 1..6: note = Synthetic Construct
TKLYHK

SEQ ID NO: 19695 - protein, 6 aa, synthetic construct
  REGION 1..6: note = Synthetic Construct
TKLYIK

SEQ ID NO: 19696 - protein, 6 aa, synthetic construct
  REGION 1..6: note = Synthetic Construct
TKLYLK

SEQ ID NO: 19697 - protein, 6 aa, synthetic construct
  REGION 1..6: note = Synthetic Construct
TKLYNK

SEQ ID NO: 19698 - protein, 6 aa, synthetic construct
  REGION 1..6: note = Synthetic Construct
TKLYQK

SEQ ID NO: 19699 - protein, 6 aa, synthetic construct
  REGION 1..6: note = Synthetic Construct
TKLYRK

SEQ ID NO: 19700 - protein, 6 aa, synthetic construct
  REGION 1..6: note = Synthetic Construct
TKLYSK

SEQ ID NO: 19701 - protein, 6 aa, synthetic construct
  REGION 1..6: note = Synthetic Construct
TKLYTK

SEQ ID NO: 19702 - protein, 6 aa, synthetic construct
  REGION 1..6: note = Synthetic Construct
TKLYYK

SEQ ID NO: 19703 - protein, 6 aa, synthetic construct
  REGION 1..6: note = Synthetic Construct
TKNAAK

SEQ ID NO: 19704 - protein, 6 aa, synthetic construct
  REGION 1..6: note = Synthetic Construct
TKNADK

SEQ ID NO: 19705 - protein, 6 aa, synthetic construct
  REGION 1..6: note = Synthetic Construct
TKNAEK

SEQ ID NO: 19706 - protein, 6 aa, synthetic construct
  REGION 1..6: note = Synthetic Construct
TKNAFK

SEQ ID NO: 19707 - protein, 6 aa, synthetic construct
  REGION 1..6: note = Synthetic Construct
TKNAGK

SEQ ID NO: 19708 - protein, 6 aa, synthetic construct
  REGION 1..6: note = Synthetic Construct
TKNAHK

SEQ ID NO: 19709 - protein, 6 aa, synthetic construct
  REGION 1..6: note = Synthetic Construct
TKNAIK

SEQ ID NO: 19710 - protein, 6 aa, synthetic construct
  REGION 1..6: note = Synthetic Construct
TKNALK

SEQ ID NO: 19711 - protein, 6 aa, synthetic construct
  REGION 1..6: note = Synthetic Construct
TKNANK

SEQ ID NO: 19712 - protein, 6 aa, synthetic construct
  REGION 1..6: note = Synthetic Construct
TKNAQK

SEQ ID NO: 19713 - protein, 6 aa, synthetic construct
  REGION 1..6: note = Synthetic Construct
TKNARK

SEQ ID NO: 19714 - protein, 6 aa, synthetic construct
  REGION 1..6: note = Synthetic Construct
TKNASK

SEQ ID NO: 19715 - protein, 6 aa, synthetic construct
  REGION 1..6: note = Synthetic Construct
TKNATK

SEQ ID NO: 19716 - protein, 6 aa, synthetic construct
  REGION 1..6: note = Synthetic Construct
TKNAYK

SEQ ID NO: 19717 - protein, 6 aa, synthetic construct
  REGION 1..6: note = Synthetic Construct
TKNDAK

SEQ ID NO: 19718 - protein, 6 aa, synthetic construct
  REGION 1..6: note = Synthetic Construct
TKNDDK

SEQ ID NO: 19719 - protein, 6 aa, synthetic construct
  REGION 1..6: note = Synthetic Construct
TKNDEK

SEQ ID NO: 19720 - protein, 6 aa, synthetic construct
  REGION 1..6: note = Synthetic Construct
TKNDFK

SEQ ID NO: 19721 - protein, 6 aa, synthetic construct
  REGION 1..6: note = Synthetic Construct
TKNDGK

SEQ ID NO: 19722 - protein, 6 aa, synthetic construct
  REGION 1..6: note = Synthetic Construct
TKNDHK

SEQ ID NO: 19723 - protein, 6 aa, synthetic construct
  REGION 1..6: note = Synthetic Construct
TKNDIK

SEQ ID NO: 19724 - protein, 6 aa, synthetic construct
  REGION 1..6: note = Synthetic Construct
TKNDLK

SEQ ID NO: 19725 - protein, 6 aa, synthetic construct
  REGION 1..6: note = Synthetic Construct
TKNDNK

SEQ ID NO: 19726 - protein, 6 aa, synthetic construct
  REGION 1..6: note = Synthetic Construct
TKNDQK

SEQ ID NO: 19727 - protein, 6 aa, synthetic construct
  REGION 1..6: note = Synthetic Construct
TKNDRK

SEQ ID NO: 19728 - protein, 6 aa, synthetic construct
  REGION 1..6: note = Synthetic Construct
TKNDSK

SEQ ID NO: 19729 - protein, 6 aa, synthetic construct
  REGION 1..6: note = Synthetic Construct
TKNDTK

SEQ ID NO: 19730 - protein, 6 aa, synthetic construct
  REGION 1..6: note = Synthetic Construct
TKNDYK

SEQ ID NO: 19731 - protein, 6 aa, synthetic construct
  REGION 1..6: note = Synthetic Construct
TKNEAK

SEQ ID NO: 19732 - protein, 6 aa, synthetic construct
  REGION 1..6: note = Synthetic Construct
TKNEDK

SEQ ID NO: 19733 - protein, 6 aa, synthetic construct
  REGION 1..6: note = Synthetic Construct
TKNEEK

SEQ ID NO: 19734 - protein, 6 aa, synthetic construct
  REGION 1..6: note = Synthetic Construct
TKNEFK

SEQ ID NO: 19735 - protein, 6 aa, synthetic construct
  REGION 1..6: note = Synthetic Construct
TKNEGK

SEQ ID NO: 19736 - protein, 6 aa, synthetic construct
  REGION 1..6: note = Synthetic Construct
TKNEHK

SEQ ID NO: 19737 - protein, 6 aa, synthetic construct
  REGION 1..6: note = Synthetic Construct
TKNEIK

SEQ ID NO: 19738 - protein, 6 aa, synthetic construct
  REGION 1..6: note = Synthetic Construct
TKNELK

SEQ ID NO: 19739 - protein, 6 aa, synthetic construct
  REGION 1..6: note = Synthetic Construct
TKNENK

SEQ ID NO: 19740 - protein, 6 aa, synthetic construct
  REGION 1..6: note = Synthetic Construct
TKNEQK

SEQ ID NO: 19741 - protein, 6 aa, synthetic construct
  REGION 1..6: note = Synthetic Construct
TKNERK

SEQ ID NO: 19742 - protein, 6 aa, synthetic construct
  REGION 1..6: note = Synthetic Construct
TKNESK

SEQ ID NO: 19743 - protein, 6 aa, synthetic construct
  REGION 1..6: note = Synthetic Construct
TKNETK

SEQ ID NO: 19744 - protein, 6 aa, synthetic construct
  REGION 1..6: note = Synthetic Construct
TKNEYK

SEQ ID NO: 19745 - protein, 6 aa, synthetic construct
  REGION 1..6: note = Synthetic Construct
TKNFAK

SEQ ID NO: 19746 - protein, 6 aa, synthetic construct
  REGION 1..6: note = Synthetic Construct
TKNFDK

SEQ ID NO: 19747 - protein, 6 aa, synthetic construct
  REGION 1..6: note = Synthetic Construct
TKNFEK

SEQ ID NO: 19748 - protein, 6 aa, synthetic construct
  REGION 1..6: note = Synthetic Construct
TKNFFK

SEQ ID NO: 19749 - protein, 6 aa, synthetic construct
  REGION 1..6: note = Synthetic Construct
TKNFGK

SEQ ID NO: 19750 - protein, 6 aa, synthetic construct
  REGION 1..6: note = Synthetic Construct
TKNFHK

SEQ ID NO: 19751 - protein, 6 aa, synthetic construct
  REGION 1..6: note = Synthetic Construct
TKNFIK

SEQ ID NO: 19752 - protein, 6 aa, synthetic construct
  REGION 1..6: note = Synthetic Construct
TKNFLK

SEQ ID NO: 19753 - protein, 6 aa, synthetic construct
  REGION 1..6: note = Synthetic Construct
TKNFNK

SEQ ID NO: 19754 - protein, 6 aa, synthetic construct
  REGION 1..6: note = Synthetic Construct
TKNFQK

SEQ ID NO: 19755 - protein, 6 aa, synthetic construct
  REGION 1..6: note = Synthetic Construct
TKNFRK

SEQ ID NO: 19756 - protein, 6 aa, synthetic construct
  REGION 1..6: note = Synthetic Construct
TKNFSK

SEQ ID NO: 19757 - protein, 6 aa, synthetic construct
  REGION 1..6: note = Synthetic Construct
TKNFTK

SEQ ID NO: 19758 - protein, 6 aa, synthetic construct
  REGION 1..6: note = Synthetic Construct
TKNFYK

SEQ ID NO: 19759 - protein, 6 aa, synthetic construct
  REGION 1..6: note = Synthetic Construct
TKNGAK

SEQ ID NO: 19760 - protein, 6 aa, synthetic construct
  REGION 1..6: note = Synthetic Construct
TKNGDK

SEQ ID NO: 19761 - protein, 6 aa, synthetic construct
  REGION 1..6: note = Synthetic Construct
TKNGEK

SEQ ID NO: 19762 - protein, 6 aa, synthetic construct
  REGION 1..6: note = Synthetic Construct
TKNGFK

SEQ ID NO: 19763 - protein, 6 aa, synthetic construct
  REGION 1..6: note = Synthetic Construct
TKNGGK

SEQ ID NO: 19764 - protein, 6 aa, synthetic construct
  REGION 1..6: note = Synthetic Construct
TKNGHK

SEQ ID NO: 19765 - protein, 6 aa, synthetic construct
  REGION 1..6: note = Synthetic Construct
TKNGIK

SEQ ID NO: 19766 - protein, 6 aa, synthetic construct
  REGION 1..6: note = Synthetic Construct
TKNGLK

SEQ ID NO: 19767 - protein, 6 aa, synthetic construct
  REGION 1..6: note = Synthetic Construct
TKNGNK

SEQ ID NO: 19768 - protein, 6 aa, synthetic construct
  REGION 1..6: note = Synthetic Construct
TKNGQK

SEQ ID NO: 19769 - protein, 6 aa, synthetic construct
  REGION 1..6: note = Synthetic Construct
TKNGRK

SEQ ID NO: 19770 - protein, 6 aa, synthetic construct
  REGION 1..6: note = Synthetic Construct
TKNGSK

SEQ ID NO: 19771 - protein, 6 aa, synthetic construct
  REGION 1..6: note = Synthetic Construct
TKNGTK

SEQ ID NO: 19772 - protein, 6 aa, synthetic construct
  REGION 1..6: note = Synthetic Construct
TKNGYK

SEQ ID NO: 19773 - protein, 6 aa, synthetic construct
  REGION 1..6: note = Synthetic Construct
TKNHAK

SEQ ID NO: 19774 - protein, 6 aa, synthetic construct
  REGION 1..6: note = Synthetic Construct
TKNHDK

SEQ ID NO: 19775 - protein, 6 aa, synthetic construct
  REGION 1..6: note = Synthetic Construct
TKNHEK

SEQ ID NO: 19776 - protein, 6 aa, synthetic construct
  REGION 1..6: note = Synthetic Construct
TKNHFK

SEQ ID NO: 19777 - protein, 6 aa, synthetic construct
  REGION 1..6: note = Synthetic Construct
TKNHGK

SEQ ID NO: 19778 - protein, 6 aa, synthetic construct
  REGION 1..6: note = Synthetic Construct
TKNHHK

SEQ ID NO: 19779 - protein, 6 aa, synthetic construct
  REGION 1..6: note = Synthetic Construct
TKNHIK

SEQ ID NO: 19780 - protein, 6 aa, synthetic construct
  REGION 1..6: note = Synthetic Construct
TKNHLK

SEQ ID NO: 19781 - protein, 6 aa, synthetic construct
  REGION 1..6: note = Synthetic Construct
TKNHNK

SEQ ID NO: 19782 - protein, 6 aa, synthetic construct
  REGION 1..6: note = Synthetic Construct
TKNHQK

SEQ ID NO: 19783 - protein, 6 aa, synthetic construct
  REGION 1..6: note = Synthetic Construct
TKNHRK

SEQ ID NO: 19784 - protein, 6 aa, synthetic construct
  REGION 1..6: note = Synthetic Construct
TKNHSK

SEQ ID NO: 19785 - protein, 6 aa, synthetic construct
  REGION 1..6: note = Synthetic Construct
TKNHTK

SEQ ID NO: 19786 - protein, 6 aa, synthetic construct
  REGION 1..6: note = Synthetic Construct
TKNHYK

SEQ ID NO: 19787 - protein, 6 aa, synthetic construct
  REGION 1..6: note = Synthetic Construct
TKNIAK

SEQ ID NO: 19788 - protein, 6 aa, synthetic construct
  REGION 1..6: note = Synthetic Construct
TKNIDK

SEQ ID NO: 19789 - protein, 6 aa, synthetic construct
  REGION 1..6: note = Synthetic Construct
TKNIEK

SEQ ID NO: 19790 - protein, 6 aa, synthetic construct
  REGION 1..6: note = Synthetic Construct
TKNIFK

SEQ ID NO: 19791 - protein, 6 aa, synthetic construct
  REGION 1..6: note = Synthetic Construct
TKNIGK

SEQ ID NO: 19792 - protein, 6 aa, synthetic construct
  REGION 1..6: note = Synthetic Construct
TKNIHK

SEQ ID NO: 19793 - protein, 6 aa, synthetic construct
  REGION 1..6: note = Synthetic Construct
TKNIIK

SEQ ID NO: 19794 - protein, 6 aa, synthetic construct
  REGION 1..6: note = Synthetic Construct
TKNILK

SEQ ID NO: 19795 - protein, 6 aa, synthetic construct
  REGION 1..6: note = Synthetic Construct
TKNINK

SEQ ID NO: 19796 - protein, 6 aa, synthetic construct
  REGION 1..6: note = Synthetic Construct
TKNIQK

SEQ ID NO: 19797 - protein, 6 aa, synthetic construct
  REGION 1..6: note = Synthetic Construct
TKNIRK

SEQ ID NO: 19798 - protein, 6 aa, synthetic construct
  REGION 1..6: note = Synthetic Construct
TKNISK

SEQ ID NO: 19799 - protein, 6 aa, synthetic construct
  REGION 1..6: note = Synthetic Construct
TKNITK

SEQ ID NO: 19800 - protein, 6 aa, synthetic construct
  REGION 1..6: note = Synthetic Construct
TKNIYK

SEQ ID NO: 19801 - protein, 6 aa, synthetic construct
  REGION 1..6: note = Synthetic Construct
TKNLAK

SEQ ID NO: 19802 - protein, 6 aa, synthetic construct
  REGION 1..6: note = Synthetic Construct
TKNLDK

SEQ ID NO: 19803 - protein, 6 aa, synthetic construct
  REGION 1..6: note = Synthetic Construct
TKNLEK

SEQ ID NO: 19804 - protein, 6 aa, synthetic construct
  REGION 1..6: note = Synthetic Construct
TKNLFK

SEQ ID NO: 19805 - protein, 6 aa, synthetic construct
  REGION 1..6: note = Synthetic Construct
TKNLGK

SEQ ID NO: 19806 - protein, 6 aa, synthetic construct
  REGION 1..6: note = Synthetic Construct
TKNLHK

SEQ ID NO: 19807 - protein, 6 aa, synthetic construct
  REGION 1..6: note = Synthetic Construct
TKNLIK

SEQ ID NO: 19808 - protein, 6 aa, synthetic construct
  REGION 1..6: note = Synthetic Construct
TKNLLK

SEQ ID NO: 19809 - protein, 6 aa, synthetic construct
  REGION 1..6: note = Synthetic Construct
TKNLNK

SEQ ID NO: 19810 - protein, 6 aa, synthetic construct
  REGION 1..6: note = Synthetic Construct
TKNLQK

SEQ ID NO: 19811 - protein, 6 aa, synthetic construct
  REGION 1..6: note = Synthetic Construct
TKNLRK

SEQ ID NO: 19812 - protein, 6 aa, synthetic construct
  REGION 1..6: note = Synthetic Construct
TKNLSK

SEQ ID NO: 19813 - protein, 6 aa, synthetic construct
  REGION 1..6: note = Synthetic Construct
TKNLTK

SEQ ID NO: 19814 - protein, 6 aa, synthetic construct
  REGION 1..6: note = Synthetic Construct
TKNLYK

SEQ ID NO: 19815 - protein, 6 aa, synthetic construct
  REGION 1..6: note = Synthetic Construct
TKNNAK

SEQ ID NO: 19816 - protein, 6 aa, synthetic construct
  REGION 1..6: note = Synthetic Construct
TKNNDK

SEQ ID NO: 19817 - protein, 6 aa, synthetic construct
  REGION 1..6: note = Synthetic Construct
TKNNEK

SEQ ID NO: 19818 - protein, 6 aa, synthetic construct
  REGION 1..6: note = Synthetic Construct
TKNNFK

SEQ ID NO: 19819 - protein, 6 aa, synthetic construct
  REGION 1..6: note = Synthetic Construct
TKNNGK

SEQ ID NO: 19820 - protein, 6 aa, synthetic construct
  REGION 1..6: note = Synthetic Construct
TKNNHK

SEQ ID NO: 19821 - protein, 6 aa, synthetic construct
  REGION 1..6: note = Synthetic Construct
TKNNIK

SEQ ID NO: 19822 - protein, 6 aa, synthetic construct
  REGION 1..6: note = Synthetic Construct
TKNNLK

SEQ ID NO: 19823 - protein, 6 aa, synthetic construct
  REGION 1..6: note = Synthetic Construct
TKNNNK

SEQ ID NO: 19824 - protein, 6 aa, synthetic construct
  REGION 1..6: note = Synthetic Construct
TKNNQK

SEQ ID NO: 19825 - protein, 6 aa, synthetic construct
  REGION 1..6: note = Synthetic Construct
TKNNRK

SEQ ID NO: 19826 - protein, 6 aa, synthetic construct
  REGION 1..6: note = Synthetic Construct
TKNNSK

SEQ ID NO: 19827 - protein, 6 aa, synthetic construct
  REGION 1..6: note = Synthetic Construct
TKNNTK

SEQ ID NO: 19828 - protein, 6 aa, synthetic construct
  REGION 1..6: note = Synthetic Construct
TKNNYK

SEQ ID NO: 19829 - protein, 6 aa, synthetic construct
  REGION 1..6: note = Synthetic Construct
TKNQAK

SEQ ID NO: 19830 - protein, 6 aa, synthetic construct
  REGION 1..6: note = Synthetic Construct
TKNQDK

SEQ ID NO: 19831 - protein, 6 aa, synthetic construct
  REGION 1..6: note = Synthetic Construct
TKNQEK

SEQ ID NO: 19832 - protein, 6 aa, synthetic construct
  REGION 1..6: note = Synthetic Construct
TKNQFK

SEQ ID NO: 19833 - protein, 6 aa, synthetic construct
  REGION 1..6: note = Synthetic Construct
TKNQGK

SEQ ID NO: 19834 - protein, 6 aa, synthetic construct
  REGION 1..6: note = Synthetic Construct
TKNQHK

SEQ ID NO: 19835 - protein, 6 aa, synthetic construct
  REGION 1..6: note = Synthetic Construct
TKNQIK

SEQ ID NO: 19836 - protein, 6 aa, synthetic construct
  REGION 1..6: note = Synthetic Construct
TKNQLK

SEQ ID NO: 19837 - protein, 6 aa, synthetic construct
  REGION 1..6: note = Synthetic Construct
TKNQNK

SEQ ID NO: 19838 - protein, 6 aa, synthetic construct
  REGION 1..6: note = Synthetic Construct
TKNQQK

SEQ ID NO: 19839 - protein, 6 aa, synthetic construct
  REGION 1..6: note = Synthetic Construct
TKNQRK

SEQ ID NO: 19840 - protein, 6 aa, synthetic construct
  REGION 1..6: note = Synthetic Construct
TKNQSK

SEQ ID NO: 19841 - protein, 6 aa, synthetic construct
  REGION 1..6: note = Synthetic Construct
TKNQTK

SEQ ID NO: 19842 - protein, 6 aa, synthetic construct
  REGION 1..6: note = Synthetic Construct
TKNQYK

SEQ ID NO: 19843 - protein, 6 aa, synthetic construct
  REGION 1..6: note = Synthetic Construct
TKNRAK

SEQ ID NO: 19844 - protein, 6 aa, synthetic construct
  REGION 1..6: note = Synthetic Construct
TKNRDK

SEQ ID NO: 19845 - protein, 6 aa, synthetic construct
  REGION 1..6: note = Synthetic Construct
TKNREK

SEQ ID NO: 19846 - protein, 6 aa, synthetic construct
  REGION 1..6: note = Synthetic Construct
TKNRFK

SEQ ID NO: 19847 - protein, 6 aa, synthetic construct
  REGION 1..6: note = Synthetic Construct
TKNRGK

SEQ ID NO: 19848 - protein, 6 aa, synthetic construct
  REGION 1..6: note = Synthetic Construct
TKNRHK

SEQ ID NO: 19849 - protein, 6 aa, synthetic construct
  REGION 1..6: note = Synthetic Construct
TKNRIK

SEQ ID NO: 19850 - protein, 6 aa, synthetic construct
  REGION 1..6: note = Synthetic Construct
TKNRLK

SEQ ID NO: 19851 - protein, 6 aa, synthetic construct
  REGION 1..6: note = Synthetic Construct
TKNRNK

SEQ ID NO: 19852 - protein, 6 aa, synthetic construct
  REGION 1..6: note = Synthetic Construct
TKNRQK

SEQ ID NO: 19853 - protein, 6 aa, synthetic construct
  REGION 1..6: note = Synthetic Construct
TKNRRK

SEQ ID NO: 19854 - protein, 6 aa, synthetic construct
  REGION 1..6: note = Synthetic Construct
TKNRSK

SEQ ID NO: 19855 - protein, 6 aa, synthetic construct
  REGION 1..6: note = Synthetic Construct
TKNRTK

SEQ ID NO: 19856 - protein, 6 aa, synthetic construct
  REGION 1..6: note = Synthetic Construct
TKNRYK

SEQ ID NO: 19857 - protein, 6 aa, synthetic construct
  REGION 1..6: note = Synthetic Construct
TKNSAK

SEQ ID NO: 19858 - protein, 6 aa, synthetic construct
  REGION 1..6: note = Synthetic Construct
TKNSDK

SEQ ID NO: 19859 - protein, 6 aa, synthetic construct
  REGION 1..6: note = Synthetic Construct
TKNSEK

SEQ ID NO: 19860 - protein, 6 aa, synthetic construct
  REGION 1..6: note = Synthetic Construct
TKNSFK

SEQ ID NO: 19861 - protein, 6 aa, synthetic construct
  REGION 1..6: note = Synthetic Construct
TKNSGK

SEQ ID NO: 19862 - protein, 6 aa, synthetic construct
  REGION 1..6: note = Synthetic Construct
TKNSHK

SEQ ID NO: 19863 - protein, 6 aa, synthetic construct
  REGION 1..6: note = Synthetic Construct
TKNSIK

SEQ ID NO: 19864 - protein, 6 aa, synthetic construct
  REGION 1..6: note = Synthetic Construct
TKNSLK

SEQ ID NO: 19865 - protein, 6 aa, synthetic construct
  REGION 1..6: note = Synthetic Construct
TKNSNK

SEQ ID NO: 19866 - protein, 6 aa, synthetic construct
  REGION 1..6: note = Synthetic Construct
TKNSQK

SEQ ID NO: 19867 - protein, 6 aa, synthetic construct
  REGION 1..6: note = Synthetic Construct
TKNSRK

SEQ ID NO: 19868 - protein, 6 aa, synthetic construct
  REGION 1..6: note = Synthetic Construct
TKNSSK

SEQ ID NO: 19869 - protein, 6 aa, synthetic construct
  REGION 1..6: note = Synthetic Construct
TKNSTK

SEQ ID NO: 19870 - protein, 6 aa, synthetic construct
  REGION 1..6: note = Synthetic Construct
TKNSYK

SEQ ID NO: 19871 - protein, 6 aa, synthetic construct
  REGION 1..6: note = Synthetic Construct
TKNTAK

SEQ ID NO: 19872 - protein, 6 aa, synthetic construct
  REGION 1..6: note = Synthetic Construct
TKNTDK

SEQ ID NO: 19873 - protein, 6 aa, synthetic construct
  REGION 1..6: note = Synthetic Construct
TKNTEK

SEQ ID NO: 19874 - protein, 6 aa, synthetic construct
  REGION 1..6: note = Synthetic Construct
TKNTFK

SEQ ID NO: 19875 - protein, 6 aa, synthetic construct
  REGION 1..6: note = Synthetic Construct
TKNTGK

SEQ ID NO: 19876 - protein, 6 aa, synthetic construct
  REGION 1..6: note = Synthetic Construct
TKNTHK

SEQ ID NO: 19877 - protein, 6 aa, synthetic construct
  REGION 1..6: note = Synthetic Construct
TKNTIK

SEQ ID NO: 19878 - protein, 6 aa, synthetic construct
  REGION 1..6: note = Synthetic Construct
TKNTLK

SEQ ID NO: 19879 - protein, 6 aa, synthetic construct
  REGION 1..6: note = Synthetic Construct
TKNTNK

SEQ ID NO: 19880 - protein, 6 aa, synthetic construct
  REGION 1..6: note = Synthetic Construct
TKNTQK

SEQ ID NO: 19881 - protein, 6 aa, synthetic construct
  REGION 1..6: note = Synthetic Construct
TKNTRK

SEQ ID NO: 19882 - protein, 6 aa, synthetic construct
  REGION 1..6: note = Synthetic Construct
TKNTSK

SEQ ID NO: 19883 - protein, 6 aa, synthetic construct
  REGION 1..6: note = Synthetic Construct
TKNTTK

SEQ ID NO: 19884 - protein, 6 aa, synthetic construct
  REGION 1..6: note = Synthetic Construct
TKNTYK

SEQ ID NO: 19885 - protein, 6 aa, synthetic construct
  REGION 1..6: note = Synthetic Construct
TKNYAK

SEQ ID NO: 19886 - protein, 6 aa, synthetic construct
  REGION 1..6: note = Synthetic Construct
TKNYDK

SEQ ID NO: 19887 - protein, 6 aa, synthetic construct
  REGION 1..6: note = Synthetic Construct
TKNYEK

SEQ ID NO: 19888 - protein, 6 aa, synthetic construct
  REGION 1..6: note = Synthetic Construct
TKNYFK

SEQ ID NO: 19889 - protein, 6 aa, synthetic construct
  REGION 1..6: note = Synthetic Construct
TKNYGK

SEQ ID NO: 19890 - protein, 6 aa, synthetic construct
  REGION 1..6: note = Synthetic Construct
TKNYHK

SEQ ID NO: 19891 - protein, 6 aa, synthetic construct
  REGION 1..6: note = Synthetic Construct
TKNYIK

SEQ ID NO: 19892 - protein, 6 aa, synthetic construct
  REGION 1..6: note = Synthetic Construct
TKNYLK

SEQ ID NO: 19893 - protein, 6 aa, synthetic construct
  REGION 1..6: note = Synthetic Construct
TKNYNK

SEQ ID NO: 19894 - protein, 6 aa, synthetic construct
  REGION 1..6: note = Synthetic Construct
TKNYQK

SEQ ID NO: 19895 - protein, 6 aa, synthetic construct
  REGION 1..6: note = Synthetic Construct
TKNYRK

SEQ ID NO: 19896 - protein, 6 aa, synthetic construct
  REGION 1..6: note = Synthetic Construct
TKNYSK

SEQ ID NO: 19897 - protein, 6 aa, synthetic construct
  REGION 1..6: note = Synthetic Construct
TKNYTK

SEQ ID NO: 19898 - protein, 6 aa, synthetic construct
  REGION 1..6: note = Synthetic Construct
TKNYYK

SEQ ID NO: 19899 - protein, 6 aa, synthetic construct
  REGION 1..6: note = Synthetic Construct
TKPAAK

SEQ ID NO: 19900 - protein, 6 aa, synthetic construct
  REGION 1..6: note = Synthetic Construct
TKPADK

SEQ ID NO: 19901 - protein, 6 aa, synthetic construct
  REGION 1..6: note = Synthetic Construct
TKPAEK

SEQ ID NO: 19902 - protein, 6 aa, synthetic construct
  REGION 1..6: note = Synthetic Construct
TKPAFK

SEQ ID NO: 19903 - protein, 6 aa, synthetic construct
  REGION 1..6: note = Synthetic Construct
TKPAGK

SEQ ID NO: 19904 - protein, 6 aa, synthetic construct
  REGION 1..6: note = Synthetic Construct
TKPAHK

SEQ ID NO: 19905 - protein, 6 aa, synthetic construct
  REGION 1..6: note = Synthetic Construct
TKPAIK

SEQ ID NO: 19906 - protein, 6 aa, synthetic construct
  REGION 1..6: note = Synthetic Construct
TKPALK

SEQ ID NO: 19907 - protein, 6 aa, synthetic construct
  REGION 1..6: note = Synthetic Construct
TKPANK

SEQ ID NO: 19908 - protein, 6 aa, synthetic construct
  REGION 1..6: note = Synthetic Construct
TKPAQK

SEQ ID NO: 19909 - protein, 6 aa, synthetic construct
  REGION 1..6: note = Synthetic Construct
TKPARK

SEQ ID NO: 19910 - protein, 6 aa, synthetic construct
  REGION 1..6: note = Synthetic Construct
TKPASK

SEQ ID NO: 19911 - protein, 6 aa, synthetic construct
  REGION 1..6: note = Synthetic Construct
TKPATK

SEQ ID NO: 19912 - protein, 6 aa, synthetic construct
  REGION 1..6: note = Synthetic Construct
TKPAYK

SEQ ID NO: 19913 - protein, 6 aa, synthetic construct
  REGION 1..6: note = Synthetic Construct
TKPDAK

SEQ ID NO: 19914 - protein, 6 aa, synthetic construct
  REGION 1..6: note = Synthetic Construct
TKPDDK

SEQ ID NO: 19915 - protein, 6 aa, synthetic construct
  REGION 1..6: note = Synthetic Construct
TKPDEK

SEQ ID NO: 19916 - protein, 6 aa, synthetic construct
  REGION 1..6: note = Synthetic Construct
TKPDFK

SEQ ID NO: 19917 - protein, 6 aa, synthetic construct
  REGION 1..6: note = Synthetic Construct
TKPDGK

SEQ ID NO: 19918 - protein, 6 aa, synthetic construct
  REGION 1..6: note = Synthetic Construct
TKPDHK

SEQ ID NO: 19919 - protein, 6 aa, synthetic construct
  REGION 1..6: note = Synthetic Construct
TKPDIK

SEQ ID NO: 19920 - protein, 6 aa, synthetic construct
  REGION 1..6: note = Synthetic Construct
TKPDLK

SEQ ID NO: 19921 - protein, 6 aa, synthetic construct
  REGION 1..6: note = Synthetic Construct
TKPDNK

SEQ ID NO: 19922 - protein, 6 aa, synthetic construct
  REGION 1..6: note = Synthetic Construct
TKPDQK

SEQ ID NO: 19923 - protein, 6 aa, synthetic construct
  REGION 1..6: note = Synthetic Construct
TKPDRK

SEQ ID NO: 19924 - protein, 6 aa, synthetic construct
  REGION 1..6: note = Synthetic Construct
TKPDSK

SEQ ID NO: 19925 - protein, 6 aa, synthetic construct
  REGION 1..6: note = Synthetic Construct
TKPDTK

SEQ ID NO: 19926 - protein, 6 aa, synthetic construct
  REGION 1..6: note = Synthetic Construct
TKPDYK

SEQ ID NO: 19927 - protein, 6 aa, synthetic construct
  REGION 1..6: note = Synthetic Construct
TKPEAK

SEQ ID NO: 19928 - protein, 6 aa, synthetic construct
  REGION 1..6: note = Synthetic Construct
TKPEDK

SEQ ID NO: 19929 - protein, 6 aa, synthetic construct
  REGION 1..6: note = Synthetic Construct
TKPEEK

SEQ ID NO: 19930 - protein, 6 aa, synthetic construct
  REGION 1..6: note = Synthetic Construct
TKPEFK

SEQ ID NO: 19931 - protein, 6 aa, synthetic construct
  REGION 1..6: note = Synthetic Construct
TKPEGK

SEQ ID NO: 19932 - protein, 6 aa, synthetic construct
  REGION 1..6: note = Synthetic Construct
TKPEHK

SEQ ID NO: 19933 - protein, 6 aa, synthetic construct
  REGION 1..6: note = Synthetic Construct
TKPEIK

SEQ ID NO: 19934 - protein, 6 aa, synthetic construct
  REGION 1..6: note = Synthetic Construct
TKPELK

SEQ ID NO: 19935 - protein, 6 aa, synthetic construct
  REGION 1..6: note = Synthetic Construct
TKPENK

SEQ ID NO: 19936 - protein, 6 aa, synthetic construct
  REGION 1..6: note = Synthetic Construct
TKPEQK

SEQ ID NO: 19937 - protein, 6 aa, synthetic construct
  REGION 1..6: note = Synthetic Construct
TKPERK

SEQ ID NO: 19938 - protein, 6 aa, synthetic construct
  REGION 1..6: note = Synthetic Construct
TKPESK

SEQ ID NO: 19939 - protein, 6 aa, synthetic construct
  REGION 1..6: note = Synthetic Construct
TKPETK

SEQ ID NO: 19940 - protein, 6 aa, synthetic construct
  REGION 1..6: note = Synthetic Construct
TKPEYK

SEQ ID NO: 19941 - protein, 6 aa, synthetic construct
  REGION 1..6: note = Synthetic Construct
TKPFAK

SEQ ID NO: 19942 - protein, 6 aa, synthetic construct
  REGION 1..6: note = Synthetic Construct
TKPFDK

SEQ ID NO: 19943 - protein, 6 aa, synthetic construct
  REGION 1..6: note = Synthetic Construct
TKPFEK

SEQ ID NO: 19944 - protein, 6 aa, synthetic construct
  REGION 1..6: note = Synthetic Construct
TKPFFK

SEQ ID NO: 19945 - protein, 6 aa, synthetic construct
  REGION 1..6: note = Synthetic Construct
TKPFGK

SEQ ID NO: 19946 - protein, 6 aa, synthetic construct
  REGION 1..6: note = Synthetic Construct
TKPFHK

SEQ ID NO: 19947 - protein, 6 aa, synthetic construct
  REGION 1..6: note = Synthetic Construct
TKPFIK

SEQ ID NO: 19948 - protein, 6 aa, synthetic construct
  REGION 1..6: note = Synthetic Construct
TKPFLK

SEQ ID NO: 19949 - protein, 6 aa, synthetic construct
  REGION 1..6: note = Synthetic Construct
TKPFNK

SEQ ID NO: 19950 - protein, 6 aa, synthetic construct
  REGION 1..6: note = Synthetic Construct
TKPFQK

SEQ ID NO: 19951 - protein, 6 aa, synthetic construct
  REGION 1..6: note = Synthetic Construct
TKPFRK

SEQ ID NO: 19952 - protein, 6 aa, synthetic construct
  REGION 1..6: note = Synthetic Construct
TKPFSK

SEQ ID NO: 19953 - protein, 6 aa, synthetic construct
  REGION 1..6: note = Synthetic Construct
TKPFTK

SEQ ID NO: 19954 - protein, 6 aa, synthetic construct
  REGION 1..6: note = Synthetic Construct
TKPFYK

SEQ ID NO: 19955 - protein, 6 aa, synthetic construct
  REGION 1..6: note = Synthetic Construct
TKPGAK

SEQ ID NO: 19956 - protein, 6 aa, synthetic construct
  REGION 1..6: note = Synthetic Construct
TKPGDK

SEQ ID NO: 19957 - protein, 6 aa, synthetic construct
  REGION 1..6: note = Synthetic Construct
TKPGEK

SEQ ID NO: 19958 - protein, 6 aa, synthetic construct
  REGION 1..6: note = Synthetic Construct
TKPGFK

SEQ ID NO: 19959 - protein, 6 aa, synthetic construct
  REGION 1..6: note = Synthetic Construct
TKPGGK

SEQ ID NO: 19960 - protein, 6 aa, synthetic construct
  REGION 1..6: note = Synthetic Construct
TKPGHK

SEQ ID NO: 19961 - protein, 6 aa, synthetic construct
  REGION 1..6: note = Synthetic Construct
TKPGIK

SEQ ID NO: 19962 - protein, 6 aa, synthetic construct
  REGION 1..6: note = Synthetic Construct
TKPGLK

SEQ ID NO: 19963 - protein, 6 aa, synthetic construct
  REGION 1..6: note = Synthetic Construct
TKPGNK

SEQ ID NO: 19964 - protein, 6 aa, synthetic construct
  REGION 1..6: note = Synthetic Construct
TKPGQK

SEQ ID NO: 19965 - protein, 6 aa, synthetic construct
  REGION 1..6: note = Synthetic Construct
TKPGRK

SEQ ID NO: 19966 - protein, 6 aa, synthetic construct
  REGION 1..6: note = Synthetic Construct
TKPGSK

SEQ ID NO: 19967 - protein, 6 aa, synthetic construct
  REGION 1..6: note = Synthetic Construct
TKPGTK

SEQ ID NO: 19968 - protein, 6 aa, synthetic construct
  REGION 1..6: note = Synthetic Construct
TKPGYK

SEQ ID NO: 19969 - protein, 6 aa, synthetic construct
  REGION 1..6: note = Synthetic Construct
TKPHAK

SEQ ID NO: 19970 - protein, 6 aa, synthetic construct
  REGION 1..6: note = Synthetic Construct
TKPHDK

SEQ ID NO: 19971 - protein, 6 aa, synthetic construct
  REGION 1..6: note = Synthetic Construct
TKPHEK

SEQ ID NO: 19972 - protein, 6 aa, synthetic construct
  REGION 1..6: note = Synthetic Construct
TKPHFK

SEQ ID NO: 19973 - protein, 6 aa, synthetic construct
  REGION 1..6: note = Synthetic Construct
TKPHGK

SEQ ID NO: 19974 - protein, 6 aa, synthetic construct
  REGION 1..6: note = Synthetic Construct
TKPHHK

SEQ ID NO: 19975 - protein, 6 aa, synthetic construct
  REGION 1..6: note = Synthetic Construct
TKPHIK

SEQ ID NO: 19976 - protein, 6 aa, synthetic construct
  REGION 1..6: note = Synthetic Construct
TKPHLK

SEQ ID NO: 19977 - protein, 6 aa, synthetic construct
  REGION 1..6: note = Synthetic Construct
TKPHNK

SEQ ID NO: 19978 - protein, 6 aa, synthetic construct
  REGION 1..6: note = Synthetic Construct
TKPHQK

SEQ ID NO: 19979 - protein, 6 aa, synthetic construct
  REGION 1..6: note = Synthetic Construct
TKPHRK

SEQ ID NO: 19980 - protein, 6 aa, synthetic construct
  REGION 1..6: note = Synthetic Construct
TKPHSK

SEQ ID NO: 19981 - protein, 6 aa, synthetic construct
  REGION 1..6: note = Synthetic Construct
TKPHTK

SEQ ID NO: 19982 - protein, 6 aa, synthetic construct
  REGION 1..6: note = Synthetic Construct
TKPHYK

SEQ ID NO: 19983 - protein, 6 aa, synthetic construct
  REGION 1..6: note = Synthetic Construct
TKPIAK

SEQ ID NO: 19984 - protein, 6 aa, synthetic construct
  REGION 1..6: note = Synthetic Construct
TKPIDK

SEQ ID NO: 19985 - protein, 6 aa, synthetic construct
  REGION 1..6: note = Synthetic Construct
TKPIEK

SEQ ID NO: 19986 - protein, 6 aa, synthetic construct
  REGION 1..6: note = Synthetic Construct
TKPIFK

SEQ ID NO: 19987 - protein, 6 aa, synthetic construct
  REGION 1..6: note = Synthetic Construct
TKPIGK

SEQ ID NO: 19988 - protein, 6 aa, synthetic construct
  REGION 1..6: note = Synthetic Construct
TKPIHK

SEQ ID NO: 19989 - protein, 6 aa, synthetic construct
  REGION 1..6: note = Synthetic Construct
TKPIIK

SEQ ID NO: 19990 - protein, 6 aa, synthetic construct
  REGION 1..6: note = Synthetic Construct
TKPILK

SEQ ID NO: 19991 - protein, 6 aa, synthetic construct
  REGION 1..6: note = Synthetic Construct
TKPINK

SEQ ID NO: 19992 - protein, 6 aa, synthetic construct
  REGION 1..6: note = Synthetic Construct
TKPIQK

SEQ ID NO: 19993 - protein, 6 aa, synthetic construct
  REGION 1..6: note = Synthetic Construct
TKPIRK

SEQ ID NO: 19994 - protein, 6 aa, synthetic construct
  REGION 1..6: note = Synthetic Construct
TKPISK

SEQ ID NO: 19995 - protein, 6 aa, synthetic construct
  REGION 1..6: note = Synthetic Construct
TKPITK

SEQ ID NO: 19996 - protein, 6 aa, synthetic construct
  REGION 1..6: note = Synthetic Construct
TKPIYK

SEQ ID NO: 19997 - protein, 6 aa, synthetic construct
  REGION 1..6: note = Synthetic Construct
TKPLAK

SEQ ID NO: 19998 - protein, 6 aa, synthetic construct
  REGION 1..6: note = Synthetic Construct
TKPLDK

SEQ ID NO: 19999 - protein, 6 aa, synthetic construct
  REGION 1..6: note = Synthetic Construct
TKPLEK

SEQ ID NO: 20000 - protein, 6 aa, synthetic construct
  REGION 1..6: note = Synthetic Construct
TKPLFK

SEQ ID NO: 20001 - protein, 6 aa, synthetic construct
  REGION 1..6: note = Synthetic Construct
TKPLGK

SEQ ID NO: 20002 - protein, 6 aa, synthetic construct
  REGION 1..6: note = Synthetic Construct
TKPLHK

SEQ ID NO: 20003 - protein, 6 aa, synthetic construct
  REGION 1..6: note = Synthetic Construct
TKPLIK

SEQ ID NO: 20004 - protein, 6 aa, synthetic construct
  REGION 1..6: note = Synthetic Construct
TKPLLK

SEQ ID NO: 20005 - protein, 6 aa, synthetic construct
  REGION 1..6: note = Synthetic Construct
TKPLNK

SEQ ID NO: 20006 - protein, 6 aa, synthetic construct
  REGION 1..6: note = Synthetic Construct
TKPLQK

SEQ ID NO: 20007 - protein, 6 aa, synthetic construct
  REGION 1..6: note = Synthetic Construct
TKPLRK

SEQ ID NO: 20008 - protein, 6 aa, synthetic construct
  REGION 1..6: note = Synthetic Construct
TKPLSK

SEQ ID NO: 20009 - protein, 6 aa, synthetic construct
  REGION 1..6: note = Synthetic Construct
TKPLTK

SEQ ID NO: 20010 - protein, 6 aa, synthetic construct
  REGION 1..6: note = Synthetic Construct
TKPLYK

SEQ ID NO: 20011 - protein, 6 aa, synthetic construct
  REGION 1..6: note = Synthetic Construct
TKPNAK

SEQ ID NO: 20012 - protein, 6 aa, synthetic construct
  REGION 1..6: note = Synthetic Construct
TKPNDK

SEQ ID NO: 20013 - protein, 6 aa, synthetic construct
  REGION 1..6: note = Synthetic Construct
TKPNEK

SEQ ID NO: 20014 - protein, 6 aa, synthetic construct
  REGION 1..6: note = Synthetic Construct
TKPNFK

SEQ ID NO: 20015 - protein, 6 aa, synthetic construct
  REGION 1..6: note = Synthetic Construct
TKPNGK

SEQ ID NO: 20016 - protein, 6 aa, synthetic construct
  REGION 1..6: note = Synthetic Construct
TKPNHK

SEQ ID NO: 20017 - protein, 6 aa, synthetic construct
  REGION 1..6: note = Synthetic Construct
TKPNIK

SEQ ID NO: 20018 - protein, 6 aa, synthetic construct
  REGION 1..6: note = Synthetic Construct
TKPNLK

SEQ ID NO: 20019 - protein, 6 aa, synthetic construct
  REGION 1..6: note = Synthetic Construct
TKPNNK

SEQ ID NO: 20020 - protein, 6 aa, synthetic construct
  REGION 1..6: note = Synthetic Construct
TKPNQK

SEQ ID NO: 20021 - protein, 6 aa, synthetic construct
  REGION 1..6: note = Synthetic Construct
TKPNRK

SEQ ID NO: 20022 - protein, 6 aa, synthetic construct
  REGION 1..6: note = Synthetic Construct
TKPNSK

SEQ ID NO: 20023 - protein, 6 aa, synthetic construct
  REGION 1..6: note = Synthetic Construct
TKPNTK

SEQ ID NO: 20024 - protein, 6 aa, synthetic construct
  REGION 1..6: note = Synthetic Construct
TKPNYK

SEQ ID NO: 20025 - protein, 6 aa, synthetic construct
  REGION 1..6: note = Synthetic Construct
TKPQAK

SEQ ID NO: 20026 - protein, 6 aa, synthetic construct
  REGION 1..6: note = Synthetic Construct
TKPQDK

SEQ ID NO: 20027 - protein, 6 aa, synthetic construct
  REGION 1..6: note = Synthetic Construct
TKPQEK

SEQ ID NO: 20028 - protein, 6 aa, synthetic construct
  REGION 1..6: note = Synthetic Construct
TKPQFK

SEQ ID NO: 20029 - protein, 6 aa, synthetic construct
  REGION 1..6: note = Synthetic Construct
TKPQGK

SEQ ID NO: 20030 - protein, 6 aa, synthetic construct
  REGION 1..6: note = Synthetic Construct
TKPQHK

SEQ ID NO: 20031 - protein, 6 aa, synthetic construct
  REGION 1..6: note = Synthetic Construct
TKPQIK

SEQ ID NO: 20032 - protein, 6 aa, synthetic construct
  REGION 1..6: note = Synthetic Construct
TKPQLK

SEQ ID NO: 20033 - protein, 6 aa, synthetic construct
  REGION 1..6: note = Synthetic Construct
TKPQNK

SEQ ID NO: 20034 - protein, 6 aa, synthetic construct
  REGION 1..6: note = Synthetic Construct
TKPQQK

SEQ ID NO: 20035 - protein, 6 aa, synthetic construct
  REGION 1..6: note = Synthetic Construct
TKPQRK

SEQ ID NO: 20036 - protein, 6 aa, synthetic construct
  REGION 1..6: note = Synthetic Construct
TKPQSK

SEQ ID NO: 20037 - protein, 6 aa, synthetic construct
  REGION 1..6: note = Synthetic Construct
TKPQTK

SEQ ID NO: 20038 - protein, 6 aa, synthetic construct
  REGION 1..6: note = Synthetic Construct
TKPQYK

SEQ ID NO: 20039 - protein, 6 aa, synthetic construct
  REGION 1..6: note = Synthetic Construct
TKPRAK

SEQ ID NO: 20040 - protein, 6 aa, synthetic construct
  REGION 1..6: note = Synthetic Construct
TKPRDK

SEQ ID NO: 20041 - protein, 6 aa, synthetic construct
  REGION 1..6: note = Synthetic Construct
TKPREK

SEQ ID NO: 20042 - protein, 6 aa, synthetic construct
  REGION 1..6: note = Synthetic Construct
TKPRFK

SEQ ID NO: 20043 - protein, 6 aa, synthetic construct
  REGION 1..6: note = Synthetic Construct
TKPRGK

SEQ ID NO: 20044 - protein, 6 aa, synthetic construct
  REGION 1..6: note = Synthetic Construct
TKPRHK

SEQ ID NO: 20045 - protein, 6 aa, synthetic construct
  REGION 1..6: note = Synthetic Construct
TKPRIK

SEQ ID NO: 20046 - protein, 6 aa, synthetic construct
  REGION 1..6: note = Synthetic Construct
TKPRLK

SEQ ID NO: 20047 - protein, 6 aa, synthetic construct
  REGION 1..6: note = Synthetic Construct
TKPRNK

SEQ ID NO: 20048 - protein, 6 aa, synthetic construct
  REGION 1..6: note = Synthetic Construct
TKPRQK

SEQ ID NO: 20049 - protein, 6 aa, synthetic construct
  REGION 1..6: note = Synthetic Construct
TKPRRK

SEQ ID NO: 20050 - protein, 6 aa, synthetic construct
  REGION 1..6: note = Synthetic Construct
TKPRSK

SEQ ID NO: 20051 - protein, 6 aa, synthetic construct
  REGION 1..6: note = Synthetic Construct
TKPRTK

SEQ ID NO: 20052 - protein, 6 aa, synthetic construct
  REGION 1..6: note = Synthetic Construct
TKPRYK

SEQ ID NO: 20053 - protein, 6 aa, synthetic construct
  REGION 1..6: note = Synthetic Construct
TKPSAK

SEQ ID NO: 20054 - protein, 6 aa, synthetic construct
  REGION 1..6: note = Synthetic Construct
TKPSDK

SEQ ID NO: 20055 - protein, 6 aa, synthetic construct
  REGION 1..6: note = Synthetic Construct
TKPSEK

SEQ ID NO: 20056 - protein, 6 aa, synthetic construct
  REGION 1..6: note = Synthetic Construct
TKPSFK

SEQ ID NO: 20057 - protein, 6 aa, synthetic construct
  REGION 1..6: note = Synthetic Construct
TKPSGK

SEQ ID NO: 20058 - protein, 6 aa, synthetic construct
  REGION 1..6: note = Synthetic Construct
TKPSHK

SEQ ID NO: 20059 - protein, 6 aa, synthetic construct
  REGION 1..6: note = Synthetic Construct
TKPSIK

SEQ ID NO: 20060 - protein, 6 aa, synthetic construct
  REGION 1..6: note = Synthetic Construct
TKPSLK

SEQ ID NO: 20061 - protein, 6 aa, synthetic construct
  REGION 1..6: note = Synthetic Construct
TKPSNK

SEQ ID NO: 20062 - protein, 6 aa, synthetic construct
  REGION 1..6: note = Synthetic Construct
TKPSQK

SEQ ID NO: 20063 - protein, 6 aa, synthetic construct
  REGION 1..6: note = Synthetic Construct
TKPSRK

SEQ ID NO: 20064 - protein, 6 aa, synthetic construct
  REGION 1..6: note = Synthetic Construct
TKPSSK

SEQ ID NO: 20065 - protein, 6 aa, synthetic construct
  REGION 1..6: note = Synthetic Construct
TKPSTK

SEQ ID NO: 20066 - protein, 6 aa, synthetic construct
  REGION 1..6: note = Synthetic Construct
TKPSYK

SEQ ID NO: 20067 - protein, 6 aa, synthetic construct
  REGION 1..6: note = Synthetic Construct
TKPTAK

SEQ ID NO: 20068 - protein, 6 aa, synthetic construct
  REGION 1..6: note = Synthetic Construct
TKPTDK

SEQ ID NO: 20069 - protein, 6 aa, synthetic construct
  REGION 1..6: note = Synthetic Construct
TKPTEK

SEQ ID NO: 20070 - protein, 6 aa, synthetic construct
  REGION 1..6: note = Synthetic Construct
TKPTFK

SEQ ID NO: 20071 - protein, 6 aa, synthetic construct
  REGION 1..6: note = Synthetic Construct
TKPTGK

SEQ ID NO: 20072 - protein, 6 aa, synthetic construct
  REGION 1..6: note = Synthetic Construct
TKPTHK

SEQ ID NO: 20073 - protein, 6 aa, synthetic construct
  REGION 1..6: note = Synthetic Construct
TKPTIK

SEQ ID NO: 20074 - protein, 6 aa, synthetic construct
  REGION 1..6: note = Synthetic Construct
TKPTLK

SEQ ID NO: 20075 - protein, 6 aa, synthetic construct
  REGION 1..6: note = Synthetic Construct
TKPTNK

SEQ ID NO: 20076 - protein, 6 aa, synthetic construct
  REGION 1..6: note = Synthetic Construct
TKPTQK

SEQ ID NO: 20077 - protein, 6 aa, synthetic construct
  REGION 1..6: note = Synthetic Construct
TKPTRK

SEQ ID NO: 20078 - protein, 6 aa, synthetic construct
  REGION 1..6: note = Synthetic Construct
TKPTSK

SEQ ID NO: 20079 - protein, 6 aa, synthetic construct
  REGION 1..6: note = Synthetic Construct
TKPTTK

SEQ ID NO: 20080 - protein, 6 aa, synthetic construct
  REGION 1..6: note = Synthetic Construct
TKPTYK

SEQ ID NO: 20081 - protein, 6 aa, synthetic construct
  REGION 1..6: note = Synthetic Construct
TKPYAK

SEQ ID NO: 20082 - protein, 6 aa, synthetic construct
  REGION 1..6: note = Synthetic Construct
TKPYDK

SEQ ID NO: 20083 - protein, 6 aa, synthetic construct
  REGION 1..6: note = Synthetic Construct
TKPYEK

SEQ ID NO: 20084 - protein, 6 aa, synthetic construct
  REGION 1..6: note = Synthetic Construct
TKPYFK

SEQ ID NO: 20085 - protein, 6 aa, synthetic construct
  REGION 1..6: note = Synthetic Construct
TKPYGK

SEQ ID NO: 20086 - protein, 6 aa, synthetic construct
  REGION 1..6: note = Synthetic Construct
TKPYHK

SEQ ID NO: 20087 - protein, 6 aa, synthetic construct
  REGION 1..6: note = Synthetic Construct
TKPYIK

SEQ ID NO: 20088 - protein, 6 aa, synthetic construct
  REGION 1..6: note = Synthetic Construct
TKPYLK

SEQ ID NO: 20089 - protein, 6 aa, synthetic construct
  REGION 1..6: note = Synthetic Construct
TKPYNK

SEQ ID NO: 20090 - protein, 6 aa, synthetic construct
  REGION 1..6: note = Synthetic Construct
TKPYQK

SEQ ID NO: 20091 - protein, 6 aa, synthetic construct
  REGION 1..6: note = Synthetic Construct
TKPYRK

SEQ ID NO: 20092 - protein, 6 aa, synthetic construct
  REGION 1..6: note = Synthetic Construct
TKPYSK

SEQ ID NO: 20093 - protein, 6 aa, synthetic construct
  REGION 1..6: note = Synthetic Construct
TKPYTK

SEQ ID NO: 20094 - protein, 6 aa, synthetic construct
  REGION 1..6: note = Synthetic Construct
TKPYYK

SEQ ID NO: 20095 - protein, 6 aa, synthetic construct
  REGION 1..6: note = Synthetic Construct
TKQAAK

SEQ ID NO: 20096 - protein, 6 aa, synthetic construct
  REGION 1..6: note = Synthetic Construct
TKQADK

SEQ ID NO: 20097 - protein, 6 aa, synthetic construct
  REGION 1..6: note = Synthetic Construct
TKQAEK

SEQ ID NO: 20098 - protein, 6 aa, synthetic construct
  REGION 1..6: note = Synthetic Construct
TKQAFK

SEQ ID NO: 20099 - protein, 6 aa, synthetic construct
  REGION 1..6: note = Synthetic Construct
TKQAGK

SEQ ID NO: 20100 - protein, 6 aa, synthetic construct
  REGION 1..6: note = Synthetic Construct
TKQAHK

SEQ ID NO: 20101 - protein, 6 aa, synthetic construct
  REGION 1..6: note = Synthetic Construct
TKQAIK

SEQ ID NO: 20102 - protein, 6 aa, synthetic construct
  REGION 1..6: note = Synthetic Construct
TKQALK

SEQ ID NO: 20103 - protein, 6 aa, synthetic construct
  REGION 1..6: note = Synthetic Construct
TKQANK

SEQ ID NO: 20104 - protein, 6 aa, synthetic construct
  REGION 1..6: note = Synthetic Construct
TKQAQK

SEQ ID NO: 20105 - protein, 6 aa, synthetic construct
  REGION 1..6: note = Synthetic Construct
TKQARK

SEQ ID NO: 20106 - protein, 6 aa, synthetic construct
  REGION 1..6: note = Synthetic Construct
TKQASK

SEQ ID NO: 20107 - protein, 6 aa, synthetic construct
  REGION 1..6: note = Synthetic Construct
TKQATK

SEQ ID NO: 20108 - protein, 6 aa, synthetic construct
  REGION 1..6: note = Synthetic Construct
TKQAYK

SEQ ID NO: 20109 - protein, 6 aa, synthetic construct
  REGION 1..6: note = Synthetic Construct
TKQDAK

SEQ ID NO: 20110 - protein, 6 aa, synthetic construct
  REGION 1..6: note = Synthetic Construct
TKQDDK

SEQ ID NO: 20111 - protein, 6 aa, synthetic construct
  REGION 1..6: note = Synthetic Construct
TKQDEK

SEQ ID NO: 20112 - protein, 6 aa, synthetic construct
  REGION 1..6: note = Synthetic Construct
TKQDFK

SEQ ID NO: 20113 - protein, 6 aa, synthetic construct
  REGION 1..6: note = Synthetic Construct
TKQDGK

SEQ ID NO: 20114 - protein, 6 aa, synthetic construct
  REGION 1..6: note = Synthetic Construct
TKQDHK

SEQ ID NO: 20115 - protein, 6 aa, synthetic construct
  REGION 1..6: note = Synthetic Construct
TKQDIK

SEQ ID NO: 20116 - protein, 6 aa, synthetic construct
  REGION 1..6: note = Synthetic Construct
TKQDLK

SEQ ID NO: 20117 - protein, 6 aa, synthetic construct
  REGION 1..6: note = Synthetic Construct
TKQDNK

SEQ ID NO: 20118 - protein, 6 aa, synthetic construct
  REGION 1..6: note = Synthetic Construct
TKQDQK

SEQ ID NO: 20119 - protein, 6 aa, synthetic construct
  REGION 1..6: note = Synthetic Construct
TKQDRK

SEQ ID NO: 20120 - protein, 6 aa, synthetic construct
  REGION 1..6: note = Synthetic Construct
TKQDSK

SEQ ID NO: 20121 - protein, 6 aa, synthetic construct
  REGION 1..6: note = Synthetic Construct
TKQDTK

SEQ ID NO: 20122 - protein, 6 aa, synthetic construct
  REGION 1..6: note = Synthetic Construct
TKQDYK

SEQ ID NO: 20123 - protein, 6 aa, synthetic construct
  REGION 1..6: note = Synthetic Construct
TKQEAK

SEQ ID NO: 20124 - protein, 6 aa, synthetic construct
  REGION 1..6: note = Synthetic Construct
TKQEDK

SEQ ID NO: 20125 - protein, 6 aa, synthetic construct
  REGION 1..6: note = Synthetic Construct
TKQEEK

SEQ ID NO: 20126 - protein, 6 aa, synthetic construct
  REGION 1..6: note = Synthetic Construct
TKQEFK

SEQ ID NO: 20127 - protein, 6 aa, synthetic construct
  REGION 1..6: note = Synthetic Construct
TKQEGK

SEQ ID NO: 20128 - protein, 6 aa, synthetic construct
  REGION 1..6: note = Synthetic Construct
TKQEHK

SEQ ID NO: 20129 - protein, 6 aa, synthetic construct
  REGION 1..6: note = Synthetic Construct
TKQEIK

SEQ ID NO: 20130 - protein, 6 aa, synthetic construct
  REGION 1..6: note = Synthetic Construct
TKQELK

SEQ ID NO: 20131 - protein, 6 aa, synthetic construct
  REGION 1..6: note = Synthetic Construct
TKQENK

SEQ ID NO: 20132 - protein, 6 aa, synthetic construct
  REGION 1..6: note = Synthetic Construct
TKQEQK

SEQ ID NO: 20133 - protein, 6 aa, synthetic construct
  REGION 1..6: note = Synthetic Construct
TKQERK

SEQ ID NO: 20134 - protein, 6 aa, synthetic construct
  REGION 1..6: note = Synthetic Construct
TKQESK

SEQ ID NO: 20135 - protein, 6 aa, synthetic construct
  REGION 1..6: note = Synthetic Construct
TKQETK

SEQ ID NO: 20136 - protein, 6 aa, synthetic construct
  REGION 1..6: note = Synthetic Construct
TKQEYK

SEQ ID NO: 20137 - protein, 6 aa, synthetic construct
  REGION 1..6: note = Synthetic Construct
TKQFAK

SEQ ID NO: 20138 - protein, 6 aa, synthetic construct
  REGION 1..6: note = Synthetic Construct
TKQFDK

SEQ ID NO: 20139 - protein, 6 aa, synthetic construct
  REGION 1..6: note = Synthetic Construct
TKQFEK

SEQ ID NO: 20140 - protein, 6 aa, synthetic construct
  REGION 1..6: note = Synthetic Construct
TKQFFK

SEQ ID NO: 20141 - protein, 6 aa, synthetic construct
  REGION 1..6: note = Synthetic Construct
TKQFGK

SEQ ID NO: 20142 - protein, 6 aa, synthetic construct
  REGION 1..6: note = Synthetic Construct
TKQFHK

SEQ ID NO: 20143 - protein, 6 aa, synthetic construct
  REGION 1..6: note = Synthetic Construct
TKQFIK

SEQ ID NO: 20144 - protein, 6 aa, synthetic construct
  REGION 1..6: note = Synthetic Construct
TKQFLK

SEQ ID NO: 20145 - protein, 6 aa, synthetic construct
  REGION 1..6: note = Synthetic Construct
TKQFNK

SEQ ID NO: 20146 - protein, 6 aa, synthetic construct
  REGION 1..6: note = Synthetic Construct
TKQFQK

SEQ ID NO: 20147 - protein, 6 aa, synthetic construct
  REGION 1..6: note = Synthetic Construct
TKQFRK

SEQ ID NO: 20148 - protein, 6 aa, synthetic construct
  REGION 1..6: note = Synthetic Construct
TKQFSK

SEQ ID NO: 20149 - protein, 6 aa, synthetic construct
  REGION 1..6: note = Synthetic Construct
TKQFTK

SEQ ID NO: 20150 - protein, 6 aa, synthetic construct
  REGION 1..6: note = Synthetic Construct
TKQFYK

SEQ ID NO: 20151 - protein, 6 aa, synthetic construct
  REGION 1..6: note = Synthetic Construct
TKQGAK

SEQ ID NO: 20152 - protein, 6 aa, synthetic construct
  REGION 1..6: note = Synthetic Construct
TKQGDK

SEQ ID NO: 20153 - protein, 6 aa, synthetic construct
  REGION 1..6: note = Synthetic Construct
TKQGEK

SEQ ID NO: 20154 - protein, 6 aa, synthetic construct
  REGION 1..6: note = Synthetic Construct
TKQGFK

SEQ ID NO: 20155 - protein, 6 aa, synthetic construct
  REGION 1..6: note = Synthetic Construct
TKQGGK

SEQ ID NO: 20156 - protein, 6 aa, synthetic construct
  REGION 1..6: note = Synthetic Construct
TKQGHK

SEQ ID NO: 20157 - protein, 6 aa, synthetic construct
  REGION 1..6: note = Synthetic Construct
TKQGIK

SEQ ID NO: 20158 - protein, 6 aa, synthetic construct
  REGION 1..6: note = Synthetic Construct
TKQGLK

SEQ ID NO: 20159 - protein, 6 aa, synthetic construct
  REGION 1..6: note = Synthetic Construct
TKQGNK

SEQ ID NO: 20160 - protein, 6 aa, synthetic construct
  REGION 1..6: note = Synthetic Construct
TKQGQK

SEQ ID NO: 20161 - protein, 6 aa, synthetic construct
  REGION 1..6: note = Synthetic Construct
TKQGRK

SEQ ID NO: 20162 - protein, 6 aa, synthetic construct
  REGION 1..6: note = Synthetic Construct
TKQGSK

SEQ ID NO: 20163 - protein, 6 aa, synthetic construct
  REGION 1..6: note = Synthetic Construct
TKQGTK

SEQ ID NO: 20164 - protein, 6 aa, synthetic construct
  REGION 1..6: note = Synthetic Construct
TKQGYK

SEQ ID NO: 20165 - protein, 6 aa, synthetic construct
  REGION 1..6: note = Synthetic Construct
TKQHAK

SEQ ID NO: 20166 - protein, 6 aa, synthetic construct
  REGION 1..6: note = Synthetic Construct
TKQHDK

SEQ ID NO: 20167 - protein, 6 aa, synthetic construct
  REGION 1..6: note = Synthetic Construct
TKQHEK

SEQ ID NO: 20168 - protein, 6 aa, synthetic construct
  REGION 1..6: note = Synthetic Construct
TKQHFK

SEQ ID NO: 20169 - protein, 6 aa, synthetic construct
  REGION 1..6: note = Synthetic Construct
TKQHGK

SEQ ID NO: 20170 - protein, 6 aa, synthetic construct
  REGION 1..6: note = Synthetic Construct
TKQHHK

SEQ ID NO: 20171 - protein, 6 aa, synthetic construct
  REGION 1..6: note = Synthetic Construct
TKQHIK

SEQ ID NO: 20172 - protein, 6 aa, synthetic construct
  REGION 1..6: note = Synthetic Construct
TKQHLK

SEQ ID NO: 20173 - protein, 6 aa, synthetic construct
  REGION 1..6: note = Synthetic Construct
TKQHNK

SEQ ID NO: 20174 - protein, 6 aa, synthetic construct
  REGION 1..6: note = Synthetic Construct
TKQHQK

SEQ ID NO: 20175 - protein, 6 aa, synthetic construct
  REGION 1..6: note = Synthetic Construct
TKQHRK

SEQ ID NO: 20176 - protein, 6 aa, synthetic construct
  REGION 1..6: note = Synthetic Construct
TKQHSK

SEQ ID NO: 20177 - protein, 6 aa, synthetic construct
  REGION 1..6: note = Synthetic Construct
TKQHTK

SEQ ID NO: 20178 - protein, 6 aa, synthetic construct
  REGION 1..6: note = Synthetic Construct
TKQHYK

SEQ ID NO: 20179 - protein, 6 aa, synthetic construct
  REGION 1..6: note = Synthetic Construct
TKQIAK

SEQ ID NO: 20180 - protein, 6 aa, synthetic construct
  REGION 1..6: note = Synthetic Construct
TKQIDK

SEQ ID NO: 20181 - protein, 6 aa, synthetic construct
  REGION 1..6: note = Synthetic Construct
TKQIEK

SEQ ID NO: 20182 - protein, 6 aa, synthetic construct
  REGION 1..6: note = Synthetic Construct
TKQIFK

SEQ ID NO: 20183 - protein, 6 aa, synthetic construct
  REGION 1..6: note = Synthetic Construct
TKQIGK

SEQ ID NO: 20184 - protein, 6 aa, synthetic construct
  REGION 1..6: note = Synthetic Construct
TKQIHK

SEQ ID NO: 20185 - protein, 6 aa, synthetic construct
  REGION 1..6: note = Synthetic Construct
TKQIIK

SEQ ID NO: 20186 - protein, 6 aa, synthetic construct
  REGION 1..6: note = Synthetic Construct
TKQILK

SEQ ID NO: 20187 - protein, 6 aa, synthetic construct
  REGION 1..6: note = Synthetic Construct
TKQINK

SEQ ID NO: 20188 - protein, 6 aa, synthetic construct
  REGION 1..6: note = Synthetic Construct
TKQIQK

SEQ ID NO: 20189 - protein, 6 aa, synthetic construct
  REGION 1..6: note = Synthetic Construct
TKQIRK

SEQ ID NO: 20190 - protein, 6 aa, synthetic construct
  REGION 1..6: note = Synthetic Construct
TKQISK

SEQ ID NO: 20191 - protein, 6 aa, synthetic construct
  REGION 1..6: note = Synthetic Construct
TKQITK

SEQ ID NO: 20192 - protein, 6 aa, synthetic construct
  REGION 1..6: note = Synthetic Construct
TKQIYK

SEQ ID NO: 20193 - protein, 6 aa, synthetic construct
  REGION 1..6: note = Synthetic Construct
TKQLAK

SEQ ID NO: 20194 - protein, 6 aa, synthetic construct
  REGION 1..6: note = Synthetic Construct
TKQLDK

SEQ ID NO: 20195 - protein, 6 aa, synthetic construct
  REGION 1..6: note = Synthetic Construct
TKQLEK

SEQ ID NO: 20196 - protein, 6 aa, synthetic construct
  REGION 1..6: note = Synthetic Construct
TKQLFK

SEQ ID NO: 20197 - protein, 6 aa, synthetic construct
  REGION 1..6: note = Synthetic Construct
TKQLGK

SEQ ID NO: 20198 - protein, 6 aa, synthetic construct
  REGION 1..6: note = Synthetic Construct
TKQLHK

SEQ ID NO: 20199 - protein, 6 aa, synthetic construct
  REGION 1..6: note = Synthetic Construct
TKQLIK

SEQ ID NO: 20200 - protein, 6 aa, synthetic construct
  REGION 1..6: note = Synthetic Construct
TKQLLK

SEQ ID NO: 20201 - protein, 6 aa, synthetic construct
  REGION 1..6: note = Synthetic Construct
TKQLNK

SEQ ID NO: 20202 - protein, 6 aa, synthetic construct
  REGION 1..6: note = Synthetic Construct
TKQLQK

SEQ ID NO: 20203 - protein, 6 aa, synthetic construct
  REGION 1..6: note = Synthetic Construct
TKQLRK

SEQ ID NO: 20204 - protein, 6 aa, synthetic construct
  REGION 1..6: note = Synthetic Construct
TKQLSK

SEQ ID NO: 20205 - protein, 6 aa, synthetic construct
  REGION 1..6: note = Synthetic Construct
TKQLTK

SEQ ID NO: 20206 - protein, 6 aa, synthetic construct
  REGION 1..6: note = Synthetic Construct
TKQLYK

SEQ ID NO: 20207 - protein, 6 aa, synthetic construct
  REGION 1..6: note = Synthetic Construct
TKQNAK

SEQ ID NO: 20208 - protein, 6 aa, synthetic construct
  REGION 1..6: note = Synthetic Construct
TKQNDK

SEQ ID NO: 20209 - protein, 6 aa, synthetic construct
  REGION 1..6: note = Synthetic Construct
TKQNEK

SEQ ID NO: 20210 - protein, 6 aa, synthetic construct
  REGION 1..6: note = Synthetic Construct
TKQNFK

SEQ ID NO: 20211 - protein, 6 aa, synthetic construct
  REGION 1..6: note = Synthetic Construct
TKQNGK

SEQ ID NO: 20212 - protein, 6 aa, synthetic construct
  REGION 1..6: note = Synthetic Construct
TKQNHK

SEQ ID NO: 20213 - protein, 6 aa, synthetic construct
  REGION 1..6: note = Synthetic Construct
TKQNIK

SEQ ID NO: 20214 - protein, 6 aa, synthetic construct
  REGION 1..6: note = Synthetic Construct
TKQNLK

SEQ ID NO: 20215 - protein, 6 aa, synthetic construct
  REGION 1..6: note = Synthetic Construct
TKQNNK

SEQ ID NO: 20216 - protein, 6 aa, synthetic construct
  REGION 1..6: note = Synthetic Construct
TKQNQK

SEQ ID NO: 20217 - protein, 6 aa, synthetic construct
  REGION 1..6: note = Synthetic Construct
TKQNRK

SEQ ID NO: 20218 - protein, 6 aa, synthetic construct
  REGION 1..6: note = Synthetic Construct
TKQNSK

SEQ ID NO: 20219 - protein, 6 aa, synthetic construct
  REGION 1..6: note = Synthetic Construct
TKQNTK

SEQ ID NO: 20220 - protein, 6 aa, synthetic construct
  REGION 1..6: note = Synthetic Construct
TKQNYK

SEQ ID NO: 20221 - protein, 6 aa, synthetic construct
  REGION 1..6: note = Synthetic Construct
TKQQAK

SEQ ID NO: 20222 - protein, 6 aa, synthetic construct
  REGION 1..6: note = Synthetic Construct
TKQQDK

SEQ ID NO: 20223 - protein, 6 aa, synthetic construct
  REGION 1..6: note = Synthetic Construct
TKQQEK

SEQ ID NO: 20224 - protein, 6 aa, synthetic construct
  REGION 1..6: note = Synthetic Construct
TKQQFK

SEQ ID NO: 20225 - protein, 6 aa, synthetic construct
  REGION 1..6: note = Synthetic Construct
TKQQGK

SEQ ID NO: 20226 - protein, 6 aa, synthetic construct
  REGION 1..6: note = Synthetic Construct
TKQQHK

SEQ ID NO: 20227 - protein, 6 aa, synthetic construct
  REGION 1..6: note = Synthetic Construct
TKQQIK

SEQ ID NO: 20228 - protein, 6 aa, synthetic construct
  REGION 1..6: note = Synthetic Construct
TKQQLK

SEQ ID NO: 20229 - protein, 6 aa, synthetic construct
  REGION 1..6: note = Synthetic Construct
TKQQNK

SEQ ID NO: 20230 - protein, 6 aa, synthetic construct
  REGION 1..6: note = Synthetic Construct
TKQQQK

SEQ ID NO: 20231 - protein, 6 aa, synthetic construct
  REGION 1..6: note = Synthetic Construct
TKQQRK

SEQ ID NO: 20232 - protein, 6 aa, synthetic construct
  REGION 1..6: note = Synthetic Construct
TKQQSK

SEQ ID NO: 20233 - protein, 6 aa, synthetic construct
  REGION 1..6: note = Synthetic Construct
TKQQTK

SEQ ID NO: 20234 - protein, 6 aa, synthetic construct
  REGION 1..6: note = Synthetic Construct
TKQQYK

SEQ ID NO: 20235 - protein, 6 aa, synthetic construct
  REGION 1..6: note = Synthetic Construct
TKQRAK

SEQ ID NO: 20236 - protein, 6 aa, synthetic construct
  REGION 1..6: note = Synthetic Construct
TKQRDK

SEQ ID NO: 20237 - protein, 6 aa, synthetic construct
  REGION 1..6: note = Synthetic Construct
TKQREK

SEQ ID NO: 20238 - protein, 6 aa, synthetic construct
  REGION 1..6: note = Synthetic Construct
TKQRFK

SEQ ID NO: 20239 - protein, 6 aa, synthetic construct
  REGION 1..6: note = Synthetic Construct
TKQRGK

SEQ ID NO: 20240 - protein, 6 aa, synthetic construct
  REGION 1..6: note = Synthetic Construct
TKQRHK

SEQ ID NO: 20241 - protein, 6 aa, synthetic construct
  REGION 1..6: note = Synthetic Construct
TKQRIK

SEQ ID NO: 20242 - protein, 6 aa, synthetic construct
  REGION 1..6: note = Synthetic Construct
TKQRLK

SEQ ID NO: 20243 - protein, 6 aa, synthetic construct
  REGION 1..6: note = Synthetic Construct
TKQRNK

SEQ ID NO: 20244 - protein, 6 aa, synthetic construct
  REGION 1..6: note = Synthetic Construct
TKQRQK

SEQ ID NO: 20245 - protein, 6 aa, synthetic construct
  REGION 1..6: note = Synthetic Construct
TKQRRK

SEQ ID NO: 20246 - protein, 6 aa, synthetic construct
  REGION 1..6: note = Synthetic Construct
TKQRSK

SEQ ID NO: 20247 - protein, 6 aa, synthetic construct
  REGION 1..6: note = Synthetic Construct
TKQRTK

SEQ ID NO: 20248 - protein, 6 aa, synthetic construct
  REGION 1..6: note = Synthetic Construct
TKQRYK

SEQ ID NO: 20249 - protein, 6 aa, synthetic construct
  REGION 1..6: note = Synthetic Construct
TKQSAK

SEQ ID NO: 20250 - protein, 6 aa, synthetic construct
  REGION 1..6: note = Synthetic Construct
TKQSDK

SEQ ID NO: 20251 - protein, 6 aa, synthetic construct
  REGION 1..6: note = Synthetic Construct
TKQSEK

SEQ ID NO: 20252 - protein, 6 aa, synthetic construct
  REGION 1..6: note = Synthetic Construct
TKQSFK

SEQ ID NO: 20253 - protein, 6 aa, synthetic construct
  REGION 1..6: note = Synthetic Construct
TKQSGK

SEQ ID NO: 20254 - protein, 6 aa, synthetic construct
  REGION 1..6: note = Synthetic Construct
TKQSHK

SEQ ID NO: 20255 - protein, 6 aa, synthetic construct
  REGION 1..6: note = Synthetic Construct
TKQSIK

SEQ ID NO: 20256 - protein, 6 aa, synthetic construct
  REGION 1..6: note = Synthetic Construct
TKQSLK

SEQ ID NO: 20257 - protein, 6 aa, synthetic construct
  REGION 1..6: note = Synthetic Construct
TKQSNK

SEQ ID NO: 20258 - protein, 6 aa, synthetic construct
  REGION 1..6: note = Synthetic Construct
TKQSQK

SEQ ID NO: 20259 - protein, 6 aa, synthetic construct
  REGION 1..6: note = Synthetic Construct
TKQSRK

SEQ ID NO: 20260 - protein, 6 aa, synthetic construct
  REGION 1..6: note = Synthetic Construct
TKQSSK

SEQ ID NO: 20261 - protein, 6 aa, synthetic construct
  REGION 1..6: note = Synthetic Construct
TKQSTK

SEQ ID NO: 20262 - protein, 6 aa, synthetic construct
  REGION 1..6: note = Synthetic Construct
TKQSYK

SEQ ID NO: 20263 - protein, 6 aa, synthetic construct
  REGION 1..6: note = Synthetic Construct
TKQTAK

SEQ ID NO: 20264 - protein, 6 aa, synthetic construct
  REGION 1..6: note = Synthetic Construct
TKQTDK

SEQ ID NO: 20265 - protein, 6 aa, synthetic construct
  REGION 1..6: note = Synthetic Construct
TKQTEK

SEQ ID NO: 20266 - protein, 6 aa, synthetic construct
  REGION 1..6: note = Synthetic Construct
TKQTFK

SEQ ID NO: 20267 - protein, 6 aa, synthetic construct
  REGION 1..6: note = Synthetic Construct
TKQTGK

SEQ ID NO: 20268 - protein, 6 aa, synthetic construct
  REGION 1..6: note = Synthetic Construct
TKQTHK

SEQ ID NO: 20269 - protein, 6 aa, synthetic construct
  REGION 1..6: note = Synthetic Construct
TKQTIK

SEQ ID NO: 20270 - protein, 6 aa, synthetic construct
  REGION 1..6: note = Synthetic Construct
TKQTLK

SEQ ID NO: 20271 - protein, 6 aa, synthetic construct
  REGION 1..6: note = Synthetic Construct
TKQTNK

SEQ ID NO: 20272 - protein, 6 aa, synthetic construct
  REGION 1..6: note = Synthetic Construct
TKQTQK

SEQ ID NO: 20273 - protein, 6 aa, synthetic construct
  REGION 1..6: note = Synthetic Construct
TKQTRK

SEQ ID NO: 20274 - protein, 6 aa, synthetic construct
  REGION 1..6: note = Synthetic Construct
TKQTSK

SEQ ID NO: 20275 - protein, 6 aa, synthetic construct
  REGION 1..6: note = Synthetic Construct
TKQTTK

SEQ ID NO: 20276 - protein, 6 aa, synthetic construct
  REGION 1..6: note = Synthetic Construct
TKQTYK

SEQ ID NO: 20277 - protein, 6 aa, synthetic construct
  REGION 1..6: note = Synthetic Construct
TKQYAK

SEQ ID NO: 20278 - protein, 6 aa, synthetic construct
  REGION 1..6: note = Synthetic Construct
TKQYDK

SEQ ID NO: 20279 - protein, 6 aa, synthetic construct
  REGION 1..6: note = Synthetic Construct
TKQYEK

SEQ ID NO: 20280 - protein, 6 aa, synthetic construct
  REGION 1..6: note = Synthetic Construct
TKQYFK

SEQ ID NO: 20281 - protein, 6 aa, synthetic construct
  REGION 1..6: note = Synthetic Construct
TKQYGK

SEQ ID NO: 20282 - protein, 6 aa, synthetic construct
  REGION 1..6: note = Synthetic Construct
TKQYHK

SEQ ID NO: 20283 - protein, 6 aa, synthetic construct
  REGION 1..6: note = Synthetic Construct
TKQYIK

SEQ ID NO: 20284 - protein, 6 aa, synthetic construct
  REGION 1..6: note = Synthetic Construct
TKQYLK

SEQ ID NO: 20285 - protein, 6 aa, synthetic construct
  REGION 1..6: note = Synthetic Construct
TKQYNK

SEQ ID NO: 20286 - protein, 6 aa, synthetic construct
  REGION 1..6: note = Synthetic Construct
TKQYQK

SEQ ID NO: 20287 - protein, 6 aa, synthetic construct
  REGION 1..6: note = Synthetic Construct
TKQYRK

SEQ ID NO: 20288 - protein, 6 aa, synthetic construct
  REGION 1..6: note = Synthetic Construct
TKQYSK

SEQ ID NO: 20289 - protein, 6 aa, synthetic construct
  REGION 1..6: note = Synthetic Construct
TKQYTK

SEQ ID NO: 20290 - protein, 6 aa, synthetic construct
  REGION 1..6: note = Synthetic Construct
TKQYYK

SEQ ID NO: 20291 - protein, 6 aa, synthetic construct
  REGION 1..6: note = Synthetic Construct
TKRAAK

SEQ ID NO: 20292 - protein, 6 aa, synthetic construct
  REGION 1..6: note = Synthetic Construct
TKRADK

SEQ ID NO: 20293 - protein, 6 aa, synthetic construct
  REGION 1..6: note = Synthetic Construct
TKRAEK

SEQ ID NO: 20294 - protein, 6 aa, synthetic construct
  REGION 1..6: note = Synthetic Construct
TKRAFK

SEQ ID NO: 20295 - protein, 6 aa, synthetic construct
  REGION 1..6: note = Synthetic Construct
TKRAGK

SEQ ID NO: 20296 - protein, 6 aa, synthetic construct
  REGION 1..6: note = Synthetic Construct
TKRAHK

SEQ ID NO: 20297 - protein, 6 aa, synthetic construct
  REGION 1..6: note = Synthetic Construct
TKRAIK

SEQ ID NO: 20298 - protein, 6 aa, synthetic construct
  REGION 1..6: note = Synthetic Construct
TKRALK

SEQ ID NO: 20299 - protein, 6 aa, synthetic construct
  REGION 1..6: note = Synthetic Construct
TKRANK

SEQ ID NO: 20300 - protein, 6 aa, synthetic construct
  REGION 1..6: note = Synthetic Construct
TKRAQK

SEQ ID NO: 20301 - protein, 6 aa, synthetic construct
  REGION 1..6: note = Synthetic Construct
TKRARK

SEQ ID NO: 20302 - protein, 6 aa, synthetic construct
  REGION 1..6: note = Synthetic Construct
TKRASK

SEQ ID NO: 20303 - protein, 6 aa, synthetic construct
  REGION 1..6: note = Synthetic Construct
TKRATK

SEQ ID NO: 20304 - protein, 6 aa, synthetic construct
  REGION 1..6: note = Synthetic Construct
TKRAYK

SEQ ID NO: 20305 - protein, 6 aa, synthetic construct
  REGION 1..6: note = Synthetic Construct
TKRDAK

SEQ ID NO: 20306 - protein, 6 aa, synthetic construct
  REGION 1..6: note = Synthetic Construct
TKRDDK

SEQ ID NO: 20307 - protein, 6 aa, synthetic construct
  REGION 1..6: note = Synthetic Construct
TKRDEK

SEQ ID NO: 20308 - protein, 6 aa, synthetic construct
  REGION 1..6: note = Synthetic Construct
TKRDFK

SEQ ID NO: 20309 - protein, 6 aa, synthetic construct
  REGION 1..6: note = Synthetic Construct
TKRDGK

SEQ ID NO: 20310 - protein, 6 aa, synthetic construct
  REGION 1..6: note = Synthetic Construct
TKRDHK

SEQ ID NO: 20311 - protein, 6 aa, synthetic construct
  REGION 1..6: note = Synthetic Construct
TKRDIK

SEQ ID NO: 20312 - protein, 6 aa, synthetic construct
  REGION 1..6: note = Synthetic Construct
TKRDLK

SEQ ID NO: 20313 - protein, 6 aa, synthetic construct
  REGION 1..6: note = Synthetic Construct
TKRDNK

SEQ ID NO: 20314 - protein, 6 aa, synthetic construct
  REGION 1..6: note = Synthetic Construct
TKRDQK

SEQ ID NO: 20315 - protein, 6 aa, synthetic construct
  REGION 1..6: note = Synthetic Construct
TKRDRK

SEQ ID NO: 20316 - protein, 6 aa, synthetic construct
  REGION 1..6: note = Synthetic Construct
TKRDSK

SEQ ID NO: 20317 - protein, 6 aa, synthetic construct
  REGION 1..6: note = Synthetic Construct
TKRDTK

SEQ ID NO: 20318 - protein, 6 aa, synthetic construct
  REGION 1..6: note = Synthetic Construct
TKRDYK

SEQ ID NO: 20319 - protein, 6 aa, synthetic construct
  REGION 1..6: note = Synthetic Construct
TKREAK

SEQ ID NO: 20320 - protein, 6 aa, synthetic construct
  REGION 1..6: note = Synthetic Construct
TKREDK

SEQ ID NO: 20321 - protein, 6 aa, synthetic construct
  REGION 1..6: note = Synthetic Construct
TKREEK

SEQ ID NO: 20322 - protein, 6 aa, synthetic construct
  REGION 1..6: note = Synthetic Construct
TKREFK

SEQ ID NO: 20323 - protein, 6 aa, synthetic construct
  REGION 1..6: note = Synthetic Construct
TKREGK

SEQ ID NO: 20324 - protein, 6 aa, synthetic construct
  REGION 1..6: note = Synthetic Construct
TKREHK

SEQ ID NO: 20325 - protein, 6 aa, synthetic construct
  REGION 1..6: note = Synthetic Construct
TKREIK

SEQ ID NO: 20326 - protein, 6 aa, synthetic construct
  REGION 1..6: note = Synthetic Construct
TKRELK

SEQ ID NO: 20327 - protein, 6 aa, synthetic construct
  REGION 1..6: note = Synthetic Construct
TKRENK

SEQ ID NO: 20328 - protein, 6 aa, synthetic construct
  REGION 1..6: note = Synthetic Construct
TKREQK

SEQ ID NO: 20329 - protein, 6 aa, synthetic construct
  REGION 1..6: note = Synthetic Construct
TKRERK

SEQ ID NO: 20330 - protein, 6 aa, synthetic construct
  REGION 1..6: note = Synthetic Construct
TKRESK

SEQ ID NO: 20331 - protein, 6 aa, synthetic construct
  REGION 1..6: note = Synthetic Construct
TKRETK

SEQ ID NO: 20332 - protein, 6 aa, synthetic construct
  REGION 1..6: note = Synthetic Construct
TKREYK

SEQ ID NO: 20333 - protein, 6 aa, synthetic construct
  REGION 1..6: note = Synthetic Construct
TKRFAK

SEQ ID NO: 20334 - protein, 6 aa, synthetic construct
  REGION 1..6: note = Synthetic Construct
TKRFDK

SEQ ID NO: 20335 - protein, 6 aa, synthetic construct
  REGION 1..6: note = Synthetic Construct
TKRFEK

SEQ ID NO: 20336 - protein, 6 aa, synthetic construct
  REGION 1..6: note = Synthetic Construct
TKRFFK

SEQ ID NO: 20337 - protein, 6 aa, synthetic construct
  REGION 1..6: note = Synthetic Construct
TKRFGK

SEQ ID NO: 20338 - protein, 6 aa, synthetic construct
  REGION 1..6: note = Synthetic Construct
TKRFHK

SEQ ID NO: 20339 - protein, 6 aa, synthetic construct
  REGION 1..6: note = Synthetic Construct
TKRFIK

SEQ ID NO: 20340 - protein, 6 aa, synthetic construct
  REGION 1..6: note = Synthetic Construct
TKRFLK

SEQ ID NO: 20341 - protein, 6 aa, synthetic construct
  REGION 1..6: note = Synthetic Construct
TKRFNK

SEQ ID NO: 20342 - protein, 6 aa, synthetic construct
  REGION 1..6: note = Synthetic Construct
TKRFQK

SEQ ID NO: 20343 - protein, 6 aa, synthetic construct
  REGION 1..6: note = Synthetic Construct
TKRFRK

SEQ ID NO: 20344 - protein, 6 aa, synthetic construct
  REGION 1..6: note = Synthetic Construct
TKRFSK

SEQ ID NO: 20345 - protein, 6 aa, synthetic construct
  REGION 1..6: note = Synthetic Construct
TKRFTK

SEQ ID NO: 20346 - protein, 6 aa, synthetic construct
  REGION 1..6: note = Synthetic Construct
TKRFYK

SEQ ID NO: 20347 - protein, 6 aa, synthetic construct
  REGION 1..6: note = Synthetic Construct
TKRGAK

SEQ ID NO: 20348 - protein, 6 aa, synthetic construct
  REGION 1..6: note = Synthetic Construct
TKRGDK

SEQ ID NO: 20349 - protein, 6 aa, synthetic construct
  REGION 1..6: note = Synthetic Construct
TKRGEK

SEQ ID NO: 20350 - protein, 6 aa, synthetic construct
  REGION 1..6: note = Synthetic Construct
TKRGFK

SEQ ID NO: 20351 - protein, 6 aa, synthetic construct
  REGION 1..6: note = Synthetic Construct
TKRGGK

SEQ ID NO: 20352 - protein, 6 aa, synthetic construct
  REGION 1..6: note = Synthetic Construct
TKRGHK

SEQ ID NO: 20353 - protein, 6 aa, synthetic construct
  REGION 1..6: note = Synthetic Construct
TKRGIK

SEQ ID NO: 20354 - protein, 6 aa, synthetic construct
  REGION 1..6: note = Synthetic Construct
TKRGLK

SEQ ID NO: 20355 - protein, 6 aa, synthetic construct
  REGION 1..6: note = Synthetic Construct
TKRGNK

SEQ ID NO: 20356 - protein, 6 aa, synthetic construct
  REGION 1..6: note = Synthetic Construct
TKRGQK

SEQ ID NO: 20357 - protein, 6 aa, synthetic construct
  REGION 1..6: note = Synthetic Construct
TKRGRK

SEQ ID NO: 20358 - protein, 6 aa, synthetic construct
  REGION 1..6: note = Synthetic Construct
TKRGSK

SEQ ID NO: 20359 - protein, 6 aa, synthetic construct
  REGION 1..6: note = Synthetic Construct
TKRGTK

SEQ ID NO: 20360 - protein, 6 aa, synthetic construct
  REGION 1..6: note = Synthetic Construct
TKRGYK

SEQ ID NO: 20361 - protein, 6 aa, synthetic construct
  REGION 1..6: note = Synthetic Construct
TKRHAK

SEQ ID NO: 20362 - protein, 6 aa, synthetic construct
  REGION 1..6: note = Synthetic Construct
TKRHDK

SEQ ID NO: 20363 - protein, 6 aa, synthetic construct
  REGION 1..6: note = Synthetic Construct
TKRHEK

SEQ ID NO: 20364 - protein, 6 aa, synthetic construct
  REGION 1..6: note = Synthetic Construct
TKRHFK

SEQ ID NO: 20365 - protein, 6 aa, synthetic construct
  REGION 1..6: note = Synthetic Construct
TKRHGK

SEQ ID NO: 20366 - protein, 6 aa, synthetic construct
  REGION 1..6: note = Synthetic Construct
TKRHHK

SEQ ID NO: 20367 - protein, 6 aa, synthetic construct
  REGION 1..6: note = Synthetic Construct
TKRHIK

SEQ ID NO: 20368 - protein, 6 aa, synthetic construct
  REGION 1..6: note = Synthetic Construct
TKRHLK

SEQ ID NO: 20369 - protein, 6 aa, synthetic construct
  REGION 1..6: note = Synthetic Construct
TKRHNK

SEQ ID NO: 20370 - protein, 6 aa, synthetic construct
  REGION 1..6: note = Synthetic Construct
TKRHQK

SEQ ID NO: 20371 - protein, 6 aa, synthetic construct
  REGION 1..6: note = Synthetic Construct
TKRHRK

SEQ ID NO: 20372 - protein, 6 aa, synthetic construct
  REGION 1..6: note = Synthetic Construct
TKRHSK

SEQ ID NO: 20373 - protein, 6 aa, synthetic construct
  REGION 1..6: note = Synthetic Construct
TKRHTK

SEQ ID NO: 20374 - protein, 6 aa, synthetic construct
  REGION 1..6: note = Synthetic Construct
TKRHYK

SEQ ID NO: 20375 - protein, 6 aa, synthetic construct
  REGION 1..6: note = Synthetic Construct
TKRIAK

SEQ ID NO: 20376 - protein, 6 aa, synthetic construct
  REGION 1..6: note = Synthetic Construct
TKRIDK

SEQ ID NO: 20377 - protein, 6 aa, synthetic construct
  REGION 1..6: note = Synthetic Construct
TKRIEK

SEQ ID NO: 20378 - protein, 6 aa, synthetic construct
  REGION 1..6: note = Synthetic Construct
TKRIFK

SEQ ID NO: 20379 - protein, 6 aa, synthetic construct
  REGION 1..6: note = Synthetic Construct
TKRIGK

SEQ ID NO: 20380 - protein, 6 aa, synthetic construct
  REGION 1..6: note = Synthetic Construct
TKRIHK

SEQ ID NO: 20381 - protein, 6 aa, synthetic construct
  REGION 1..6: note = Synthetic Construct
TKRIIK

SEQ ID NO: 20382 - protein, 6 aa, synthetic construct
  REGION 1..6: note = Synthetic Construct
TKRILK

SEQ ID NO: 20383 - protein, 6 aa, synthetic construct
  REGION 1..6: note = Synthetic Construct
TKRINK

SEQ ID NO: 20384 - protein, 6 aa, synthetic construct
  REGION 1..6: note = Synthetic Construct
TKRIQK

SEQ ID NO: 20385 - protein, 6 aa, synthetic construct
  REGION 1..6: note = Synthetic Construct
TKRIRK

SEQ ID NO: 20386 - protein, 6 aa, synthetic construct
  REGION 1..6: note = Synthetic Construct
TKRISK

SEQ ID NO: 20387 - protein, 6 aa, synthetic construct
  REGION 1..6: note = Synthetic Construct
TKRITK

SEQ ID NO: 20388 - protein, 6 aa, synthetic construct
  REGION 1..6: note = Synthetic Construct
TKRIYK

SEQ ID NO: 20389 - protein, 6 aa, synthetic construct
  REGION 1..6: note = Synthetic Construct
TKRLAK

SEQ ID NO: 20390 - protein, 6 aa, synthetic construct
  REGION 1..6: note = Synthetic Construct
TKRLDK

SEQ ID NO: 20391 - protein, 6 aa, synthetic construct
  REGION 1..6: note = Synthetic Construct
TKRLEK

SEQ ID NO: 20392 - protein, 6 aa, synthetic construct
  REGION 1..6: note = Synthetic Construct
TKRLFK

SEQ ID NO: 20393 - protein, 6 aa, synthetic construct
  REGION 1..6: note = Synthetic Construct
TKRLGK

SEQ ID NO: 20394 - protein, 6 aa, synthetic construct
  REGION 1..6: note = Synthetic Construct
TKRLHK

SEQ ID NO: 20395 - protein, 6 aa, synthetic construct
  REGION 1..6: note = Synthetic Construct
TKRLIK

SEQ ID NO: 20396 - protein, 6 aa, synthetic construct
  REGION 1..6: note = Synthetic Construct
TKRLLK

SEQ ID NO: 20397 - protein, 6 aa, synthetic construct
  REGION 1..6: note = Synthetic Construct
TKRLNK

SEQ ID NO: 20398 - protein, 6 aa, synthetic construct
  REGION 1..6: note = Synthetic Construct
TKRLQK

SEQ ID NO: 20399 - protein, 6 aa, synthetic construct
  REGION 1..6: note = Synthetic Construct
TKRLRK

SEQ ID NO: 20400 - protein, 6 aa, synthetic construct
  REGION 1..6: note = Synthetic Construct
TKRLSK

SEQ ID NO: 20401 - protein, 6 aa, synthetic construct
  REGION 1..6: note = Synthetic Construct
TKRLTK

SEQ ID NO: 20402 - protein, 6 aa, synthetic construct
  REGION 1..6: note = Synthetic Construct
TKRLYK

SEQ ID NO: 20403 - protein, 6 aa, synthetic construct
  REGION 1..6: note = Synthetic Construct
TKRNAK

SEQ ID NO: 20404 - protein, 6 aa, synthetic construct
  REGION 1..6: note = Synthetic Construct
TKRNDK

SEQ ID NO: 20405 - protein, 6 aa, synthetic construct
  REGION 1..6: note = Synthetic Construct
TKRNEK

SEQ ID NO: 20406 - protein, 6 aa, synthetic construct
  REGION 1..6: note = Synthetic Construct
TKRNFK

SEQ ID NO: 20407 - protein, 6 aa, synthetic construct
  REGION 1..6: note = Synthetic Construct
TKRNGK

SEQ ID NO: 20408 - protein, 6 aa, synthetic construct
  REGION 1..6: note = Synthetic Construct
TKRNHK

SEQ ID NO: 20409 - protein, 6 aa, synthetic construct
  REGION 1..6: note = Synthetic Construct
TKRNIK

SEQ ID NO: 20410 - protein, 6 aa, synthetic construct
  REGION 1..6: note = Synthetic Construct
TKRNLK

SEQ ID NO: 20411 - protein, 6 aa, synthetic construct
  REGION 1..6: note = Synthetic Construct
TKRNNK

SEQ ID NO: 20412 - protein, 6 aa, synthetic construct
  REGION 1..6: note = Synthetic Construct
TKRNQK

SEQ ID NO: 20413 - protein, 6 aa, synthetic construct
  REGION 1..6: note = Synthetic Construct
TKRNRK

SEQ ID NO: 20414 - protein, 6 aa, synthetic construct
  REGION 1..6: note = Synthetic Construct
TKRNSK

SEQ ID NO: 20415 - protein, 6 aa, synthetic construct
  REGION 1..6: note = Synthetic Construct
TKRNTK

SEQ ID NO: 20416 - protein, 6 aa, synthetic construct
  REGION 1..6: note = Synthetic Construct
TKRNYK

SEQ ID NO: 20417 - protein, 6 aa, synthetic construct
  REGION 1..6: note = Synthetic Construct
TKRQAK

SEQ ID NO: 20418 - protein, 6 aa, synthetic construct
  REGION 1..6: note = Synthetic Construct
TKRQDK

SEQ ID NO: 20419 - protein, 6 aa, synthetic construct
  REGION 1..6: note = Synthetic Construct
TKRQEK

SEQ ID NO: 20420 - protein, 6 aa, synthetic construct
  REGION 1..6: note = Synthetic Construct
TKRQFK

SEQ ID NO: 20421 - protein, 6 aa, synthetic construct
  REGION 1..6: note = Synthetic Construct
TKRQGK

SEQ ID NO: 20422 - protein, 6 aa, synthetic construct
  REGION 1..6: note = Synthetic Construct
TKRQHK

SEQ ID NO: 20423 - protein, 6 aa, synthetic construct
  REGION 1..6: note = Synthetic Construct
TKRQIK

SEQ ID NO: 20424 - protein, 6 aa, synthetic construct
  REGION 1..6: note = Synthetic Construct
TKRQLK

SEQ ID NO: 20425 - protein, 6 aa, synthetic construct
  REGION 1..6: note = Synthetic Construct
TKRQNK

SEQ ID NO: 20426 - protein, 6 aa, synthetic construct
  REGION 1..6: note = Synthetic Construct
TKRQQK

SEQ ID NO: 20427 - protein, 6 aa, synthetic construct
  REGION 1..6: note = Synthetic Construct
TKRQRK

SEQ ID NO: 20428 - protein, 6 aa, synthetic construct
  REGION 1..6: note = Synthetic Construct
TKRQSK

SEQ ID NO: 20429 - protein, 6 aa, synthetic construct
  REGION 1..6: note = Synthetic Construct
TKRQTK

SEQ ID NO: 20430 - protein, 6 aa, synthetic construct
  REGION 1..6: note = Synthetic Construct
TKRQYK

SEQ ID NO: 20431 - protein, 6 aa, synthetic construct
  REGION 1..6: note = Synthetic Construct
TKRRAK

SEQ ID NO: 20432 - protein, 6 aa, synthetic construct
  REGION 1..6: note = Synthetic Construct
TKRRDK

SEQ ID NO: 20433 - protein, 6 aa, synthetic construct
  REGION 1..6: note = Synthetic Construct
TKRREK

SEQ ID NO: 20434 - protein, 6 aa, synthetic construct
  REGION 1..6: note = Synthetic Construct
TKRRFK

SEQ ID NO: 20435 - protein, 6 aa, synthetic construct
  REGION 1..6: note = Synthetic Construct
TKRRGK

SEQ ID NO: 20436 - protein, 6 aa, synthetic construct
  REGION 1..6: note = Synthetic Construct
TKRRHK

SEQ ID NO: 20437 - protein, 6 aa, synthetic construct
  REGION 1..6: note = Synthetic Construct
TKRRIK

SEQ ID NO: 20438 - protein, 6 aa, synthetic construct
  REGION 1..6: note = Synthetic Construct
TKRRLK

SEQ ID NO: 20439 - protein, 6 aa, synthetic construct
  REGION 1..6: note = Synthetic Construct
TKRRNK

SEQ ID NO: 20440 - protein, 6 aa, synthetic construct
  REGION 1..6: note = Synthetic Construct
TKRRQK

SEQ ID NO: 20441 - protein, 6 aa, synthetic construct
  REGION 1..6: note = Synthetic Construct
TKRRRK

SEQ ID NO: 20442 - protein, 6 aa, synthetic construct
  REGION 1..6: note = Synthetic Construct
TKRRSK

SEQ ID NO: 20443 - protein, 6 aa, synthetic construct
  REGION 1..6: note = Synthetic Construct
TKRRTK

SEQ ID NO: 20444 - protein, 6 aa, synthetic construct
  REGION 1..6: note = Synthetic Construct
TKRRYK

SEQ ID NO: 20445 - protein, 6 aa, synthetic construct
  REGION 1..6: note = Synthetic Construct
TKRSAK

SEQ ID NO: 20446 - protein, 6 aa, synthetic construct
  REGION 1..6: note = Synthetic Construct
TKRSDK

SEQ ID NO: 20447 - protein, 6 aa, synthetic construct
  REGION 1..6: note = Synthetic Construct
TKRSEK

SEQ ID NO: 20448 - protein, 6 aa, synthetic construct
  REGION 1..6: note = Synthetic Construct
TKRSFK

SEQ ID NO: 20449 - protein, 6 aa, synthetic construct
  REGION 1..6: note = Synthetic Construct
TKRSGK

SEQ ID NO: 20450 - protein, 6 aa, synthetic construct
  REGION 1..6: note = Synthetic Construct
TKRSHK

SEQ ID NO: 20451 - protein, 6 aa, synthetic construct
  REGION 1..6: note = Synthetic Construct
TKRSIK

SEQ ID NO: 20452 - protein, 6 aa, synthetic construct
  REGION 1..6: note = Synthetic Construct
TKRSLK

SEQ ID NO: 20453 - protein, 6 aa, synthetic construct
  REGION 1..6: note = Synthetic Construct
TKRSNK

SEQ ID NO: 20454 - protein, 6 aa, synthetic construct
  REGION 1..6: note = Synthetic Construct
TKRSQK

SEQ ID NO: 20455 - protein, 6 aa, synthetic construct
  REGION 1..6: note = Synthetic Construct
TKRSRK

SEQ ID NO: 20456 - protein, 6 aa, synthetic construct
  REGION 1..6: note = Synthetic Construct
TKRSSK

SEQ ID NO: 20457 - protein, 6 aa, synthetic construct
  REGION 1..6: note = Synthetic Construct
TKRSTK

SEQ ID NO: 20458 - protein, 6 aa, synthetic construct
  REGION 1..6: note = Synthetic Construct
TKRSYK

SEQ ID NO: 20459 - protein, 6 aa, synthetic construct
  REGION 1..6: note = Synthetic Construct
TKRTAK

SEQ ID NO: 20460 - protein, 6 aa, synthetic construct
  REGION 1..6: note = Synthetic Construct
TKRTDK

SEQ ID NO: 20461 - protein, 6 aa, synthetic construct
  REGION 1..6: note = Synthetic Construct
TKRTEK

SEQ ID NO: 20462 - protein, 6 aa, synthetic construct
  REGION 1..6: note = Synthetic Construct
TKRTFK

SEQ ID NO: 20463 - protein, 6 aa, synthetic construct
  REGION 1..6: note = Synthetic Construct
TKRTGK

SEQ ID NO: 20464 - protein, 6 aa, synthetic construct
  REGION 1..6: note = Synthetic Construct
TKRTHK

SEQ ID NO: 20465 - protein, 6 aa, synthetic construct
  REGION 1..6: note = Synthetic Construct
TKRTIK

SEQ ID NO: 20466 - protein, 6 aa, synthetic construct
  REGION 1..6: note = Synthetic Construct
TKRTLK

SEQ ID NO: 20467 - protein, 6 aa, synthetic construct
  REGION 1..6: note = Synthetic Construct
TKRTNK

SEQ ID NO: 20468 - protein, 6 aa, synthetic construct
  REGION 1..6: note = Synthetic Construct
TKRTQK

SEQ ID NO: 20469 - protein, 6 aa, synthetic construct
  REGION 1..6: note = Synthetic Construct
TKRTRK

SEQ ID NO: 20470 - protein, 6 aa, synthetic construct
  REGION 1..6: note = Synthetic Construct
TKRTSK

SEQ ID NO: 20471 - protein, 6 aa, synthetic construct
  REGION 1..6: note = Synthetic Construct
TKRTTK

SEQ ID NO: 20472 - protein, 6 aa, synthetic construct
  REGION 1..6: note = Synthetic Construct
TKRTYK

SEQ ID NO: 20473 - protein, 6 aa, synthetic construct
  REGION 1..6: note = Synthetic Construct
TKRYAK

SEQ ID NO: 20474 - protein, 6 aa, synthetic construct
  REGION 1..6: note = Synthetic Construct
TKRYDK

SEQ ID NO: 20475 - protein, 6 aa, synthetic construct
  REGION 1..6: note = Synthetic Construct
TKRYEK

SEQ ID NO: 20476 - protein, 6 aa, synthetic construct
  REGION 1..6: note = Synthetic Construct
TKRYFK

SEQ ID NO: 20477 - protein, 6 aa, synthetic construct
  REGION 1..6: note = Synthetic Construct
TKRYGK

SEQ ID NO: 20478 - protein, 6 aa, synthetic construct
  REGION 1..6: note = Synthetic Construct
TKRYHK

SEQ ID NO: 20479 - protein, 6 aa, synthetic construct
  REGION 1..6: note = Synthetic Construct
TKRYIK

SEQ ID NO: 20480 - protein, 6 aa, synthetic construct
  REGION 1..6: note = Synthetic Construct
TKRYLK

SEQ ID NO: 20481 - protein, 6 aa, synthetic construct
  REGION 1..6: note = Synthetic Construct
TKRYNK

SEQ ID NO: 20482 - protein, 6 aa, synthetic construct
  REGION 1..6: note = Synthetic Construct
TKRYQK

SEQ ID NO: 20483 - protein, 6 aa, synthetic construct
  REGION 1..6: note = Synthetic Construct
TKRYRK

SEQ ID NO: 20484 - protein, 6 aa, synthetic construct
  REGION 1..6: note = Synthetic Construct
TKRYSK

SEQ ID NO: 20485 - protein, 6 aa, synthetic construct
  REGION 1..6: note = Synthetic Construct
TKRYTK

SEQ ID NO: 20486 - protein, 6 aa, synthetic construct
  REGION 1..6: note = Synthetic Construct
TKRYYK

SEQ ID NO: 20487 - protein, 6 aa, synthetic construct
  REGION 1..6: note = Synthetic Construct
TKSAAK

SEQ ID NO: 20488 - protein, 6 aa, synthetic construct
  REGION 1..6: note = Synthetic Construct
TKSADK

SEQ ID NO: 20489 - protein, 6 aa, synthetic construct
  REGION 1..6: note = Synthetic Construct
TKSAEK

SEQ ID NO: 20490 - protein, 6 aa, synthetic construct
  REGION 1..6: note = Synthetic Construct
TKSAFK

SEQ ID NO: 20491 - protein, 6 aa, synthetic construct
  REGION 1..6: note = Synthetic Construct
TKSAGK

SEQ ID NO: 20492 - protein, 6 aa, synthetic construct
  REGION 1..6: note = Synthetic Construct
TKSAHK

SEQ ID NO: 20493 - protein, 6 aa, synthetic construct
  REGION 1..6: note = Synthetic Construct
TKSAIK

SEQ ID NO: 20494 - protein, 6 aa, synthetic construct
  REGION 1..6: note = Synthetic Construct
TKSALK

SEQ ID NO: 20495 - protein, 6 aa, synthetic construct
  REGION 1..6: note = Synthetic Construct
TKSANK

SEQ ID NO: 20496 - protein, 6 aa, synthetic construct
  REGION 1..6: note = Synthetic Construct
TKSAQK

SEQ ID NO: 20497 - protein, 6 aa, synthetic construct
  REGION 1..6: note = Synthetic Construct
TKSARK

SEQ ID NO: 20498 - protein, 6 aa, synthetic construct
  REGION 1..6: note = Synthetic Construct
TKSASK

SEQ ID NO: 20499 - protein, 6 aa, synthetic construct
  REGION 1..6: note = Synthetic Construct
TKSATK

SEQ ID NO: 20500 - protein, 6 aa, synthetic construct
  REGION 1..6: note = Synthetic Construct
TKSAYK

SEQ ID NO: 20501 - protein, 6 aa, synthetic construct
  REGION 1..6: note = Synthetic Construct
TKSDAK

SEQ ID NO: 20502 - protein, 6 aa, synthetic construct
  REGION 1..6: note = Synthetic Construct
TKSDDK

SEQ ID NO: 20503 - protein, 6 aa, synthetic construct
  REGION 1..6: note = Synthetic Construct
TKSDEK

SEQ ID NO: 20504 - protein, 6 aa, synthetic construct
  REGION 1..6: note = Synthetic Construct
TKSDFK

SEQ ID NO: 20505 - protein, 6 aa, synthetic construct
  REGION 1..6: note = Synthetic Construct
TKSDGK

SEQ ID NO: 20506 - protein, 6 aa, synthetic construct
  REGION 1..6: note = Synthetic Construct
TKSDHK

SEQ ID NO: 20507 - protein, 6 aa, synthetic construct
  REGION 1..6: note = Synthetic Construct
TKSDIK

SEQ ID NO: 20508 - protein, 6 aa, synthetic construct
  REGION 1..6: note = Synthetic Construct
TKSDLK

SEQ ID NO: 20509 - protein, 6 aa, synthetic construct
  REGION 1..6: note = Synthetic Construct
TKSDNK

SEQ ID NO: 20510 - protein, 6 aa, synthetic construct
  REGION 1..6: note = Synthetic Construct
TKSDQK

SEQ ID NO: 20511 - protein, 6 aa, synthetic construct
  REGION 1..6: note = Synthetic Construct
TKSDRK

SEQ ID NO: 20512 - protein, 6 aa, synthetic construct
  REGION 1..6: note = Synthetic Construct
TKSDSK

SEQ ID NO: 20513 - protein, 6 aa, synthetic construct
  REGION 1..6: note = Synthetic Construct
TKSDTK

SEQ ID NO: 20514 - protein, 6 aa, synthetic construct
  REGION 1..6: note = Synthetic Construct
TKSDYK

SEQ ID NO: 20515 - protein, 6 aa, synthetic construct
  REGION 1..6: note = Synthetic Construct
TKSEAK

SEQ ID NO: 20516 - protein, 6 aa, synthetic construct
  REGION 1..6: note = Synthetic Construct
TKSEDK

SEQ ID NO: 20517 - protein, 6 aa, synthetic construct
  REGION 1..6: note = Synthetic Construct
TKSEEK

SEQ ID NO: 20518 - protein, 6 aa, synthetic construct
  REGION 1..6: note = Synthetic Construct
TKSEFK

SEQ ID NO: 20519 - protein, 6 aa, synthetic construct
  REGION 1..6: note = Synthetic Construct
TKSEGK

SEQ ID NO: 20520 - protein, 6 aa, synthetic construct
  REGION 1..6: note = Synthetic Construct
TKSEHK

SEQ ID NO: 20521 - protein, 6 aa, synthetic construct
  REGION 1..6: note = Synthetic Construct
TKSEIK

SEQ ID NO: 20522 - protein, 6 aa, synthetic construct
  REGION 1..6: note = Synthetic Construct
TKSELK

SEQ ID NO: 20523 - protein, 6 aa, synthetic construct
  REGION 1..6: note = Synthetic Construct
TKSENK

SEQ ID NO: 20524 - protein, 6 aa, synthetic construct
  REGION 1..6: note = Synthetic Construct
TKSEQK

SEQ ID NO: 20525 - protein, 6 aa, synthetic construct
  REGION 1..6: note = Synthetic Construct
TKSERK

SEQ ID NO: 20526 - protein, 6 aa, synthetic construct
  REGION 1..6: note = Synthetic Construct
TKSESK

SEQ ID NO: 20527 - protein, 6 aa, synthetic construct
  REGION 1..6: note = Synthetic Construct
TKSETK

SEQ ID NO: 20528 - protein, 6 aa, synthetic construct
  REGION 1..6: note = Synthetic Construct
TKSEYK

SEQ ID NO: 20529 - protein, 6 aa, synthetic construct
  REGION 1..6: note = Synthetic Construct
TKSFAK

SEQ ID NO: 20530 - protein, 6 aa, synthetic construct
  REGION 1..6: note = Synthetic Construct
TKSFDK

SEQ ID NO: 20531 - protein, 6 aa, synthetic construct
  REGION 1..6: note = Synthetic Construct
TKSFEK

SEQ ID NO: 20532 - protein, 6 aa, synthetic construct
  REGION 1..6: note = Synthetic Construct
TKSFFK

SEQ ID NO: 20533 - protein, 6 aa, synthetic construct
  REGION 1..6: note = Synthetic Construct
TKSFGK

SEQ ID NO: 20534 - protein, 6 aa, synthetic construct
  REGION 1..6: note = Synthetic Construct
TKSFHK

SEQ ID NO: 20535 - protein, 6 aa, synthetic construct
  REGION 1..6: note = Synthetic Construct
TKSFIK

SEQ ID NO: 20536 - protein, 6 aa, synthetic construct
  REGION 1..6: note = Synthetic Construct
TKSFLK

SEQ ID NO: 20537 - protein, 6 aa, synthetic construct
  REGION 1..6: note = Synthetic Construct
TKSFNK

SEQ ID NO: 20538 - protein, 6 aa, synthetic construct
  REGION 1..6: note = Synthetic Construct
TKSFQK

SEQ ID NO: 20539 - protein, 6 aa, synthetic construct
  REGION 1..6: note = Synthetic Construct
TKSFRK

SEQ ID NO: 20540 - protein, 6 aa, synthetic construct
  REGION 1..6: note = Synthetic Construct
TKSFSK

SEQ ID NO: 20541 - protein, 6 aa, synthetic construct
  REGION 1..6: note = Synthetic Construct
TKSFTK

SEQ ID NO: 20542 - protein, 6 aa, synthetic construct
  REGION 1..6: note = Synthetic Construct
TKSFYK

SEQ ID NO: 20543 - protein, 6 aa, synthetic construct
  REGION 1..6: note = Synthetic Construct
TKSGAK

SEQ ID NO: 20544 - protein, 6 aa, synthetic construct
  REGION 1..6: note = Synthetic Construct
TKSGDK

SEQ ID NO: 20545 - protein, 6 aa, synthetic construct
  REGION 1..6: note = Synthetic Construct
TKSGEK

SEQ ID NO: 20546 - protein, 6 aa, synthetic construct
  REGION 1..6: note = Synthetic Construct
TKSGFK

SEQ ID NO: 20547 - protein, 6 aa, synthetic construct
  REGION 1..6: note = Synthetic Construct
TKSGGK

SEQ ID NO: 20548 - protein, 6 aa, synthetic construct
  REGION 1..6: note = Synthetic Construct
TKSGHK

SEQ ID NO: 20549 - protein, 6 aa, synthetic construct
  REGION 1..6: note = Synthetic Construct
TKSGIK

SEQ ID NO: 20550 - protein, 6 aa, synthetic construct
  REGION 1..6: note = Synthetic Construct
TKSGLK

SEQ ID NO: 20551 - protein, 6 aa, synthetic construct
  REGION 1..6: note = Synthetic Construct
TKSGNK

SEQ ID NO: 20552 - protein, 6 aa, synthetic construct
  REGION 1..6: note = Synthetic Construct
TKSGQK

SEQ ID NO: 20553 - protein, 6 aa, synthetic construct
  REGION 1..6: note = Synthetic Construct
TKSGRK

SEQ ID NO: 20554 - protein, 6 aa, synthetic construct
  REGION 1..6: note = Synthetic Construct
TKSGSK

SEQ ID NO: 20555 - protein, 6 aa, synthetic construct
  REGION 1..6: note = Synthetic Construct
TKSGTK

SEQ ID NO: 20556 - protein, 6 aa, synthetic construct
  REGION 1..6: note = Synthetic Construct
TKSGYK

SEQ ID NO: 20557 - protein, 6 aa, synthetic construct
  REGION 1..6: note = Synthetic Construct
TKSHAK

SEQ ID NO: 20558 - protein, 6 aa, synthetic construct
  REGION 1..6: note = Synthetic Construct
TKSHDK

SEQ ID NO: 20559 - protein, 6 aa, synthetic construct
  REGION 1..6: note = Synthetic Construct
TKSHEK

SEQ ID NO: 20560 - protein, 6 aa, synthetic construct
  REGION 1..6: note = Synthetic Construct
TKSHFK

SEQ ID NO: 20561 - protein, 6 aa, synthetic construct
  REGION 1..6: note = Synthetic Construct
TKSHGK

SEQ ID NO: 20562 - protein, 6 aa, synthetic construct
  REGION 1..6: note = Synthetic Construct
TKSHHK

SEQ ID NO: 20563 - protein, 6 aa, synthetic construct
  REGION 1..6: note = Synthetic Construct
TKSHIK

SEQ ID NO: 20564 - protein, 6 aa, synthetic construct
  REGION 1..6: note = Synthetic Construct
TKSHLK

SEQ ID NO: 20565 - protein, 6 aa, synthetic construct
  REGION 1..6: note = Synthetic Construct
TKSHNK

SEQ ID NO: 20566 - protein, 6 aa, synthetic construct
  REGION 1..6: note = Synthetic Construct
TKSHQK

SEQ ID NO: 20567 - protein, 6 aa, synthetic construct
  REGION 1..6: note = Synthetic Construct
TKSHRK

SEQ ID NO: 20568 - protein, 6 aa, synthetic construct
  REGION 1..6: note = Synthetic Construct
TKSHSK

SEQ ID NO: 20569 - protein, 6 aa, synthetic construct
  REGION 1..6: note = Synthetic Construct
TKSHTK

SEQ ID NO: 20570 - protein, 6 aa, synthetic construct
  REGION 1..6: note = Synthetic Construct
TKSHYK

SEQ ID NO: 20571 - protein, 6 aa, synthetic construct
  REGION 1..6: note = Synthetic Construct
TKSIAK

SEQ ID NO: 20572 - protein, 6 aa, synthetic construct
  REGION 1..6: note = Synthetic Construct
TKSIDK

SEQ ID NO: 20573 - protein, 6 aa, synthetic construct
  REGION 1..6: note = Synthetic Construct
TKSIEK

SEQ ID NO: 20574 - protein, 6 aa, synthetic construct
  REGION 1..6: note = Synthetic Construct
TKSIFK

SEQ ID NO: 20575 - protein, 6 aa, synthetic construct
  REGION 1..6: note = Synthetic Construct
TKSIGK

SEQ ID NO: 20576 - protein, 6 aa, synthetic construct
  REGION 1..6: note = Synthetic Construct
TKSIHK

SEQ ID NO: 20577 - protein, 6 aa, synthetic construct
  REGION 1..6: note = Synthetic Construct
TKSIIK

SEQ ID NO: 20578 - protein, 6 aa, synthetic construct
  REGION 1..6: note = Synthetic Construct
TKSILK

SEQ ID NO: 20579 - protein, 6 aa, synthetic construct
  REGION 1..6: note = Synthetic Construct
TKSINK

SEQ ID NO: 20580 - protein, 6 aa, synthetic construct
  REGION 1..6: note = Synthetic Construct
TKSIQK

SEQ ID NO: 20581 - protein, 6 aa, synthetic construct
  REGION 1..6: note = Synthetic Construct
TKSIRK

SEQ ID NO: 20582 - protein, 6 aa, synthetic construct
  REGION 1..6: note = Synthetic Construct
TKSISK

SEQ ID NO: 20583 - protein, 6 aa, synthetic construct
  REGION 1..6: note = Synthetic Construct
TKSITK

SEQ ID NO: 20584 - protein, 6 aa, synthetic construct
  REGION 1..6: note = Synthetic Construct
TKSIYK

SEQ ID NO: 20585 - protein, 6 aa, synthetic construct
  REGION 1..6: note = Synthetic Construct
TKSLAK

SEQ ID NO: 20586 - protein, 6 aa, synthetic construct
  REGION 1..6: note = Synthetic Construct
TKSLDK

SEQ ID NO: 20587 - protein, 6 aa, synthetic construct
  REGION 1..6: note = Synthetic Construct
TKSLEK

SEQ ID NO: 20588 - protein, 6 aa, synthetic construct
  REGION 1..6: note = Synthetic Construct
TKSLFK

SEQ ID NO: 20589 - protein, 6 aa, synthetic construct
  REGION 1..6: note = Synthetic Construct
TKSLGK

SEQ ID NO: 20590 - protein, 6 aa, synthetic construct
  REGION 1..6: note = Synthetic Construct
TKSLHK

SEQ ID NO: 20591 - protein, 6 aa, synthetic construct
  REGION 1..6: note = Synthetic Construct
TKSLIK

SEQ ID NO: 20592 - protein, 6 aa, synthetic construct
  REGION 1..6: note = Synthetic Construct
TKSLLK

SEQ ID NO: 20593 - protein, 6 aa, synthetic construct
  REGION 1..6: note = Synthetic Construct
TKSLNK

SEQ ID NO: 20594 - protein, 6 aa, synthetic construct
  REGION 1..6: note = Synthetic Construct
TKSLQK

SEQ ID NO: 20595 - protein, 6 aa, synthetic construct
  REGION 1..6: note = Synthetic Construct
TKSLRK

SEQ ID NO: 20596 - protein, 6 aa, synthetic construct
  REGION 1..6: note = Synthetic Construct
TKSLSK

SEQ ID NO: 20597 - protein, 6 aa, synthetic construct
  REGION 1..6: note = Synthetic Construct
TKSLTK

SEQ ID NO: 20598 - protein, 6 aa, synthetic construct
  REGION 1..6: note = Synthetic Construct
TKSLYK

SEQ ID NO: 20599 - protein, 6 aa, synthetic construct
  REGION 1..6: note = Synthetic Construct
TKSNAK

SEQ ID NO: 20600 - protein, 6 aa, synthetic construct
  REGION 1..6: note = Synthetic Construct
TKSNDK

SEQ ID NO: 20601 - protein, 6 aa, synthetic construct
  REGION 1..6: note = Synthetic Construct
TKSNEK

SEQ ID NO: 20602 - protein, 6 aa, synthetic construct
  REGION 1..6: note = Synthetic Construct
TKSNFK

SEQ ID NO: 20603 - protein, 6 aa, synthetic construct
  REGION 1..6: note = Synthetic Construct
TKSNGK

SEQ ID NO: 20604 - protein, 6 aa, synthetic construct
  REGION 1..6: note = Synthetic Construct
TKSNHK

SEQ ID NO: 20605 - protein, 6 aa, synthetic construct
  REGION 1..6: note = Synthetic Construct
TKSNIK

SEQ ID NO: 20606 - protein, 6 aa, synthetic construct
  REGION 1..6: note = Synthetic Construct
TKSNLK

SEQ ID NO: 20607 - protein, 6 aa, synthetic construct
  REGION 1..6: note = Synthetic Construct
TKSNNK

SEQ ID NO: 20608 - protein, 6 aa, synthetic construct
  REGION 1..6: note = Synthetic Construct
TKSNQK

SEQ ID NO: 20609 - protein, 6 aa, synthetic construct
  REGION 1..6: note = Synthetic Construct
TKSNRK

SEQ ID NO: 20610 - protein, 6 aa, synthetic construct
  REGION 1..6: note = Synthetic Construct
TKSNSK

SEQ ID NO: 20611 - protein, 6 aa, synthetic construct
  REGION 1..6: note = Synthetic Construct
TKSNTK

SEQ ID NO: 20612 - protein, 6 aa, synthetic construct
  REGION 1..6: note = Synthetic Construct
TKSNYK

SEQ ID NO: 20613 - protein, 6 aa, synthetic construct
  REGION 1..6: note = Synthetic Construct
TKSQAK

SEQ ID NO: 20614 - protein, 6 aa, synthetic construct
  REGION 1..6: note = Synthetic Construct
TKSQDK

SEQ ID NO: 20615 - protein, 6 aa, synthetic construct
  REGION 1..6: note = Synthetic Construct
TKSQEK

SEQ ID NO: 20616 - protein, 6 aa, synthetic construct
  REGION 1..6: note = Synthetic Construct
TKSQFK

SEQ ID NO: 20617 - protein, 6 aa, synthetic construct
  REGION 1..6: note = Synthetic Construct
TKSQGK

SEQ ID NO: 20618 - protein, 6 aa, synthetic construct
  REGION 1..6: note = Synthetic Construct
TKSQHK

SEQ ID NO: 20619 - protein, 6 aa, synthetic construct
  REGION 1..6: note = Synthetic Construct
TKSQIK

SEQ ID NO: 20620 - protein, 6 aa, synthetic construct
  REGION 1..6: note = Synthetic Construct
TKSQLK

SEQ ID NO: 20621 - protein, 6 aa, synthetic construct
  REGION 1..6: note = Synthetic Construct
TKSQNK

SEQ ID NO: 20622 - protein, 6 aa, synthetic construct
  REGION 1..6: note = Synthetic Construct
TKSQQK

SEQ ID NO: 20623 - protein, 6 aa, synthetic construct
  REGION 1..6: note = Synthetic Construct
TKSQRK

SEQ ID NO: 20624 - protein, 6 aa, synthetic construct
  REGION 1..6: note = Synthetic Construct
TKSQSK

SEQ ID NO: 20625 - protein, 6 aa, synthetic construct
  REGION 1..6: note = Synthetic Construct
TKSQTK

SEQ ID NO: 20626 - protein, 6 aa, synthetic construct
  REGION 1..6: note = Synthetic Construct
TKSQYK

SEQ ID NO: 20627 - protein, 6 aa, synthetic construct
  REGION 1..6: note = Synthetic Construct
TKSRAK

SEQ ID NO: 20628 - protein, 6 aa, synthetic construct
  REGION 1..6: note = Synthetic Construct
TKSRDK

SEQ ID NO: 20629 - protein, 6 aa, synthetic construct
  REGION 1..6: note = Synthetic Construct
TKSREK

SEQ ID NO: 20630 - protein, 6 aa, synthetic construct
  REGION 1..6: note = Synthetic Construct
TKSRFK

SEQ ID NO: 20631 - protein, 6 aa, synthetic construct
  REGION 1..6: note = Synthetic Construct
TKSRGK

SEQ ID NO: 20632 - protein, 6 aa, synthetic construct
  REGION 1..6: note = Synthetic Construct
TKSRHK

SEQ ID NO: 20633 - protein, 6 aa, synthetic construct
  REGION 1..6: note = Synthetic Construct
TKSRIK

SEQ ID NO: 20634 - protein, 6 aa, synthetic construct
  REGION 1..6: note = Synthetic Construct
TKSRLK

SEQ ID NO: 20635 - protein, 6 aa, synthetic construct
  REGION 1..6: note = Synthetic Construct
TKSRNK

SEQ ID NO: 20636 - protein, 6 aa, synthetic construct
  REGION 1..6: note = Synthetic Construct
TKSRQK

SEQ ID NO: 20637 - protein, 6 aa, synthetic construct
  REGION 1..6: note = Synthetic Construct
TKSRRK

SEQ ID NO: 20638 - protein, 6 aa, synthetic construct
  REGION 1..6: note = Synthetic Construct
TKSRSK

SEQ ID NO: 20639 - protein, 6 aa, synthetic construct
  REGION 1..6: note = Synthetic Construct
TKSRTK

SEQ ID NO: 20640 - protein, 6 aa, synthetic construct
  REGION 1..6: note = Synthetic Construct
TKSRYK

SEQ ID NO: 20641 - protein, 6 aa, synthetic construct
  REGION 1..6: note = Synthetic Construct
TKSSAK

SEQ ID NO: 20642 - protein, 6 aa, synthetic construct
  REGION 1..6: note = Synthetic Construct
TKSSDK

SEQ ID NO: 20643 - protein, 6 aa, synthetic construct
  REGION 1..6: note = Synthetic Construct
TKSSEK

SEQ ID NO: 20644 - protein, 6 aa, synthetic construct
  REGION 1..6: note = Synthetic Construct
TKSSFK

SEQ ID NO: 20645 - protein, 6 aa, synthetic construct
  REGION 1..6: note = Synthetic Construct
TKSSGK

SEQ ID NO: 20646 - protein, 6 aa, synthetic construct
  REGION 1..6: note = Synthetic Construct
TKSSHK

SEQ ID NO: 20647 - protein, 6 aa, synthetic construct
  REGION 1..6: note = Synthetic Construct
TKSSIK

SEQ ID NO: 20648 - protein, 6 aa, synthetic construct
  REGION 1..6: note = Synthetic Construct
TKSSLK

SEQ ID NO: 20649 - protein, 6 aa, synthetic construct
  REGION 1..6: note = Synthetic Construct
TKSSNK

SEQ ID NO: 20650 - protein, 6 aa, synthetic construct
  REGION 1..6: note = Synthetic Construct
TKSSQK

SEQ ID NO: 20651 - protein, 6 aa, synthetic construct
  REGION 1..6: note = Synthetic Construct
TKSSRK

SEQ ID NO: 20652 - protein, 6 aa, synthetic construct
  REGION 1..6: note = Synthetic Construct
TKSSSK

SEQ ID NO: 20653 - protein, 6 aa, synthetic construct
  REGION 1..6: note = Synthetic Construct
TKSSTK

SEQ ID NO: 20654 - protein, 6 aa, synthetic construct
  REGION 1..6: note = Synthetic Construct
TKSSYK

SEQ ID NO: 20655 - protein, 6 aa, synthetic construct
  REGION 1..6: note = Synthetic Construct
TKSTAK

SEQ ID NO: 20656 - protein, 6 aa, synthetic construct
  REGION 1..6: note = Synthetic Construct
TKSTDK

SEQ ID NO: 20657 - protein, 6 aa, synthetic construct
  REGION 1..6: note = Synthetic Construct
TKSTEK

SEQ ID NO: 20658 - protein, 6 aa, synthetic construct
  REGION 1..6: note = Synthetic Construct
TKSTFK

SEQ ID NO: 20659 - protein, 6 aa, synthetic construct
  REGION 1..6: note = Synthetic Construct
TKSTGK

SEQ ID NO: 20660 - protein, 6 aa, synthetic construct
  REGION 1..6: note = Synthetic Construct
TKSTHK

SEQ ID NO: 20661 - protein, 6 aa, synthetic construct
  REGION 1..6: note = Synthetic Construct
TKSTIK

SEQ ID NO: 20662 - protein, 6 aa, synthetic construct
  REGION 1..6: note = Synthetic Construct
TKSTLK

SEQ ID NO: 20663 - protein, 6 aa, synthetic construct
  REGION 1..6: note = Synthetic Construct
TKSTNK

SEQ ID NO: 20664 - protein, 6 aa, synthetic construct
  REGION 1..6: note = Synthetic Construct
TKSTQK

SEQ ID NO: 20665 - protein, 6 aa, synthetic construct
  REGION 1..6: note = Synthetic Construct
TKSTRK

SEQ ID NO: 20666 - protein, 6 aa, synthetic construct
  REGION 1..6: note = Synthetic Construct
TKSTSK

SEQ ID NO: 20667 - protein, 6 aa, synthetic construct
  REGION 1..6: note = Synthetic Construct
TKSTTK

SEQ ID NO: 20668 - protein, 6 aa, synthetic construct
  REGION 1..6: note = Synthetic Construct
TKSTYK

SEQ ID NO: 20669 - protein, 6 aa, synthetic construct
  REGION 1..6: note = Synthetic Construct
TKSYAK

SEQ ID NO: 20670 - protein, 6 aa, synthetic construct
  REGION 1..6: note = Synthetic Construct
TKSYDK

SEQ ID NO: 20671 - protein, 6 aa, synthetic construct
  REGION 1..6: note = Synthetic Construct
TKSYEK

SEQ ID NO: 20672 - protein, 6 aa, synthetic construct
  REGION 1..6: note = Synthetic Construct
TKSYFK

SEQ ID NO: 20673 - protein, 6 aa, synthetic construct
  REGION 1..6: note = Synthetic Construct
TKSYGK

SEQ ID NO: 20674 - protein, 6 aa, synthetic construct
  REGION 1..6: note = Synthetic Construct
TKSYHK

SEQ ID NO: 20675 - protein, 6 aa, synthetic construct
  REGION 1..6: note = Synthetic Construct
TKSYIK

SEQ ID NO: 20676 - protein, 6 aa, synthetic construct
  REGION 1..6: note = Synthetic Construct
TKSYLK

SEQ ID NO: 20677 - protein, 6 aa, synthetic construct
  REGION 1..6: note = Synthetic Construct
TKSYNK

SEQ ID NO: 20678 - protein, 6 aa, synthetic construct
  REGION 1..6: note = Synthetic Construct
TKSYQK

SEQ ID NO: 20679 - protein, 6 aa, synthetic construct
  REGION 1..6: note = Synthetic Construct
TKSYRK

SEQ ID NO: 20680 - protein, 6 aa, synthetic construct
  REGION 1..6: note = Synthetic Construct
TKSYSK

SEQ ID NO: 20681 - protein, 6 aa, synthetic construct
  REGION 1..6: note = Synthetic Construct
TKSYTK

SEQ ID NO: 20682 - protein, 6 aa, synthetic construct
  REGION 1..6: note = Synthetic Construct
TKSYYK

SEQ ID NO: 20683 - protein, 6 aa, synthetic construct
  REGION 1..6: note = Synthetic Construct
TKTAAK

SEQ ID NO: 20684 - protein, 6 aa, synthetic construct
  REGION 1..6: note = Synthetic Construct
TKTADK

SEQ ID NO: 20685 - protein, 6 aa, synthetic construct
  REGION 1..6: note = Synthetic Construct
TKTAEK

SEQ ID NO: 20686 - protein, 6 aa, synthetic construct
  REGION 1..6: note = Synthetic Construct
TKTAFK

SEQ ID NO: 20687 - protein, 6 aa, synthetic construct
  REGION 1..6: note = Synthetic Construct
TKTAGK

SEQ ID NO: 20688 - protein, 6 aa, synthetic construct
  REGION 1..6: note = Synthetic Construct
TKTAHK

SEQ ID NO: 20689 - protein, 6 aa, synthetic construct
  REGION 1..6: note = Synthetic Construct
TKTAIK

SEQ ID NO: 20690 - protein, 6 aa, synthetic construct
  REGION 1..6: note = Synthetic Construct
TKTALK

SEQ ID NO: 20691 - protein, 6 aa, synthetic construct
  REGION 1..6: note = Synthetic Construct
TKTANK

SEQ ID NO: 20692 - protein, 6 aa, synthetic construct
  REGION 1..6: note = Synthetic Construct
TKTAQK

SEQ ID NO: 20693 - protein, 6 aa, synthetic construct
  REGION 1..6: note = Synthetic Construct
TKTARK

SEQ ID NO: 20694 - protein, 6 aa, synthetic construct
  REGION 1..6: note = Synthetic Construct
TKTASK

SEQ ID NO: 20695 - protein, 6 aa, synthetic construct
  REGION 1..6: note = Synthetic Construct
TKTATK

SEQ ID NO: 20696 - protein, 6 aa, synthetic construct
  REGION 1..6: note = Synthetic Construct
TKTAYK

SEQ ID NO: 20697 - protein, 6 aa, synthetic construct
  REGION 1..6: note = Synthetic Construct
TKTDAK

SEQ ID NO: 20698 - protein, 6 aa, synthetic construct
  REGION 1..6: note = Synthetic Construct
TKTDDK

SEQ ID NO: 20699 - protein, 6 aa, synthetic construct
  REGION 1..6: note = Synthetic Construct
TKTDEK

SEQ ID NO: 20700 - protein, 6 aa, synthetic construct
  REGION 1..6: note = Synthetic Construct
TKTDFK

SEQ ID NO: 20701 - protein, 6 aa, synthetic construct
  REGION 1..6: note = Synthetic Construct
TKTDGK

SEQ ID NO: 20702 - protein, 6 aa, synthetic construct
  REGION 1..6: note = Synthetic Construct
TKTDHK

SEQ ID NO: 20703 - protein, 6 aa, synthetic construct
  REGION 1..6: note = Synthetic Construct
TKTDIK

SEQ ID NO: 20704 - protein, 6 aa, synthetic construct
  REGION 1..6: note = Synthetic Construct
TKTDLK

SEQ ID NO: 20705 - protein, 6 aa, synthetic construct
  REGION 1..6: note = Synthetic Construct
TKTDNK

SEQ ID NO: 20706 - protein, 6 aa, synthetic construct
  REGION 1..6: note = Synthetic Construct
TKTDQK

SEQ ID NO: 20707 - protein, 6 aa, synthetic construct
  REGION 1..6: note = Synthetic Construct
TKTDRK

SEQ ID NO: 20708 - protein, 6 aa, synthetic construct
  REGION 1..6: note = Synthetic Construct
TKTDSK

SEQ ID NO: 20709 - protein, 6 aa, synthetic construct
  REGION 1..6: note = Synthetic Construct
TKTDTK

SEQ ID NO: 20710 - protein, 6 aa, synthetic construct
  REGION 1..6: note = Synthetic Construct
TKTDYK

SEQ ID NO: 20711 - protein, 6 aa, synthetic construct
  REGION 1..6: note = Synthetic Construct
TKTEAK

SEQ ID NO: 20712 - protein, 6 aa, synthetic construct
  REGION 1..6: note = Synthetic Construct
TKTEDK

SEQ ID NO: 20713 - protein, 6 aa, synthetic construct
  REGION 1..6: note = Synthetic Construct
TKTEEK

SEQ ID NO: 20714 - protein, 6 aa, synthetic construct
  REGION 1..6: note = Synthetic Construct
TKTEFK

SEQ ID NO: 20715 - protein, 6 aa, synthetic construct
  REGION 1..6: note = Synthetic Construct
TKTEGK

SEQ ID NO: 20716 - protein, 6 aa, synthetic construct
  REGION 1..6: note = Synthetic Construct
TKTEHK

SEQ ID NO: 20717 - protein, 6 aa, synthetic construct
  REGION 1..6: note = Synthetic Construct
TKTEIK

SEQ ID NO: 20718 - protein, 6 aa, synthetic construct
  REGION 1..6: note = Synthetic Construct
TKTELK

SEQ ID NO: 20719 - protein, 6 aa, synthetic construct
  REGION 1..6: note = Synthetic Construct
TKTENK

SEQ ID NO: 20720 - protein, 6 aa, synthetic construct
  REGION 1..6: note = Synthetic Construct
TKTEQK

SEQ ID NO: 20721 - protein, 6 aa, synthetic construct
  REGION 1..6: note = Synthetic Construct
TKTERK

SEQ ID NO: 20722 - protein, 6 aa, synthetic construct
  REGION 1..6: note = Synthetic Construct
TKTESK

SEQ ID NO: 20723 - protein, 6 aa, synthetic construct
  REGION 1..6: note = Synthetic Construct
TKTETK

SEQ ID NO: 20724 - protein, 6 aa, synthetic construct
  REGION 1..6: note = Synthetic Construct
TKTEYK

SEQ ID NO: 20725 - protein, 6 aa, synthetic construct
  REGION 1..6: note = Synthetic Construct
TKTFAK

SEQ ID NO: 20726 - protein, 6 aa, synthetic construct
  REGION 1..6: note = Synthetic Construct
TKTFDK

SEQ ID NO: 20727 - protein, 6 aa, synthetic construct
  REGION 1..6: note = Synthetic Construct
TKTFEK

SEQ ID NO: 20728 - protein, 6 aa, synthetic construct
  REGION 1..6: note = Synthetic Construct
TKTFFK

SEQ ID NO: 20729 - protein, 6 aa, synthetic construct
  REGION 1..6: note = Synthetic Construct
TKTFGK

SEQ ID NO: 20730 - protein, 6 aa, synthetic construct
  REGION 1..6: note = Synthetic Construct
TKTFHK

SEQ ID NO: 20731 - protein, 6 aa, synthetic construct
  REGION 1..6: note = Synthetic Construct
TKTFIK

SEQ ID NO: 20732 - protein, 6 aa, synthetic construct
  REGION 1..6: note = Synthetic Construct
TKTFLK

SEQ ID NO: 20733 - protein, 6 aa, synthetic construct
  REGION 1..6: note = Synthetic Construct
TKTFNK

SEQ ID NO: 20734 - protein, 6 aa, synthetic construct
  REGION 1..6: note = Synthetic Construct
TKTFQK

SEQ ID NO: 20735 - protein, 6 aa, synthetic construct
  REGION 1..6: note = Synthetic Construct
TKTFRK

SEQ ID NO: 20736 - protein, 6 aa, synthetic construct
  REGION 1..6: note = Synthetic Construct
TKTFSK

SEQ ID NO: 20737 - protein, 6 aa, synthetic construct
  REGION 1..6: note = Synthetic Construct
TKTFTK

SEQ ID NO: 20738 - protein, 6 aa, synthetic construct
  REGION 1..6: note = Synthetic Construct
TKTFYK

SEQ ID NO: 20739 - protein, 6 aa, synthetic construct
  REGION 1..6: note = Synthetic Construct
TKTGAK

SEQ ID NO: 20740 - protein, 6 aa, synthetic construct
  REGION 1..6: note = Synthetic Construct
TKTGDK

SEQ ID NO: 20741 - protein, 6 aa, synthetic construct
  REGION 1..6: note = Synthetic Construct
TKTGEK

SEQ ID NO: 20742 - protein, 6 aa, synthetic construct
  REGION 1..6: note = Synthetic Construct
TKTGFK

SEQ ID NO: 20743 - protein, 6 aa, synthetic construct
  REGION 1..6: note = Synthetic Construct
TKTGGK

SEQ ID NO: 20744 - protein, 6 aa, synthetic construct
  REGION 1..6: note = Synthetic Construct
TKTGHK

SEQ ID NO: 20745 - protein, 6 aa, synthetic construct
  REGION 1..6: note = Synthetic Construct
TKTGIK

SEQ ID NO: 20746 - protein, 6 aa, synthetic construct
  REGION 1..6: note = Synthetic Construct
TKTGLK

SEQ ID NO: 20747 - protein, 6 aa, synthetic construct
  REGION 1..6: note = Synthetic Construct
TKTGNK

SEQ ID NO: 20748 - protein, 6 aa, synthetic construct
  REGION 1..6: note = Synthetic Construct
TKTGQK

SEQ ID NO: 20749 - protein, 6 aa, synthetic construct
  REGION 1..6: note = Synthetic Construct
TKTGRK

SEQ ID NO: 20750 - protein, 6 aa, synthetic construct
  REGION 1..6: note = Synthetic Construct
TKTGSK

SEQ ID NO: 20751 - protein, 6 aa, synthetic construct
  REGION 1..6: note = Synthetic Construct
TKTGTK

SEQ ID NO: 20752 - protein, 6 aa, synthetic construct
  REGION 1..6: note = Synthetic Construct
TKTGYK

SEQ ID NO: 20753 - protein, 6 aa, synthetic construct
  REGION 1..6: note = Synthetic Construct
TKTHAK

SEQ ID NO: 20754 - protein, 6 aa, synthetic construct
  REGION 1..6: note = Synthetic Construct
TKTHDK

SEQ ID NO: 20755 - protein, 6 aa, synthetic construct
  REGION 1..6: note = Synthetic Construct
TKTHEK

SEQ ID NO: 20756 - protein, 6 aa, synthetic construct
  REGION 1..6: note = Synthetic Construct
TKTHFK

SEQ ID NO: 20757 - protein, 6 aa, synthetic construct
  REGION 1..6: note = Synthetic Construct
TKTHGK

SEQ ID NO: 20758 - protein, 6 aa, synthetic construct
  REGION 1..6: note = Synthetic Construct
TKTHHK

SEQ ID NO: 20759 - protein, 6 aa, synthetic construct
  REGION 1..6: note = Synthetic Construct
TKTHIK

SEQ ID NO: 20760 - protein, 6 aa, synthetic construct
  REGION 1..6: note = Synthetic Construct
TKTHLK

SEQ ID NO: 20761 - protein, 6 aa, synthetic construct
  REGION 1..6: note = Synthetic Construct
TKTHNK

SEQ ID NO: 20762 - protein, 6 aa, synthetic construct
  REGION 1..6: note = Synthetic Construct
TKTHQK

SEQ ID NO: 20763 - protein, 6 aa, synthetic construct
  REGION 1..6: note = Synthetic Construct
TKTHRK

SEQ ID NO: 20764 - protein, 6 aa, synthetic construct
  REGION 1..6: note = Synthetic Construct
TKTHSK

SEQ ID NO: 20765 - protein, 6 aa, synthetic construct
  REGION 1..6: note = Synthetic Construct
TKTHTK

SEQ ID NO: 20766 - protein, 6 aa, synthetic construct
  REGION 1..6: note = Synthetic Construct
TKTHYK

SEQ ID NO: 20767 - protein, 6 aa, synthetic construct
  REGION 1..6: note = Synthetic Construct
TKTIAK

SEQ ID NO: 20768 - protein, 6 aa, synthetic construct
  REGION 1..6: note = Synthetic Construct
TKTIDK

SEQ ID NO: 20769 - protein, 6 aa, synthetic construct
  REGION 1..6: note = Synthetic Construct
TKTIEK

SEQ ID NO: 20770 - protein, 6 aa, synthetic construct
  REGION 1..6: note = Synthetic Construct
TKTIFK

SEQ ID NO: 20771 - protein, 6 aa, synthetic construct
  REGION 1..6: note = Synthetic Construct
TKTIGK

SEQ ID NO: 20772 - protein, 6 aa, synthetic construct
  REGION 1..6: note = Synthetic Construct
TKTIHK

SEQ ID NO: 20773 - protein, 6 aa, synthetic construct
  REGION 1..6: note = Synthetic Construct
TKTIIK

SEQ ID NO: 20774 - protein, 6 aa, synthetic construct
  REGION 1..6: note = Synthetic Construct
TKTILK

SEQ ID NO: 20775 - protein, 6 aa, synthetic construct
  REGION 1..6: note = Synthetic Construct
TKTINK

SEQ ID NO: 20776 - protein, 6 aa, synthetic construct
  REGION 1..6: note = Synthetic Construct
TKTIQK

SEQ ID NO: 20777 - protein, 6 aa, synthetic construct
  REGION 1..6: note = Synthetic Construct
TKTIRK

SEQ ID NO: 20778 - protein, 6 aa, synthetic construct
  REGION 1..6: note = Synthetic Construct
TKTISK

SEQ ID NO: 20779 - protein, 6 aa, synthetic construct
  REGION 1..6: note = Synthetic Construct
TKTITK

SEQ ID NO: 20780 - protein, 6 aa, synthetic construct
  REGION 1..6: note = Synthetic Construct
TKTIYK

SEQ ID NO: 20781 - protein, 6 aa, synthetic construct
  REGION 1..6: note = Synthetic Construct
TKTLAK

SEQ ID NO: 20782 - protein, 6 aa, synthetic construct
  REGION 1..6: note = Synthetic Construct
TKTLDK

SEQ ID NO: 20783 - protein, 6 aa, synthetic construct
  REGION 1..6: note = Synthetic Construct
TKTLEK

SEQ ID NO: 20784 - protein, 6 aa, synthetic construct
  REGION 1..6: note = Synthetic Construct
TKTLFK

SEQ ID NO: 20785 - protein, 6 aa, synthetic construct
  REGION 1..6: note = Synthetic Construct
TKTLGK

SEQ ID NO: 20786 - protein, 6 aa, synthetic construct
  REGION 1..6: note = Synthetic Construct
TKTLHK

SEQ ID NO: 20787 - protein, 6 aa, synthetic construct
  REGION 1..6: note = Synthetic Construct
TKTLIK

SEQ ID NO: 20788 - protein, 6 aa, synthetic construct
  REGION 1..6: note = Synthetic Construct
TKTLLK

SEQ ID NO: 20789 - protein, 6 aa, synthetic construct
  REGION 1..6: note = Synthetic Construct
TKTLNK

SEQ ID NO: 20790 - protein, 6 aa, synthetic construct
  REGION 1..6: note = Synthetic Construct
TKTLQK

SEQ ID NO: 20791 - protein, 6 aa, synthetic construct
  REGION 1..6: note = Synthetic Construct
TKTLRK

SEQ ID NO: 20792 - protein, 6 aa, synthetic construct
  REGION 1..6: note = Synthetic Construct
TKTLSK

SEQ ID NO: 20793 - protein, 6 aa, synthetic construct
  REGION 1..6: note = Synthetic Construct
TKTLTK

SEQ ID NO: 20794 - protein, 6 aa, synthetic construct
  REGION 1..6: note = Synthetic Construct
TKTLYK

SEQ ID NO: 20795 - protein, 6 aa, synthetic construct
  REGION 1..6: note = Synthetic Construct
TKTNAK

SEQ ID NO: 20796 - protein, 6 aa, synthetic construct
  REGION 1..6: note = Synthetic Construct
TKTNDK

SEQ ID NO: 20797 - protein, 6 aa, synthetic construct
  REGION 1..6: note = Synthetic Construct
TKTNEK

SEQ ID NO: 20798 - protein, 6 aa, synthetic construct
  REGION 1..6: note = Synthetic Construct
TKTNFK

SEQ ID NO: 20799 - protein, 6 aa, synthetic construct
  REGION 1..6: note = Synthetic Construct
TKTNGK

SEQ ID NO: 20800 - protein, 6 aa, synthetic construct
  REGION 1..6: note = Synthetic Construct
TKTNHK

SEQ ID NO: 20801 - protein, 6 aa, synthetic construct
  REGION 1..6: note = Synthetic Construct
TKTNIK

SEQ ID NO: 20802 - protein, 6 aa, synthetic construct
  REGION 1..6: note = Synthetic Construct
TKTNLK

SEQ ID NO: 20803 - protein, 6 aa, synthetic construct
  REGION 1..6: note = Synthetic Construct
TKTNNK

SEQ ID NO: 20804 - protein, 6 aa, synthetic construct
  REGION 1..6: note = Synthetic Construct
TKTNQK

SEQ ID NO: 20805 - protein, 6 aa, synthetic construct
  REGION 1..6: note = Synthetic Construct
TKTNRK

SEQ ID NO: 20806 - protein, 6 aa, synthetic construct
  REGION 1..6: note = Synthetic Construct
TKTNSK

SEQ ID NO: 20807 - protein, 6 aa, synthetic construct
  REGION 1..6: note = Synthetic Construct
TKTNTK

SEQ ID NO: 20808 - protein, 6 aa, synthetic construct
  REGION 1..6: note = Synthetic Construct
TKTNYK

SEQ ID NO: 20809 - protein, 6 aa, synthetic construct
  REGION 1..6: note = Synthetic Construct
TKTQAK

SEQ ID NO: 20810 - protein, 6 aa, synthetic construct
  REGION 1..6: note = Synthetic Construct
TKTQDK

SEQ ID NO: 20811 - protein, 6 aa, synthetic construct
  REGION 1..6: note = Synthetic Construct
TKTQEK

SEQ ID NO: 20812 - protein, 6 aa, synthetic construct
  REGION 1..6: note = Synthetic Construct
TKTQFK

SEQ ID NO: 20813 - protein, 6 aa, synthetic construct
  REGION 1..6: note = Synthetic Construct
TKTQGK

SEQ ID NO: 20814 - protein, 6 aa, synthetic construct
  REGION 1..6: note = Synthetic Construct
TKTQHK

SEQ ID NO: 20815 - protein, 6 aa, synthetic construct
  REGION 1..6: note = Synthetic Construct
TKTQIK

SEQ ID NO: 20816 - protein, 6 aa, synthetic construct
  REGION 1..6: note = Synthetic Construct
TKTQLK

SEQ ID NO: 20817 - protein, 6 aa, synthetic construct
  REGION 1..6: note = Synthetic Construct
TKTQNK

SEQ ID NO: 20818 - protein, 6 aa, synthetic construct
  REGION 1..6: note = Synthetic Construct
TKTQQK

SEQ ID NO: 20819 - protein, 6 aa, synthetic construct
  REGION 1..6: note = Synthetic Construct
TKTQRK

SEQ ID NO: 20820 - protein, 6 aa, synthetic construct
  REGION 1..6: note = Synthetic Construct
TKTQSK

SEQ ID NO: 20821 - protein, 6 aa, synthetic construct
  REGION 1..6: note = Synthetic Construct
TKTQTK

SEQ ID NO: 20822 - protein, 6 aa, synthetic construct
  REGION 1..6: note = Synthetic Construct
TKTQYK

SEQ ID NO: 20823 - protein, 6 aa, synthetic construct
  REGION 1..6: note = Synthetic Construct
TKTRAK

SEQ ID NO: 20824 - protein, 6 aa, synthetic construct
  REGION 1..6: note = Synthetic Construct
TKTRDK

SEQ ID NO: 20825 - protein, 6 aa, synthetic construct
  REGION 1..6: note = Synthetic Construct
TKTREK

SEQ ID NO: 20826 - protein, 6 aa, synthetic construct
  REGION 1..6: note = Synthetic Construct
TKTRFK

SEQ ID NO: 20827 - protein, 6 aa, synthetic construct
  REGION 1..6: note = Synthetic Construct
TKTRGK

SEQ ID NO: 20828 - protein, 6 aa, synthetic construct
  REGION 1..6: note = Synthetic Construct
TKTRHK

SEQ ID NO: 20829 - protein, 6 aa, synthetic construct
  REGION 1..6: note = Synthetic Construct
TKTRIK

SEQ ID NO: 20830 - protein, 6 aa, synthetic construct
  REGION 1..6: note = Synthetic Construct
TKTRLK

SEQ ID NO: 20831 - protein, 6 aa, synthetic construct
  REGION 1..6: note = Synthetic Construct
TKTRNK

SEQ ID NO: 20832 - protein, 6 aa, synthetic construct
  REGION 1..6: note = Synthetic Construct
TKTRQK

SEQ ID NO: 20833 - protein, 6 aa, synthetic construct
  REGION 1..6: note = Synthetic Construct
TKTRRK

SEQ ID NO: 20834 - protein, 6 aa, synthetic construct
  REGION 1..6: note = Synthetic Construct
TKTRSK

SEQ ID NO: 20835 - protein, 6 aa, synthetic construct
  REGION 1..6: note = Synthetic Construct
TKTRTK

SEQ ID NO: 20836 - protein, 6 aa, synthetic construct
  REGION 1..6: note = Synthetic Construct
TKTRYK

SEQ ID NO: 20837 - protein, 6 aa, synthetic construct
  REGION 1..6: note = Synthetic Construct
TKTSAK

SEQ ID NO: 20838 - protein, 6 aa, synthetic construct
  REGION 1..6: note = Synthetic Construct
TKTSDK

SEQ ID NO: 20839 - protein, 6 aa, synthetic construct
  REGION 1..6: note = Synthetic Construct
TKTSEK

SEQ ID NO: 20840 - protein, 6 aa, synthetic construct
  REGION 1..6: note = Synthetic Construct
TKTSFK

SEQ ID NO: 20841 - protein, 6 aa, synthetic construct
  REGION 1..6: note = Synthetic Construct
TKTSGK

SEQ ID NO: 20842 - protein, 6 aa, synthetic construct
  REGION 1..6: note = Synthetic Construct
TKTSHK

SEQ ID NO: 20843 - protein, 6 aa, synthetic construct
  REGION 1..6: note = Synthetic Construct
TKTSIK

SEQ ID NO: 20844 - protein, 6 aa, synthetic construct
  REGION 1..6: note = Synthetic Construct
TKTSLK

SEQ ID NO: 20845 - protein, 6 aa, synthetic construct
  REGION 1..6: note = Synthetic Construct
TKTSNK

SEQ ID NO: 20846 - protein, 6 aa, synthetic construct
  REGION 1..6: note = Synthetic Construct
TKTSQK

SEQ ID NO: 20847 - protein, 6 aa, synthetic construct
  REGION 1..6: note = Synthetic Construct
TKTSRK

SEQ ID NO: 20848 - protein, 6 aa, synthetic construct
  REGION 1..6: note = Synthetic Construct
TKTSSK

SEQ ID NO: 20849 - protein, 6 aa, synthetic construct
  REGION 1..6: note = Synthetic Construct
TKTSTK

SEQ ID NO: 20850 - protein, 6 aa, synthetic construct
  REGION 1..6: note = Synthetic Construct
TKTSYK

SEQ ID NO: 20851 - protein, 6 aa, synthetic construct
  REGION 1..6: note = Synthetic Construct
TKTTAK

SEQ ID NO: 20852 - protein, 6 aa, synthetic construct
  REGION 1..6: note = Synthetic Construct
TKTTDK

SEQ ID NO: 20853 - protein, 6 aa, synthetic construct
  REGION 1..6: note = Synthetic Construct
TKTTEK

SEQ ID NO: 20854 - protein, 6 aa, synthetic construct
  REGION 1..6: note = Synthetic Construct
TKTTFK

SEQ ID NO: 20855 - protein, 6 aa, synthetic construct
  REGION 1..6: note = Synthetic Construct
TKTTGK

SEQ ID NO: 20856 - protein, 6 aa, synthetic construct
  REGION 1..6: note = Synthetic Construct
TKTTHK

SEQ ID NO: 20857 - protein, 6 aa, synthetic construct
  REGION 1..6: note = Synthetic Construct
TKTTIK

SEQ ID NO: 20858 - protein, 6 aa, synthetic construct
  REGION 1..6: note = Synthetic Construct
TKTTLK

SEQ ID NO: 20859 - protein, 6 aa, synthetic construct
  REGION 1..6: note = Synthetic Construct
TKTTNK

SEQ ID NO: 20860 - protein, 6 aa, synthetic construct
  REGION 1..6: note = Synthetic Construct
TKTTQK

SEQ ID NO: 20861 - protein, 6 aa, synthetic construct
  REGION 1..6: note = Synthetic Construct
TKTTRK

SEQ ID NO: 20862 - protein, 6 aa, synthetic construct
  REGION 1..6: note = Synthetic Construct
TKTTSK

SEQ ID NO: 20863 - protein, 6 aa, synthetic construct
  REGION 1..6: note = Synthetic Construct
TKTTTK

SEQ ID NO: 20864 - protein, 6 aa, synthetic construct
  REGION 1..6: note = Synthetic Construct
TKTTYK

SEQ ID NO: 20865 - protein, 6 aa, synthetic construct
  REGION 1..6: note = Synthetic Construct
TKTYAK

SEQ ID NO: 20866 - protein, 6 aa, synthetic construct
  REGION 1..6: note = Synthetic Construct
TKTYDK

SEQ ID NO: 20867 - protein, 6 aa, synthetic construct
  REGION 1..6: note = Synthetic Construct
TKTYEK

SEQ ID NO: 20868 - protein, 6 aa, synthetic construct
  REGION 1..6: note = Synthetic Construct
TKTYFK

SEQ ID NO: 20869 - protein, 6 aa, synthetic construct
  REGION 1..6: note = Synthetic Construct
TKTYGK

SEQ ID NO: 20870 - protein, 6 aa, synthetic construct
  REGION 1..6: note = Synthetic Construct
TKTYHK

SEQ ID NO: 20871 - protein, 6 aa, synthetic construct
  REGION 1..6: note = Synthetic Construct
TKTYIK

SEQ ID NO: 20872 - protein, 6 aa, synthetic construct
  REGION 1..6: note = Synthetic Construct
TKTYLK

SEQ ID NO: 20873 - protein, 6 aa, synthetic construct
  REGION 1..6: note = Synthetic Construct
TKTYNK

SEQ ID NO: 20874 - protein, 6 aa, synthetic construct
  REGION 1..6: note = Synthetic Construct
TKTYQK

SEQ ID NO: 20875 - protein, 6 aa, synthetic construct
  REGION 1..6: note = Synthetic Construct
TKTYRK

SEQ ID NO: 20876 - protein, 6 aa, synthetic construct
  REGION 1..6: note = Synthetic Construct
TKTYSK

SEQ ID NO: 20877 - protein, 6 aa, synthetic construct
  REGION 1..6: note = Synthetic Construct
TKTYTK

SEQ ID NO: 20878 - protein, 6 aa, synthetic construct
  REGION 1..6: note = Synthetic Construct
TKTYYK

SEQ ID NO: 20879 - protein, 6 aa, synthetic construct
  REGION 1..6: note = Synthetic Construct
TKYAAK

SEQ ID NO: 20880 - protein, 6 aa, synthetic construct
  REGION 1..6: note = Synthetic Construct
TKYADK

SEQ ID NO: 20881 - protein, 6 aa, synthetic construct
  REGION 1..6: note = Synthetic Construct
TKYAEK

SEQ ID NO: 20882 - protein, 6 aa, synthetic construct
  REGION 1..6: note = Synthetic Construct
TKYAFK

SEQ ID NO: 20883 - protein, 6 aa, synthetic construct
  REGION 1..6: note = Synthetic Construct
TKYAGK

SEQ ID NO: 20884 - protein, 6 aa, synthetic construct
  REGION 1..6: note = Synthetic Construct
TKYAHK

SEQ ID NO: 20885 - protein, 6 aa, synthetic construct
  REGION 1..6: note = Synthetic Construct
TKYAIK

SEQ ID NO: 20886 - protein, 6 aa, synthetic construct
  REGION 1..6: note = Synthetic Construct
TKYALK

SEQ ID NO: 20887 - protein, 6 aa, synthetic construct
  REGION 1..6: note = Synthetic Construct
TKYANK

SEQ ID NO: 20888 - protein, 6 aa, synthetic construct
  REGION 1..6: note = Synthetic Construct
TKYAQK

SEQ ID NO: 20889 - protein, 6 aa, synthetic construct
  REGION 1..6: note = Synthetic Construct
TKYARK

SEQ ID NO: 20890 - protein, 6 aa, synthetic construct
  REGION 1..6: note = Synthetic Construct
TKYASK

SEQ ID NO: 20891 - protein, 6 aa, synthetic construct
  REGION 1..6: note = Synthetic Construct
TKYATK

SEQ ID NO: 20892 - protein, 6 aa, synthetic construct
  REGION 1..6: note = Synthetic Construct
TKYAYK

SEQ ID NO: 20893 - protein, 6 aa, synthetic construct
  REGION 1..6: note = Synthetic Construct
TKYDAK

SEQ ID NO: 20894 - protein, 6 aa, synthetic construct
  REGION 1..6: note = Synthetic Construct
TKYDDK

SEQ ID NO: 20895 - protein, 6 aa, synthetic construct
  REGION 1..6: note = Synthetic Construct
TKYDEK

SEQ ID NO: 20896 - protein, 6 aa, synthetic construct
  REGION 1..6: note = Synthetic Construct
TKYDFK

SEQ ID NO: 20897 - protein, 6 aa, synthetic construct
  REGION 1..6: note = Synthetic Construct
TKYDGK

SEQ ID NO: 20898 - protein, 6 aa, synthetic construct
  REGION 1..6: note = Synthetic Construct
TKYDHK

SEQ ID NO: 20899 - protein, 6 aa, synthetic construct
  REGION 1..6: note = Synthetic Construct
TKYDIK

SEQ ID NO: 20900 - protein, 6 aa, synthetic construct
  REGION 1..6: note = Synthetic Construct
TKYDLK

SEQ ID NO: 20901 - protein, 6 aa, synthetic construct
  REGION 1..6: note = Synthetic Construct
TKYDNK

SEQ ID NO: 20902 - protein, 6 aa, synthetic construct
  REGION 1..6: note = Synthetic Construct
TKYDQK

SEQ ID NO: 20903 - protein, 6 aa, synthetic construct
  REGION 1..6: note = Synthetic Construct
TKYDRK

SEQ ID NO: 20904 - protein, 6 aa, synthetic construct
  REGION 1..6: note = Synthetic Construct
TKYDSK

SEQ ID NO: 20905 - protein, 6 aa, synthetic construct
  REGION 1..6: note = Synthetic Construct
TKYDTK

SEQ ID NO: 20906 - protein, 6 aa, synthetic construct
  REGION 1..6: note = Synthetic Construct
TKYDYK

SEQ ID NO: 20907 - protein, 6 aa, synthetic construct
  REGION 1..6: note = Synthetic Construct
TKYEAK

SEQ ID NO: 20908 - protein, 6 aa, synthetic construct
  REGION 1..6: note = Synthetic Construct
TKYEDK

SEQ ID NO: 20909 - protein, 6 aa, synthetic construct
  REGION 1..6: note = Synthetic Construct
TKYEEK

SEQ ID NO: 20910 - protein, 6 aa, synthetic construct
  REGION 1..6: note = Synthetic Construct
TKYEFK

SEQ ID NO: 20911 - protein, 6 aa, synthetic construct
  REGION 1..6: note = Synthetic Construct
TKYEGK

SEQ ID NO: 20912 - protein, 6 aa, synthetic construct
  REGION 1..6: note = Synthetic Construct
TKYEHK

SEQ ID NO: 20913 - protein, 6 aa, synthetic construct
  REGION 1..6: note = Synthetic Construct
TKYEIK

SEQ ID NO: 20914 - protein, 6 aa, synthetic construct
  REGION 1..6: note = Synthetic Construct
TKYELK

SEQ ID NO: 20915 - protein, 6 aa, synthetic construct
  REGION 1..6: note = Synthetic Construct
TKYENK

SEQ ID NO: 20916 - protein, 6 aa, synthetic construct
  REGION 1..6: note = Synthetic Construct
TKYEQK

SEQ ID NO: 20917 - protein, 6 aa, synthetic construct
  REGION 1..6: note = Synthetic Construct
TKYERK

SEQ ID NO: 20918 - protein, 6 aa, synthetic construct
  REGION 1..6: note = Synthetic Construct
TKYESK

SEQ ID NO: 20919 - protein, 6 aa, synthetic construct
  REGION 1..6: note = Synthetic Construct
TKYETK

SEQ ID NO: 20920 - protein, 6 aa, synthetic construct
  REGION 1..6: note = Synthetic Construct
TKYEYK

SEQ ID NO: 20921 - protein, 6 aa, synthetic construct
  REGION 1..6: note = Synthetic Construct
TKYFAK

SEQ ID NO: 20922 - protein, 6 aa, synthetic construct
  REGION 1..6: note = Synthetic Construct
TKYFDK

SEQ ID NO: 20923 - protein, 6 aa, synthetic construct
  REGION 1..6: note = Synthetic Construct
TKYFEK

SEQ ID NO: 20924 - protein, 6 aa, synthetic construct
  REGION 1..6: note = Synthetic Construct
TKYFFK

SEQ ID NO: 20925 - protein, 6 aa, synthetic construct
  REGION 1..6: note = Synthetic Construct
TKYFGK

SEQ ID NO: 20926 - protein, 6 aa, synthetic construct
  REGION 1..6: note = Synthetic Construct
TKYFHK

SEQ ID NO: 20927 - protein, 6 aa, synthetic construct
  REGION 1..6: note = Synthetic Construct
TKYFIK

SEQ ID NO: 20928 - protein, 6 aa, synthetic construct
  REGION 1..6: note = Synthetic Construct
TKYFLK

SEQ ID NO: 20929 - protein, 6 aa, synthetic construct
  REGION 1..6: note = Synthetic Construct
TKYFNK

SEQ ID NO: 20930 - protein, 6 aa, synthetic construct
  REGION 1..6: note = Synthetic Construct
TKYFQK

SEQ ID NO: 20931 - protein, 6 aa, synthetic construct
  REGION 1..6: note = Synthetic Construct
TKYFRK

SEQ ID NO: 20932 - protein, 6 aa, synthetic construct
  REGION 1..6: note = Synthetic Construct
TKYFSK

SEQ ID NO: 20933 - protein, 6 aa, synthetic construct
  REGION 1..6: note = Synthetic Construct
TKYFTK

SEQ ID NO: 20934 - protein, 6 aa, synthetic construct
  REGION 1..6: note = Synthetic Construct
TKYFYK

SEQ ID NO: 20935 - protein, 6 aa, synthetic construct
  REGION 1..6: note = Synthetic Construct
TKYGAK

SEQ ID NO: 20936 - protein, 6 aa, synthetic construct
  REGION 1..6: note = Synthetic Construct
TKYGDK

SEQ ID NO: 20937 - protein, 6 aa, synthetic construct
  REGION 1..6: note = Synthetic Construct
TKYGEK

SEQ ID NO: 20938 - protein, 6 aa, synthetic construct
  REGION 1..6: note = Synthetic Construct
TKYGFK

SEQ ID NO: 20939 - protein, 6 aa, synthetic construct
  REGION 1..6: note = Synthetic Construct
TKYGGK

SEQ ID NO: 20940 - protein, 6 aa, synthetic construct
  REGION 1..6: note = Synthetic Construct
TKYGHK

SEQ ID NO: 20941 - protein, 6 aa, synthetic construct
  REGION 1..6: note = Synthetic Construct
TKYGIK

SEQ ID NO: 20942 - protein, 6 aa, synthetic construct
  REGION 1..6: note = Synthetic Construct
TKYGLK

SEQ ID NO: 20943 - protein, 6 aa, synthetic construct
  REGION 1..6: note = Synthetic Construct
TKYGNK

SEQ ID NO: 20944 - protein, 6 aa, synthetic construct
  REGION 1..6: note = Synthetic Construct
TKYGQK

SEQ ID NO: 20945 - protein, 6 aa, synthetic construct
  REGION 1..6: note = Synthetic Construct
TKYGRK

SEQ ID NO: 20946 - protein, 6 aa, synthetic construct
  REGION 1..6: note = Synthetic Construct
TKYGSK

SEQ ID NO: 20947 - protein, 6 aa, synthetic construct
  REGION 1..6: note = Synthetic Construct
TKYGTK

SEQ ID NO: 20948 - protein, 6 aa, synthetic construct
  REGION 1..6: note = Synthetic Construct
TKYGYK

SEQ ID NO: 20949 - protein, 6 aa, synthetic construct
  REGION 1..6: note = Synthetic Construct
TKYHAK

SEQ ID NO: 20950 - protein, 6 aa, synthetic construct
  REGION 1..6: note = Synthetic Construct
TKYHDK

SEQ ID NO: 20951 - protein, 6 aa, synthetic construct
  REGION 1..6: note = Synthetic Construct
TKYHEK

SEQ ID NO: 20952 - protein, 6 aa, synthetic construct
  REGION 1..6: note = Synthetic Construct
TKYHFK

SEQ ID NO: 20953 - protein, 6 aa, synthetic construct
  REGION 1..6: note = Synthetic Construct
TKYHGK

SEQ ID NO: 20954 - protein, 6 aa, synthetic construct
  REGION 1..6: note = Synthetic Construct
TKYHHK

SEQ ID NO: 20955 - protein, 6 aa, synthetic construct
  REGION 1..6: note = Synthetic Construct
TKYHIK

SEQ ID NO: 20956 - protein, 6 aa, synthetic construct
  REGION 1..6: note = Synthetic Construct
TKYHLK

SEQ ID NO: 20957 - protein, 6 aa, synthetic construct
  REGION 1..6: note = Synthetic Construct
TKYHNK

SEQ ID NO: 20958 - protein, 6 aa, synthetic construct
  REGION 1..6: note = Synthetic Construct
TKYHQK

SEQ ID NO: 20959 - protein, 6 aa, synthetic construct
  REGION 1..6: note = Synthetic Construct
TKYHRK

SEQ ID NO: 20960 - protein, 6 aa, synthetic construct
  REGION 1..6: note = Synthetic Construct
TKYHSK

SEQ ID NO: 20961 - protein, 6 aa, synthetic construct
  REGION 1..6: note = Synthetic Construct
TKYHTK

SEQ ID NO: 20962 - protein, 6 aa, synthetic construct
  REGION 1..6: note = Synthetic Construct
TKYHYK

SEQ ID NO: 20963 - protein, 6 aa, synthetic construct
  REGION 1..6: note = Synthetic Construct
TKYIAK

SEQ ID NO: 20964 - protein, 6 aa, synthetic construct
  REGION 1..6: note = Synthetic Construct
TKYIDK

SEQ ID NO: 20965 - protein, 6 aa, synthetic construct
  REGION 1..6: note = Synthetic Construct
TKYIEK

SEQ ID NO: 20966 - protein, 6 aa, synthetic construct
  REGION 1..6: note = Synthetic Construct
TKYIFK

SEQ ID NO: 20967 - protein, 6 aa, synthetic construct
  REGION 1..6: note = Synthetic Construct
TKYIGK

SEQ ID NO: 20968 - protein, 6 aa, synthetic construct
  REGION 1..6: note = Synthetic Construct
TKYIHK

SEQ ID NO: 20969 - protein, 6 aa, synthetic construct
  REGION 1..6: note = Synthetic Construct
TKYIIK

SEQ ID NO: 20970 - protein, 6 aa, synthetic construct
  REGION 1..6: note = Synthetic Construct
TKYILK

SEQ ID NO: 20971 - protein, 6 aa, synthetic construct
  REGION 1..6: note = Synthetic Construct
TKYINK

SEQ ID NO: 20972 - protein, 6 aa, synthetic construct
  REGION 1..6: note = Synthetic Construct
TKYIQK

SEQ ID NO: 20973 - protein, 6 aa, synthetic construct
  REGION 1..6: note = Synthetic Construct
TKYIRK

SEQ ID NO: 20974 - protein, 6 aa, synthetic construct
  REGION 1..6: note = Synthetic Construct
TKYISK

SEQ ID NO: 20975 - protein, 6 aa, synthetic construct
  REGION 1..6: note = Synthetic Construct
TKYITK

SEQ ID NO: 20976 - protein, 6 aa, synthetic construct
  REGION 1..6: note = Synthetic Construct
TKYIYK

SEQ ID NO: 20977 - protein, 6 aa, synthetic construct
  REGION 1..6: note = Synthetic Construct
TKYLAK

SEQ ID NO: 20978 - protein, 6 aa, synthetic construct
  REGION 1..6: note = Synthetic Construct
TKYLDK

SEQ ID NO: 20979 - protein, 6 aa, synthetic construct
  REGION 1..6: note = Synthetic Construct
TKYLEK

SEQ ID NO: 20980 - protein, 6 aa, synthetic construct
  REGION 1..6: note = Synthetic Construct
TKYLFK

SEQ ID NO: 20981 - protein, 6 aa, synthetic construct
  REGION 1..6: note = Synthetic Construct
TKYLGK

SEQ ID NO: 20982 - protein, 6 aa, synthetic construct
  REGION 1..6: note = Synthetic Construct
TKYLHK

SEQ ID NO: 20983 - protein, 6 aa, synthetic construct
  REGION 1..6: note = Synthetic Construct
TKYLIK

SEQ ID NO: 20984 - protein, 6 aa, synthetic construct
  REGION 1..6: note = Synthetic Construct
TKYLLK

SEQ ID NO: 20985 - protein, 6 aa, synthetic construct
  REGION 1..6: note = Synthetic Construct
TKYLNK

SEQ ID NO: 20986 - protein, 6 aa, synthetic construct
  REGION 1..6: note = Synthetic Construct
TKYLQK

SEQ ID NO: 20987 - protein, 6 aa, synthetic construct
  REGION 1..6: note = Synthetic Construct
TKYLRK

SEQ ID NO: 20988 - protein, 6 aa, synthetic construct
  REGION 1..6: note = Synthetic Construct
TKYLSK

SEQ ID NO: 20989 - protein, 6 aa, synthetic construct
  REGION 1..6: note = Synthetic Construct
TKYLTK

SEQ ID NO: 20990 - protein, 6 aa, synthetic construct
  REGION 1..6: note = Synthetic Construct
TKYLYK

SEQ ID NO: 20991 - protein, 6 aa, synthetic construct
  REGION 1..6: note = Synthetic Construct
TKYNAK

SEQ ID NO: 20992 - protein, 6 aa, synthetic construct
  REGION 1..6: note = Synthetic Construct
TKYNDK

SEQ ID NO: 20993 - protein, 6 aa, synthetic construct
  REGION 1..6: note = Synthetic Construct
TKYNEK

SEQ ID NO: 20994 - protein, 6 aa, synthetic construct
  REGION 1..6: note = Synthetic Construct
TKYNFK

SEQ ID NO: 20995 - protein, 6 aa, synthetic construct
  REGION 1..6: note = Synthetic Construct
TKYNGK

SEQ ID NO: 20996 - protein, 6 aa, synthetic construct
  REGION 1..6: note = Synthetic Construct
TKYNHK

SEQ ID NO: 20997 - protein, 6 aa, synthetic construct
  REGION 1..6: note = Synthetic Construct
TKYNIK

SEQ ID NO: 20998 - protein, 6 aa, synthetic construct
  REGION 1..6: note = Synthetic Construct
TKYNLK

SEQ ID NO: 20999 - protein, 6 aa, synthetic construct
  REGION 1..6: note = Synthetic Construct
TKYNNK

SEQ ID NO: 21000 - protein, 6 aa, synthetic construct
  REGION 1..6: note = Synthetic Construct
TKYNQK

SEQ ID NO: 21001 - protein, 6 aa, synthetic construct
  REGION 1..6: note = Synthetic Construct
TKYNRK

SEQ ID NO: 21002 - protein, 6 aa, synthetic construct
  REGION 1..6: note = Synthetic Construct
TKYNSK

SEQ ID NO: 21003 - protein, 6 aa, synthetic construct
  REGION 1..6: note = Synthetic Construct
TKYNTK

SEQ ID NO: 21004 - protein, 6 aa, synthetic construct
  REGION 1..6: note = Synthetic Construct
TKYNYK

SEQ ID NO: 21005 - protein, 6 aa, synthetic construct
  REGION 1..6: note = Synthetic Construct
TKYQAK

SEQ ID NO: 21006 - protein, 6 aa, synthetic construct
  REGION 1..6: note = Synthetic Construct
TKYQDK

SEQ ID NO: 21007 - protein, 6 aa, synthetic construct
  REGION 1..6: note = Synthetic Construct
TKYQEK

SEQ ID NO: 21008 - protein, 6 aa, synthetic construct
  REGION 1..6: note = Synthetic Construct
TKYQFK

SEQ ID NO: 21009 - protein, 6 aa, synthetic construct
  REGION 1..6: note = Synthetic Construct
TKYQGK

SEQ ID NO: 21010 - protein, 6 aa, synthetic construct
  REGION 1..6: note = Synthetic Construct
TKYQHK

SEQ ID NO: 21011 - protein, 6 aa, synthetic construct
  REGION 1..6: note = Synthetic Construct
TKYQIK

SEQ ID NO: 21012 - protein, 6 aa, synthetic construct
  REGION 1..6: note = Synthetic Construct
TKYQLK

SEQ ID NO: 21013 - protein, 6 aa, synthetic construct
  REGION 1..6: note = Synthetic Construct
TKYQNK

SEQ ID NO: 21014 - protein, 6 aa, synthetic construct
  REGION 1..6: note = Synthetic Construct
TKYQQK

SEQ ID NO: 21015 - protein, 6 aa, synthetic construct
  REGION 1..6: note = Synthetic Construct
TKYQRK

SEQ ID NO: 21016 - protein, 6 aa, synthetic construct
  REGION 1..6: note = Synthetic Construct
TKYQSK

SEQ ID NO: 21017 - protein, 6 aa, synthetic construct
  REGION 1..6: note = Synthetic Construct
TKYQTK

SEQ ID NO: 21018 - protein, 6 aa, synthetic construct
  REGION 1..6: note = Synthetic Construct
TKYQYK

SEQ ID NO: 21019 - protein, 6 aa, synthetic construct
  REGION 1..6: note = Synthetic Construct
TKYRAK

SEQ ID NO: 21020 - protein, 6 aa, synthetic construct
  REGION 1..6: note = Synthetic Construct
TKYRDK

SEQ ID NO: 21021 - protein, 6 aa, synthetic construct
  REGION 1..6: note = Synthetic Construct
TKYREK

SEQ ID NO: 21022 - protein, 6 aa, synthetic construct
  REGION 1..6: note = Synthetic Construct
TKYRFK

SEQ ID NO: 21023 - protein, 6 aa, synthetic construct
  REGION 1..6: note = Synthetic Construct
TKYRGK

SEQ ID NO: 21024 - protein, 6 aa, synthetic construct
  REGION 1..6: note = Synthetic Construct
TKYRHK

SEQ ID NO: 21025 - protein, 6 aa, synthetic construct
  REGION 1..6: note = Synthetic Construct
TKYRIK

SEQ ID NO: 21026 - protein, 6 aa, synthetic construct
  REGION 1..6: note = Synthetic Construct
TKYRLK

SEQ ID NO: 21027 - protein, 6 aa, synthetic construct
  REGION 1..6: note = Synthetic Construct
TKYRNK

SEQ ID NO: 21028 - protein, 6 aa, synthetic construct
  REGION 1..6: note = Synthetic Construct
TKYRQK

SEQ ID NO: 21029 - protein, 6 aa, synthetic construct
  REGION 1..6: note = Synthetic Construct
TKYRRK

SEQ ID NO: 21030 - protein, 6 aa, synthetic construct
  REGION 1..6: note = Synthetic Construct
TKYRSK

SEQ ID NO: 21031 - protein, 6 aa, synthetic construct
  REGION 1..6: note = Synthetic Construct
TKYRTK

SEQ ID NO: 21032 - protein, 6 aa, synthetic construct
  REGION 1..6: note = Synthetic Construct
TKYRYK

SEQ ID NO: 21033 - protein, 6 aa, synthetic construct
  REGION 1..6: note = Synthetic Construct
TKYSAK

SEQ ID NO: 21034 - protein, 6 aa, synthetic construct
  REGION 1..6: note = Synthetic Construct
TKYSDK

SEQ ID NO: 21035 - protein, 6 aa, synthetic construct
  REGION 1..6: note = Synthetic Construct
TKYSEK

SEQ ID NO: 21036 - protein, 6 aa, synthetic construct
  REGION 1..6: note = Synthetic Construct
TKYSFK

SEQ ID NO: 21037 - protein, 6 aa, synthetic construct
  REGION 1..6: note = Synthetic Construct
TKYSGK

SEQ ID NO: 21038 - protein, 6 aa, synthetic construct
  REGION 1..6: note = Synthetic Construct
TKYSHK

SEQ ID NO: 21039 - protein, 6 aa, synthetic construct
  REGION 1..6: note = Synthetic Construct
TKYSIK

SEQ ID NO: 21040 - protein, 6 aa, synthetic construct
  REGION 1..6: note = Synthetic Construct
TKYSLK

SEQ ID NO: 21041 - protein, 6 aa, synthetic construct
  REGION 1..6: note = Synthetic Construct
TKYSNK

SEQ ID NO: 21042 - protein, 6 aa, synthetic construct
  REGION 1..6: note = Synthetic Construct
TKYSQK

SEQ ID NO: 21043 - protein, 6 aa, synthetic construct
  REGION 1..6: note = Synthetic Construct
TKYSRK

SEQ ID NO: 21044 - protein, 6 aa, synthetic construct
  REGION 1..6: note = Synthetic Construct
TKYSSK

SEQ ID NO: 21045 - protein, 6 aa, synthetic construct
  REGION 1..6: note = Synthetic Construct
TKYSTK

SEQ ID NO: 21046 - protein, 6 aa, synthetic construct
  REGION 1..6: note = Synthetic Construct
TKYSYK

SEQ ID NO: 21047 - protein, 6 aa, synthetic construct
  REGION 1..6: note = Synthetic Construct
TKYTAK

SEQ ID NO: 21048 - protein, 6 aa, synthetic construct
  REGION 1..6: note = Synthetic Construct
TKYTDK

SEQ ID NO: 21049 - protein, 6 aa, synthetic construct
  REGION 1..6: note = Synthetic Construct
TKYTEK

SEQ ID NO: 21050 - protein, 6 aa, synthetic construct
  REGION 1..6: note = Synthetic Construct
TKYTFK

SEQ ID NO: 21051 - protein, 6 aa, synthetic construct
  REGION 1..6: note = Synthetic Construct
TKYTGK

SEQ ID NO: 21052 - protein, 6 aa, synthetic construct
  REGION 1..6: note = Synthetic Construct
TKYTHK

SEQ ID NO: 21053 - protein, 6 aa, synthetic construct
  REGION 1..6: note = Synthetic Construct
TKYTIK

SEQ ID NO: 21054 - protein, 6 aa, synthetic construct
  REGION 1..6: note = Synthetic Construct
TKYTLK

SEQ ID NO: 21055 - protein, 6 aa, synthetic construct
  REGION 1..6: note = Synthetic Construct
TKYTNK

SEQ ID NO: 21056 - protein, 6 aa, synthetic construct
  REGION 1..6: note = Synthetic Construct
TKYTQK

SEQ ID NO: 21057 - protein, 6 aa, synthetic construct
  REGION 1..6: note = Synthetic Construct
TKYTRK

SEQ ID NO: 21058 - protein, 6 aa, synthetic construct
  REGION 1..6: note = Synthetic Construct
TKYTSK

SEQ ID NO: 21059 - protein, 6 aa, synthetic construct
  REGION 1..6: note = Synthetic Construct
TKYTTK

SEQ ID NO: 21060 - protein, 6 aa, synthetic construct
  REGION 1..6: note = Synthetic Construct
TKYTYK

SEQ ID NO: 21061 - protein, 6 aa, synthetic construct
  REGION 1..6: note = Synthetic Construct
TKYYAK

SEQ ID NO: 21062 - protein, 6 aa, synthetic construct
  REGION 1..6: note = Synthetic Construct
TKYYDK

SEQ ID NO: 21063 - protein, 6 aa, synthetic construct
  REGION 1..6: note = Synthetic Construct
TKYYEK

SEQ ID NO: 21064 - protein, 6 aa, synthetic construct
  REGION 1..6: note = Synthetic Construct
TKYYFK

SEQ ID NO: 21065 - protein, 6 aa, synthetic construct
  REGION 1..6: note = Synthetic Construct
TKYYGK

SEQ ID NO: 21066 - protein, 6 aa, synthetic construct
  REGION 1..6: note = Synthetic Construct
TKYYHK

SEQ ID NO: 21067 - protein, 6 aa, synthetic construct
  REGION 1..6: note = Synthetic Construct
TKYYIK

SEQ ID NO: 21068 - protein, 6 aa, synthetic construct
  REGION 1..6: note = Synthetic Construct
TKYYLK

SEQ ID NO: 21069 - protein, 6 aa, synthetic construct
  REGION 1..6: note = Synthetic Construct
TKYYNK

SEQ ID NO: 21070 - protein, 6 aa, synthetic construct
  REGION 1..6: note = Synthetic Construct
TKYYQK

SEQ ID NO: 21071 - protein, 6 aa, synthetic construct
  REGION 1..6: note = Synthetic Construct
TKYYRK

SEQ ID NO: 21072 - protein, 6 aa, synthetic construct
  REGION 1..6: note = Synthetic Construct
TKYYSK

SEQ ID NO: 21073 - protein, 6 aa, synthetic construct
  REGION 1..6: note = Synthetic Construct
TKYYTK

SEQ ID NO: 21074 - protein, 6 aa, synthetic construct
  REGION 1..6: note = Synthetic Construct
TKYYYK

SEQ ID NO: 21075 - protein, 6 aa, synthetic construct
  REGION 1..6: note = Synthetic Construct
KKAAAK

SEQ ID NO: 21076 - protein, 6 aa, synthetic construct
  REGION 1..6: note = Synthetic Construct
KKAADK

SEQ ID NO: 21077 - protein, 6 aa, synthetic construct
  REGION 1..6: note = Synthetic Construct
KKAAEK

SEQ ID NO: 21078 - protein, 6 aa, synthetic construct
  REGION 1..6: note = Synthetic Construct
KKAAFK

SEQ ID NO: 21079 - protein, 6 aa, synthetic construct
  REGION 1..6: note = Synthetic Construct
KKAAGK

SEQ ID NO: 21080 - protein, 6 aa, synthetic construct
  REGION 1..6: note = Synthetic Construct
KKAAHK

SEQ ID NO: 21081 - protein, 6 aa, synthetic construct
  REGION 1..6: note = Synthetic Construct
KKAAIK

SEQ ID NO: 21082 - protein, 6 aa, synthetic construct
  REGION 1..6: note = Synthetic Construct
KKAALK

SEQ ID NO: 21083 - protein, 6 aa, synthetic construct
  REGION 1..6: note = Synthetic Construct
KKAANK

SEQ ID NO: 21084 - protein, 6 aa, synthetic construct
  REGION 1..6: note = Synthetic Construct
KKAAQK

SEQ ID NO: 21085 - protein, 6 aa, synthetic construct
  REGION 1..6: note = Synthetic Construct
KKAARK

SEQ ID NO: 21086 - protein, 6 aa, synthetic construct
  REGION 1..6: note = Synthetic Construct
KKAASK

SEQ ID NO: 21087 - protein, 6 aa, synthetic construct
  REGION 1..6: note = Synthetic Construct
KKAATK

SEQ ID NO: 21088 - protein, 6 aa, synthetic construct
  REGION 1..6: note = Synthetic Construct
KKAAYK

SEQ ID NO: 21089 - protein, 6 aa, synthetic construct
  REGION 1..6: note = Synthetic Construct
KKADAK

SEQ ID NO: 21090 - protein, 6 aa, synthetic construct
  REGION 1..6: note = Synthetic Construct
KKADDK

SEQ ID NO: 21091 - protein, 6 aa, synthetic construct
  REGION 1..6: note = Synthetic Construct
KKADEK

SEQ ID NO: 21092 - protein, 6 aa, synthetic construct
  REGION 1..6: note = Synthetic Construct
KKADFK

SEQ ID NO: 21093 - protein, 6 aa, synthetic construct
  REGION 1..6: note = Synthetic Construct
KKADGK

SEQ ID NO: 21094 - protein, 6 aa, synthetic construct
  REGION 1..6: note = Synthetic Construct
KKADHK

SEQ ID NO: 21095 - protein, 6 aa, synthetic construct
  REGION 1..6: note = Synthetic Construct
KKADIK

SEQ ID NO: 21096 - protein, 6 aa, synthetic construct
  REGION 1..6: note = Synthetic Construct
KKADLK

SEQ ID NO: 21097 - protein, 6 aa, synthetic construct
  REGION 1..6: note = Synthetic Construct
KKADNK

SEQ ID NO: 21098 - protein, 6 aa, synthetic construct
  REGION 1..6: note = Synthetic Construct
KKADQK

SEQ ID NO: 21099 - protein, 6 aa, synthetic construct
  REGION 1..6: note = Synthetic Construct
KKADRK

SEQ ID NO: 21100 - protein, 6 aa, synthetic construct
  REGION 1..6: note = Synthetic Construct
KKADSK

SEQ ID NO: 21101 - protein, 6 aa, synthetic construct
  REGION 1..6: note = Synthetic Construct
KKADTK

SEQ ID NO: 21102 - protein, 6 aa, synthetic construct
  REGION 1..6: note = Synthetic Construct
KKADYK

SEQ ID NO: 21103 - protein, 6 aa, synthetic construct
  REGION 1..6: note = Synthetic Construct
KKAEAK

SEQ ID NO: 21104 - protein, 6 aa, synthetic construct
  REGION 1..6: note = Synthetic Construct
KKAEDK

SEQ ID NO: 21105 - protein, 6 aa, synthetic construct
  REGION 1..6: note = Synthetic Construct
KKAEEK

SEQ ID NO: 21106 - protein, 6 aa, synthetic construct
  REGION 1..6: note = Synthetic Construct
KKAEFK

SEQ ID NO: 21107 - protein, 6 aa, synthetic construct
  REGION 1..6: note = Synthetic Construct
KKAEGK

SEQ ID NO: 21108 - protein, 6 aa, synthetic construct
  REGION 1..6: note = Synthetic Construct
KKAEHK

SEQ ID NO: 21109 - protein, 6 aa, synthetic construct
  REGION 1..6: note = Synthetic Construct
KKAEIK

SEQ ID NO: 21110 - protein, 6 aa, synthetic construct
  REGION 1..6: note = Synthetic Construct
KKAELK

SEQ ID NO: 21111 - protein, 6 aa, synthetic construct
  REGION 1..6: note = Synthetic Construct
KKAENK

SEQ ID NO: 21112 - protein, 6 aa, synthetic construct
  REGION 1..6: note = Synthetic Construct
KKAEQK

SEQ ID NO: 21113 - protein, 6 aa, synthetic construct
  REGION 1..6: note = Synthetic Construct
KKAERK

SEQ ID NO: 21114 - protein, 6 aa, synthetic construct
  REGION 1..6: note = Synthetic Construct
KKAESK

SEQ ID NO: 21115 - protein, 6 aa, synthetic construct
  REGION 1..6: note = Synthetic Construct
KKAETK

SEQ ID NO: 21116 - protein, 6 aa, synthetic construct
  REGION 1..6: note = Synthetic Construct
KKAEYK

SEQ ID NO: 21117 - protein, 6 aa, synthetic construct
  REGION 1..6: note = Synthetic Construct
KKAFAK

SEQ ID NO: 21118 - protein, 6 aa, synthetic construct
  REGION 1..6: note = Synthetic Construct
KKAFDK

SEQ ID NO: 21119 - protein, 6 aa, synthetic construct
  REGION 1..6: note = Synthetic Construct
KKAFEK

SEQ ID NO: 21120 - protein, 6 aa, synthetic construct
  REGION 1..6: note = Synthetic Construct
KKAFFK

SEQ ID NO: 21121 - protein, 6 aa, synthetic construct
  REGION 1..6: note = Synthetic Construct
KKAFGK

SEQ ID NO: 21122 - protein, 6 aa, synthetic construct
  REGION 1..6: note = Synthetic Construct
KKAFHK

SEQ ID NO: 21123 - protein, 6 aa, synthetic construct
  REGION 1..6: note = Synthetic Construct
KKAFIK

SEQ ID NO: 21124 - protein, 6 aa, synthetic construct
  REGION 1..6: note = Synthetic Construct
KKAFLK

SEQ ID NO: 21125 - protein, 6 aa, synthetic construct
  REGION 1..6: note = Synthetic Construct
KKAFNK

SEQ ID NO: 21126 - protein, 6 aa, synthetic construct
  REGION 1..6: note = Synthetic Construct
KKAFQK

SEQ ID NO: 21127 - protein, 6 aa, synthetic construct
  REGION 1..6: note = Synthetic Construct
KKAFRK

SEQ ID NO: 21128 - protein, 6 aa, synthetic construct
  REGION 1..6: note = Synthetic Construct
KKAFSK

SEQ ID NO: 21129 - protein, 6 aa, synthetic construct
  REGION 1..6: note = Synthetic Construct
KKAFTK

SEQ ID NO: 21130 - protein, 6 aa, synthetic construct
  REGION 1..6: note = Synthetic Construct
KKAFYK

SEQ ID NO: 21131 - protein, 6 aa, synthetic construct
  REGION 1..6: note = Synthetic Construct
KKAGAK

SEQ ID NO: 21132 - protein, 6 aa, synthetic construct
  REGION 1..6: note = Synthetic Construct
KKAGDK

SEQ ID NO: 21133 - protein, 6 aa, synthetic construct
  REGION 1..6: note = Synthetic Construct
KKAGEK

SEQ ID NO: 21134 - protein, 6 aa, synthetic construct
  REGION 1..6: note = Synthetic Construct
KKAGFK

SEQ ID NO: 21135 - protein, 6 aa, synthetic construct
  REGION 1..6: note = Synthetic Construct
KKAGGK

SEQ ID NO: 21136 - protein, 6 aa, synthetic construct
  REGION 1..6: note = Synthetic Construct
KKAGHK

SEQ ID NO: 21137 - protein, 6 aa, synthetic construct
  REGION 1..6: note = Synthetic Construct
KKAGIK

SEQ ID NO: 21138 - protein, 6 aa, synthetic construct
  REGION 1..6: note = Synthetic Construct
KKAGLK

SEQ ID NO: 21139 - protein, 6 aa, synthetic construct
  REGION 1..6: note = Synthetic Construct
KKAGNK

SEQ ID NO: 21140 - protein, 6 aa, synthetic construct
  REGION 1..6: note = Synthetic Construct
KKAGQK

SEQ ID NO: 21141 - protein, 6 aa, synthetic construct
  REGION 1..6: note = Synthetic Construct
KKAGRK

SEQ ID NO: 21142 - protein, 6 aa, synthetic construct
  REGION 1..6: note = Synthetic Construct
KKAGSK

SEQ ID NO: 21143 - protein, 6 aa, synthetic construct
  REGION 1..6: note = Synthetic Construct
KKAGTK

SEQ ID NO: 21144 - protein, 6 aa, synthetic construct
  REGION 1..6: note = Synthetic Construct
KKAGYK

SEQ ID NO: 21145 - protein, 6 aa, synthetic construct
  REGION 1..6: note = Synthetic Construct
KKAHAK

SEQ ID NO: 21146 - protein, 6 aa, synthetic construct
  REGION 1..6: note = Synthetic Construct
KKAHDK

SEQ ID NO: 21147 - protein, 6 aa, synthetic construct
  REGION 1..6: note = Synthetic Construct
KKAHEK

SEQ ID NO: 21148 - protein, 6 aa, synthetic construct
  REGION 1..6: note = Synthetic Construct
KKAHFK

SEQ ID NO: 21149 - protein, 6 aa, synthetic construct
  REGION 1..6: note = Synthetic Construct
KKAHGK

SEQ ID NO: 21150 - protein, 6 aa, synthetic construct
  REGION 1..6: note = Synthetic Construct
KKAHHK

SEQ ID NO: 21151 - protein, 6 aa, synthetic construct
  REGION 1..6: note = Synthetic Construct
KKAHIK

SEQ ID NO: 21152 - protein, 6 aa, synthetic construct
  REGION 1..6: note = Synthetic Construct
KKAHLK

SEQ ID NO: 21153 - protein, 6 aa, synthetic construct
  REGION 1..6: note = Synthetic Construct
KKAHNK

SEQ ID NO: 21154 - protein, 6 aa, synthetic construct
  REGION 1..6: note = Synthetic Construct
KKAHQK

SEQ ID NO: 21155 - protein, 6 aa, synthetic construct
  REGION 1..6: note = Synthetic Construct
KKAHRK

SEQ ID NO: 21156 - protein, 6 aa, synthetic construct
  REGION 1..6: note = Synthetic Construct
KKAHSK

SEQ ID NO: 21157 - protein, 6 aa, synthetic construct
  REGION 1..6: note = Synthetic Construct
KKAHTK

SEQ ID NO: 21158 - protein, 6 aa, synthetic construct
  REGION 1..6: note = Synthetic Construct
KKAHYK

SEQ ID NO: 21159 - protein, 6 aa, synthetic construct
  REGION 1..6: note = Synthetic Construct
KKAIAK

SEQ ID NO: 21160 - protein, 6 aa, synthetic construct
  REGION 1..6: note = Synthetic Construct
KKAIDK

SEQ ID NO: 21161 - protein, 6 aa, synthetic construct
  REGION 1..6: note = Synthetic Construct
KKAIEK

SEQ ID NO: 21162 - protein, 6 aa, synthetic construct
  REGION 1..6: note = Synthetic Construct
KKAIFK

SEQ ID NO: 21163 - protein, 6 aa, synthetic construct
  REGION 1..6: note = Synthetic Construct
KKAIGK

SEQ ID NO: 21164 - protein, 6 aa, synthetic construct
  REGION 1..6: note = Synthetic Construct
KKAIHK

SEQ ID NO: 21165 - protein, 6 aa, synthetic construct
  REGION 1..6: note = Synthetic Construct
KKAIIK

SEQ ID NO: 21166 - protein, 6 aa, synthetic construct
  REGION 1..6: note = Synthetic Construct
KKAILK

SEQ ID NO: 21167 - protein, 6 aa, synthetic construct
  REGION 1..6: note = Synthetic Construct
KKAINK

SEQ ID NO: 21168 - protein, 6 aa, synthetic construct
  REGION 1..6: note = Synthetic Construct
KKAIQK

SEQ ID NO: 21169 - protein, 6 aa, synthetic construct
  REGION 1..6: note = Synthetic Construct
KKAIRK

SEQ ID NO: 21170 - protein, 6 aa, synthetic construct
  REGION 1..6: note = Synthetic Construct
KKAISK

SEQ ID NO: 21171 - protein, 6 aa, synthetic construct
  REGION 1..6: note = Synthetic Construct
KKAITK

SEQ ID NO: 21172 - protein, 6 aa, synthetic construct
  REGION 1..6: note = Synthetic Construct
KKAIYK

SEQ ID NO: 21173 - protein, 6 aa, synthetic construct
  REGION 1..6: note = Synthetic Construct
KKALAK

SEQ ID NO: 21174 - protein, 6 aa, synthetic construct
  REGION 1..6: note = Synthetic Construct
KKALDK

SEQ ID NO: 21175 - protein, 6 aa, synthetic construct
  REGION 1..6: note = Synthetic Construct
KKALEK

SEQ ID NO: 21176 - protein, 6 aa, synthetic construct
  REGION 1..6: note = Synthetic Construct
KKALFK

SEQ ID NO: 21177 - protein, 6 aa, synthetic construct
  REGION 1..6: note = Synthetic Construct
KKALGK

SEQ ID NO: 21178 - protein, 6 aa, synthetic construct
  REGION 1..6: note = Synthetic Construct
KKALHK

SEQ ID NO: 21179 - protein, 6 aa, synthetic construct
  REGION 1..6: note = Synthetic Construct
KKALIK

SEQ ID NO: 21180 - protein, 6 aa, synthetic construct
  REGION 1..6: note = Synthetic Construct
KKALLK

SEQ ID NO: 21181 - protein, 6 aa, synthetic construct
  REGION 1..6: note = Synthetic Construct
KKALNK

SEQ ID NO: 21182 - protein, 6 aa, synthetic construct
  REGION 1..6: note = Synthetic Construct
KKALQK

SEQ ID NO: 21183 - protein, 6 aa, synthetic construct
  REGION 1..6: note = Synthetic Construct
KKALRK

SEQ ID NO: 21184 - protein, 6 aa, synthetic construct
  REGION 1..6: note = Synthetic Construct
KKALSK

SEQ ID NO: 21185 - protein, 6 aa, synthetic construct
  REGION 1..6: note = Synthetic Construct
KKALTK

SEQ ID NO: 21186 - protein, 6 aa, synthetic construct
  REGION 1..6: note = Synthetic Construct
KKALYK

SEQ ID NO: 21187 - protein, 6 aa, synthetic construct
  REGION 1..6: note = Synthetic Construct
KKANAK

SEQ ID NO: 21188 - protein, 6 aa, synthetic construct
  REGION 1..6: note = Synthetic Construct
KKANDK

SEQ ID NO: 21189 - protein, 6 aa, synthetic construct
  REGION 1..6: note = Synthetic Construct
KKANEK

SEQ ID NO: 21190 - protein, 6 aa, synthetic construct
  REGION 1..6: note = Synthetic Construct
KKANFK

SEQ ID NO: 21191 - protein, 6 aa, synthetic construct
  REGION 1..6: note = Synthetic Construct
KKANGK

SEQ ID NO: 21192 - protein, 6 aa, synthetic construct
  REGION 1..6: note = Synthetic Construct
KKANHK

SEQ ID NO: 21193 - protein, 6 aa, synthetic construct
  REGION 1..6: note = Synthetic Construct
KKANIK

SEQ ID NO: 21194 - protein, 6 aa, synthetic construct
  REGION 1..6: note = Synthetic Construct
KKANLK

SEQ ID NO: 21195 - protein, 6 aa, synthetic construct
  REGION 1..6: note = Synthetic Construct
KKANNK

SEQ ID NO: 21196 - protein, 6 aa, synthetic construct
  REGION 1..6: note = Synthetic Construct
KKANQK

SEQ ID NO: 21197 - protein, 6 aa, synthetic construct
  REGION 1..6: note = Synthetic Construct
KKANRK

SEQ ID NO: 21198 - protein, 6 aa, synthetic construct
  REGION 1..6: note = Synthetic Construct
KKANSK

SEQ ID NO: 21199 - protein, 6 aa, synthetic construct
  REGION 1..6: note = Synthetic Construct
KKANTK

SEQ ID NO: 21200 - protein, 6 aa, synthetic construct
  REGION 1..6: note = Synthetic Construct
KKANYK

SEQ ID NO: 21201 - protein, 6 aa, synthetic construct
  REGION 1..6: note = Synthetic Construct
KKAQAK

SEQ ID NO: 21202 - protein, 6 aa, synthetic construct
  REGION 1..6: note = Synthetic Construct
KKAQDK

SEQ ID NO: 21203 - protein, 6 aa, synthetic construct
  REGION 1..6: note = Synthetic Construct
KKAQEK

SEQ ID NO: 21204 - protein, 6 aa, synthetic construct
  REGION 1..6: note = Synthetic Construct
KKAQFK

SEQ ID NO: 21205 - protein, 6 aa, synthetic construct
  REGION 1..6: note = Synthetic Construct
KKAQGK

SEQ ID NO: 21206 - protein, 6 aa, synthetic construct
  REGION 1..6: note = Synthetic Construct
KKAQHK

SEQ ID NO: 21207 - protein, 6 aa, synthetic construct
  REGION 1..6: note = Synthetic Construct
KKAQIK

SEQ ID NO: 21208 - protein, 6 aa, synthetic construct
  REGION 1..6: note = Synthetic Construct
KKAQLK

SEQ ID NO: 21209 - protein, 6 aa, synthetic construct
  REGION 1..6: note = Synthetic Construct
KKAQNK

SEQ ID NO: 21210 - protein, 6 aa, synthetic construct
  REGION 1..6: note = Synthetic Construct
KKAQQK

SEQ ID NO: 21211 - protein, 6 aa, synthetic construct
  REGION 1..6: note = Synthetic Construct
KKAQRK

SEQ ID NO: 21212 - protein, 6 aa, synthetic construct
  REGION 1..6: note = Synthetic Construct
KKAQSK

SEQ ID NO: 21213 - protein, 6 aa, synthetic construct
  REGION 1..6: note = Synthetic Construct
KKAQTK

SEQ ID NO: 21214 - protein, 6 aa, synthetic construct
  REGION 1..6: note = Synthetic Construct
KKAQYK

SEQ ID NO: 21215 - protein, 6 aa, synthetic construct
  REGION 1..6: note = Synthetic Construct
KKARAK

SEQ ID NO: 21216 - protein, 6 aa, synthetic construct
  REGION 1..6: note = Synthetic Construct
KKARDK

SEQ ID NO: 21217 - protein, 6 aa, synthetic construct
  REGION 1..6: note = Synthetic Construct
KKAREK

SEQ ID NO: 21218 - protein, 6 aa, synthetic construct
  REGION 1..6: note = Synthetic Construct
KKARFK

SEQ ID NO: 21219 - protein, 6 aa, synthetic construct
  REGION 1..6: note = Synthetic Construct
KKARGK

SEQ ID NO: 21220 - protein, 6 aa, synthetic construct
  REGION 1..6: note = Synthetic Construct
KKARHK

SEQ ID NO: 21221 - protein, 6 aa, synthetic construct
  REGION 1..6: note = Synthetic Construct
KKARIK

SEQ ID NO: 21222 - protein, 6 aa, synthetic construct
  REGION 1..6: note = Synthetic Construct
KKARLK

SEQ ID NO: 21223 - protein, 6 aa, synthetic construct
  REGION 1..6: note = Synthetic Construct
KKARNK

SEQ ID NO: 21224 - protein, 6 aa, synthetic construct
  REGION 1..6: note = Synthetic Construct
KKARQK

SEQ ID NO: 21225 - protein, 6 aa, synthetic construct
  REGION 1..6: note = Synthetic Construct
KKARRK

SEQ ID NO: 21226 - protein, 6 aa, synthetic construct
  REGION 1..6: note = Synthetic Construct
KKARSK

SEQ ID NO: 21227 - protein, 6 aa, synthetic construct
  REGION 1..6: note = Synthetic Construct
KKARTK

SEQ ID NO: 21228 - protein, 6 aa, synthetic construct
  REGION 1..6: note = Synthetic Construct
KKARYK

SEQ ID NO: 21229 - protein, 6 aa, synthetic construct
  REGION 1..6: note = Synthetic Construct
KKASAK

SEQ ID NO: 21230 - protein, 6 aa, synthetic construct
  REGION 1..6: note = Synthetic Construct
KKASDK

SEQ ID NO: 21231 - protein, 6 aa, synthetic construct
  REGION 1..6: note = Synthetic Construct
KKASEK

SEQ ID NO: 21232 - protein, 6 aa, synthetic construct
  REGION 1..6: note = Synthetic Construct
KKASFK

SEQ ID NO: 21233 - protein, 6 aa, synthetic construct
  REGION 1..6: note = Synthetic Construct
KKASGK

SEQ ID NO: 21234 - protein, 6 aa, synthetic construct
  REGION 1..6: note = Synthetic Construct
KKASHK

SEQ ID NO: 21235 - protein, 6 aa, synthetic construct
  REGION 1..6: note = Synthetic Construct
KKASIK

SEQ ID NO: 21236 - protein, 6 aa, synthetic construct
  REGION 1..6: note = Synthetic Construct
KKASLK

SEQ ID NO: 21237 - protein, 6 aa, synthetic construct
  REGION 1..6: note = Synthetic Construct
KKASNK

SEQ ID NO: 21238 - protein, 6 aa, synthetic construct
  REGION 1..6: note = Synthetic Construct
KKASQK

SEQ ID NO: 21239 - protein, 6 aa, synthetic construct
  REGION 1..6: note = Synthetic Construct
KKASRK

SEQ ID NO: 21240 - protein, 6 aa, synthetic construct
  REGION 1..6: note = Synthetic Construct
KKASSK

SEQ ID NO: 21241 - protein, 6 aa, synthetic construct
  REGION 1..6: note = Synthetic Construct
KKASTK

SEQ ID NO: 21242 - protein, 6 aa, synthetic construct
  REGION 1..6: note = Synthetic Construct
KKASYK

SEQ ID NO: 21243 - protein, 6 aa, synthetic construct
  REGION 1..6: note = Synthetic Construct
KKATAK

SEQ ID NO: 21244 - protein, 6 aa, synthetic construct
  REGION 1..6: note = Synthetic Construct
KKATDK

SEQ ID NO: 21245 - protein, 6 aa, synthetic construct
  REGION 1..6: note = Synthetic Construct
KKATEK

SEQ ID NO: 21246 - protein, 6 aa, synthetic construct
  REGION 1..6: note = Synthetic Construct
KKATFK

SEQ ID NO: 21247 - protein, 6 aa, synthetic construct
  REGION 1..6: note = Synthetic Construct
KKATGK

SEQ ID NO: 21248 - protein, 6 aa, synthetic construct
  REGION 1..6: note = Synthetic Construct
KKATHK

SEQ ID NO: 21249 - protein, 6 aa, synthetic construct
  REGION 1..6: note = Synthetic Construct
KKATIK

SEQ ID NO: 21250 - protein, 6 aa, synthetic construct
  REGION 1..6: note = Synthetic Construct
KKATLK

SEQ ID NO: 21251 - protein, 6 aa, synthetic construct
  REGION 1..6: note = Synthetic Construct
KKATNK

SEQ ID NO: 21252 - protein, 6 aa, synthetic construct
  REGION 1..6: note = Synthetic Construct
KKATQK

SEQ ID NO: 21253 - protein, 6 aa, synthetic construct
  REGION 1..6: note = Synthetic Construct
KKATRK

SEQ ID NO: 21254 - protein, 6 aa, synthetic construct
  REGION 1..6: note = Synthetic Construct
KKATSK

SEQ ID NO: 21255 - protein, 6 aa, synthetic construct
  REGION 1..6: note = Synthetic Construct
KKATTK

SEQ ID NO: 21256 - protein, 6 aa, synthetic construct
  REGION 1..6: note = Synthetic Construct
KKATYK

SEQ ID NO: 21257 - protein, 6 aa, synthetic construct
  REGION 1..6: note = Synthetic Construct
KKAYAK

SEQ ID NO: 21258 - protein, 6 aa, synthetic construct
  REGION 1..6: note = Synthetic Construct
KKAYDK

SEQ ID NO: 21259 - protein, 6 aa, synthetic construct
  REGION 1..6: note = Synthetic Construct
KKAYEK

SEQ ID NO: 21260 - protein, 6 aa, synthetic construct
  REGION 1..6: note = Synthetic Construct
KKAYFK

SEQ ID NO: 21261 - protein, 6 aa, synthetic construct
  REGION 1..6: note = Synthetic Construct
KKAYGK

SEQ ID NO: 21262 - protein, 6 aa, synthetic construct
  REGION 1..6: note = Synthetic Construct
KKAYHK

SEQ ID NO: 21263 - protein, 6 aa, synthetic construct
  REGION 1..6: note = Synthetic Construct
KKAYIK

SEQ ID NO: 21264 - protein, 6 aa, synthetic construct
  REGION 1..6: note = Synthetic Construct
KKAYLK

SEQ ID NO: 21265 - protein, 6 aa, synthetic construct
  REGION 1..6: note = Synthetic Construct
KKAYNK

SEQ ID NO: 21266 - protein, 6 aa, synthetic construct
  REGION 1..6: note = Synthetic Construct
KKAYQK

SEQ ID NO: 21267 - protein, 6 aa, synthetic construct
  REGION 1..6: note = Synthetic Construct
KKAYRK

SEQ ID NO: 21268 - protein, 6 aa, synthetic construct
  REGION 1..6: note = Synthetic Construct
KKAYSK

SEQ ID NO: 21269 - protein, 6 aa, synthetic construct
  REGION 1..6: note = Synthetic Construct
KKAYTK

SEQ ID NO: 21270 - protein, 6 aa, synthetic construct
  REGION 1..6: note = Synthetic Construct
KKAYYK

SEQ ID NO: 21271 - protein, 6 aa, synthetic construct
  REGION 1..6: note = Synthetic Construct
KKDAAK

SEQ ID NO: 21272 - protein, 6 aa, synthetic construct
  REGION 1..6: note = Synthetic Construct
KKDADK

SEQ ID NO: 21273 - protein, 6 aa, synthetic construct
  REGION 1..6: note = Synthetic Construct
KKDAEK

SEQ ID NO: 21274 - protein, 6 aa, synthetic construct
  REGION 1..6: note = Synthetic Construct
KKDAFK

SEQ ID NO: 21275 - protein, 6 aa, synthetic construct
  REGION 1..6: note = Synthetic Construct
KKDAGK

SEQ ID NO: 21276 - protein, 6 aa, synthetic construct
  REGION 1..6: note = Synthetic Construct
KKDAHK

SEQ ID NO: 21277 - protein, 6 aa, synthetic construct
  REGION 1..6: note = Synthetic Construct
KKDAIK

SEQ ID NO: 21278 - protein, 6 aa, synthetic construct
  REGION 1..6: note = Synthetic Construct
KKDALK

SEQ ID NO: 21279 - protein, 6 aa, synthetic construct
  REGION 1..6: note = Synthetic Construct
KKDANK

SEQ ID NO: 21280 - protein, 6 aa, synthetic construct
  REGION 1..6: note = Synthetic Construct
KKDAQK

SEQ ID NO: 21281 - protein, 6 aa, synthetic construct
  REGION 1..6: note = Synthetic Construct
KKDARK

SEQ ID NO: 21282 - protein, 6 aa, synthetic construct
  REGION 1..6: note = Synthetic Construct
KKDASK

SEQ ID NO: 21283 - protein, 6 aa, synthetic construct
  REGION 1..6: note = Synthetic Construct
KKDATK

SEQ ID NO: 21284 - protein, 6 aa, synthetic construct
  REGION 1..6: note = Synthetic Construct
KKDAYK

SEQ ID NO: 21285 - protein, 6 aa, synthetic construct
  REGION 1..6: note = Synthetic Construct
KKDDAK

SEQ ID NO: 21286 - protein, 6 aa, synthetic construct
  REGION 1..6: note = Synthetic Construct
KKDDDK

SEQ ID NO: 21287 - protein, 6 aa, synthetic construct
  REGION 1..6: note = Synthetic Construct
KKDDEK

SEQ ID NO: 21288 - protein, 6 aa, synthetic construct
  REGION 1..6: note = Synthetic Construct
KKDDFK

SEQ ID NO: 21289 - protein, 6 aa, synthetic construct
  REGION 1..6: note = Synthetic Construct
KKDDGK

SEQ ID NO: 21290 - protein, 6 aa, synthetic construct
  REGION 1..6: note = Synthetic Construct
KKDDHK

SEQ ID NO: 21291 - protein, 6 aa, synthetic construct
  REGION 1..6: note = Synthetic Construct
KKDDIK

SEQ ID NO: 21292 - protein, 6 aa, synthetic construct
  REGION 1..6: note = Synthetic Construct
KKDDLK

SEQ ID NO: 21293 - protein, 6 aa, synthetic construct
  REGION 1..6: note = Synthetic Construct
KKDDNK

SEQ ID NO: 21294 - protein, 6 aa, synthetic construct
  REGION 1..6: note = Synthetic Construct
KKDDQK

SEQ ID NO: 21295 - protein, 6 aa, synthetic construct
  REGION 1..6: note = Synthetic Construct
KKDDRK

SEQ ID NO: 21296 - protein, 6 aa, synthetic construct
  REGION 1..6: note = Synthetic Construct
KKDDSK

SEQ ID NO: 21297 - protein, 6 aa, synthetic construct
  REGION 1..6: note = Synthetic Construct
KKDDTK

SEQ ID NO: 21298 - protein, 6 aa, synthetic construct
  REGION 1..6: note = Synthetic Construct
KKDDYK

SEQ ID NO: 21299 - protein, 6 aa, synthetic construct
  REGION 1..6: note = Synthetic Construct
KKDEAK

SEQ ID NO: 21300 - protein, 6 aa, synthetic construct
  REGION 1..6: note = Synthetic Construct
KKDEDK

SEQ ID NO: 21301 - protein, 6 aa, synthetic construct
  REGION 1..6: note = Synthetic Construct
KKDEEK

SEQ ID NO: 21302 - protein, 6 aa, synthetic construct
  REGION 1..6: note = Synthetic Construct
KKDEFK

SEQ ID NO: 21303 - protein, 6 aa, synthetic construct
  REGION 1..6: note = Synthetic Construct
KKDEGK

SEQ ID NO: 21304 - protein, 6 aa, synthetic construct
  REGION 1..6: note = Synthetic Construct
KKDEHK

SEQ ID NO: 21305 - protein, 6 aa, synthetic construct
  REGION 1..6: note = Synthetic Construct
KKDEIK

SEQ ID NO: 21306 - protein, 6 aa, synthetic construct
  REGION 1..6: note = Synthetic Construct
KKDELK

SEQ ID NO: 21307 - protein, 6 aa, synthetic construct
  REGION 1..6: note = Synthetic Construct
KKDENK

SEQ ID NO: 21308 - protein, 6 aa, synthetic construct
  REGION 1..6: note = Synthetic Construct
KKDEQK

SEQ ID NO: 21309 - protein, 6 aa, synthetic construct
  REGION 1..6: note = Synthetic Construct
KKDERK

SEQ ID NO: 21310 - protein, 6 aa, synthetic construct
  REGION 1..6: note = Synthetic Construct
KKDESK

SEQ ID NO: 21311 - protein, 6 aa, synthetic construct
  REGION 1..6: note = Synthetic Construct
KKDETK

SEQ ID NO: 21312 - protein, 6 aa, synthetic construct
  REGION 1..6: note = Synthetic Construct
KKDEYK

SEQ ID NO: 21313 - protein, 6 aa, synthetic construct
  REGION 1..6: note = Synthetic Construct
KKDFAK

SEQ ID NO: 21314 - protein, 6 aa, synthetic construct
  REGION 1..6: note = Synthetic Construct
KKDFDK

SEQ ID NO: 21315 - protein, 6 aa, synthetic construct
  REGION 1..6: note = Synthetic Construct
KKDFEK

SEQ ID NO: 21316 - protein, 6 aa, synthetic construct
  REGION 1..6: note = Synthetic Construct
KKDFFK

SEQ ID NO: 21317 - protein, 6 aa, synthetic construct
  REGION 1..6: note = Synthetic Construct
KKDFGK

SEQ ID NO: 21318 - protein, 6 aa, synthetic construct
  REGION 1..6: note = Synthetic Construct
KKDFHK

SEQ ID NO: 21319 - protein, 6 aa, synthetic construct
  REGION 1..6: note = Synthetic Construct
KKDFIK

SEQ ID NO: 21320 - protein, 6 aa, synthetic construct
  REGION 1..6: note = Synthetic Construct
KKDFLK

SEQ ID NO: 21321 - protein, 6 aa, synthetic construct
  REGION 1..6: note = Synthetic Construct
KKDFNK

SEQ ID NO: 21322 - protein, 6 aa, synthetic construct
  REGION 1..6: note = Synthetic Construct
KKDFQK

SEQ ID NO: 21323 - protein, 6 aa, synthetic construct
  REGION 1..6: note = Synthetic Construct
KKDFRK

SEQ ID NO: 21324 - protein, 6 aa, synthetic construct
  REGION 1..6: note = Synthetic Construct
KKDFSK

SEQ ID NO: 21325 - protein, 6 aa, synthetic construct
  REGION 1..6: note = Synthetic Construct
KKDFTK

SEQ ID NO: 21326 - protein, 6 aa, synthetic construct
  REGION 1..6: note = Synthetic Construct
KKDFYK

SEQ ID NO: 21327 - protein, 6 aa, synthetic construct
  REGION 1..6: note = Synthetic Construct
KKDGAK

SEQ ID NO: 21328 - protein, 6 aa, synthetic construct
  REGION 1..6: note = Synthetic Construct
KKDGDK

SEQ ID NO: 21329 - protein, 6 aa, synthetic construct
  REGION 1..6: note = Synthetic Construct
KKDGEK

SEQ ID NO: 21330 - protein, 6 aa, synthetic construct
  REGION 1..6: note = Synthetic Construct
KKDGFK

SEQ ID NO: 21331 - protein, 6 aa, synthetic construct
  REGION 1..6: note = Synthetic Construct
KKDGGK

SEQ ID NO: 21332 - protein, 6 aa, synthetic construct
  REGION 1..6: note = Synthetic Construct
KKDGHK

SEQ ID NO: 21333 - protein, 6 aa, synthetic construct
  REGION 1..6: note = Synthetic Construct
KKDGIK

SEQ ID NO: 21334 - protein, 6 aa, synthetic construct
  REGION 1..6: note = Synthetic Construct
KKDGLK

SEQ ID NO: 21335 - protein, 6 aa, synthetic construct
  REGION 1..6: note = Synthetic Construct
KKDGNK

SEQ ID NO: 21336 - protein, 6 aa, synthetic construct
  REGION 1..6: note = Synthetic Construct
KKDGQK

SEQ ID NO: 21337 - protein, 6 aa, synthetic construct
  REGION 1..6: note = Synthetic Construct
KKDGRK

SEQ ID NO: 21338 - protein, 6 aa, synthetic construct
  REGION 1..6: note = Synthetic Construct
KKDGSK

SEQ ID NO: 21339 - protein, 6 aa, synthetic construct
  REGION 1..6: note = Synthetic Construct
KKDGTK

SEQ ID NO: 21340 - protein, 6 aa, synthetic construct
  REGION 1..6: note = Synthetic Construct
KKDGYK

SEQ ID NO: 21341 - protein, 6 aa, synthetic construct
  REGION 1..6: note = Synthetic Construct
KKDHAK

SEQ ID NO: 21342 - protein, 6 aa, synthetic construct
  REGION 1..6: note = Synthetic Construct
KKDHDK

SEQ ID NO: 21343 - protein, 6 aa, synthetic construct
  REGION 1..6: note = Synthetic Construct
KKDHEK

SEQ ID NO: 21344 - protein, 6 aa, synthetic construct
  REGION 1..6: note = Synthetic Construct
KKDHFK

SEQ ID NO: 21345 - protein, 6 aa, synthetic construct
  REGION 1..6: note = Synthetic Construct
KKDHGK

SEQ ID NO: 21346 - protein, 6 aa, synthetic construct
  REGION 1..6: note = Synthetic Construct
KKDHHK

SEQ ID NO: 21347 - protein, 6 aa, synthetic construct
  REGION 1..6: note = Synthetic Construct
KKDHIK

SEQ ID NO: 21348 - protein, 6 aa, synthetic construct
  REGION 1..6: note = Synthetic Construct
KKDHLK

SEQ ID NO: 21349 - protein, 6 aa, synthetic construct
  REGION 1..6: note = Synthetic Construct
KKDHNK

SEQ ID NO: 21350 - protein, 6 aa, synthetic construct
  REGION 1..6: note = Synthetic Construct
KKDHQK

SEQ ID NO: 21351 - protein, 6 aa, synthetic construct
  REGION 1..6: note = Synthetic Construct
KKDHRK

SEQ ID NO: 21352 - protein, 6 aa, synthetic construct
  REGION 1..6: note = Synthetic Construct
KKDHSK

SEQ ID NO: 21353 - protein, 6 aa, synthetic construct
  REGION 1..6: note = Synthetic Construct
KKDHTK

SEQ ID NO: 21354 - protein, 6 aa, synthetic construct
  REGION 1..6: note = Synthetic Construct
KKDHYK

SEQ ID NO: 21355 - protein, 6 aa, synthetic construct
  REGION 1..6: note = Synthetic Construct
KKDIAK

SEQ ID NO: 21356 - protein, 6 aa, synthetic construct
  REGION 1..6: note = Synthetic Construct
KKDIDK

SEQ ID NO: 21357 - protein, 6 aa, synthetic construct
  REGION 1..6: note = Synthetic Construct
KKDIEK

SEQ ID NO: 21358 - protein, 6 aa, synthetic construct
  REGION 1..6: note = Synthetic Construct
KKDIFK

SEQ ID NO: 21359 - protein, 6 aa, synthetic construct
  REGION 1..6: note = Synthetic Construct
KKDIGK

SEQ ID NO: 21360 - protein, 6 aa, synthetic construct
  REGION 1..6: note = Synthetic Construct
KKDIHK

SEQ ID NO: 21361 - protein, 6 aa, synthetic construct
  REGION 1..6: note = Synthetic Construct
KKDIIK

SEQ ID NO: 21362 - protein, 6 aa, synthetic construct
  REGION 1..6: note = Synthetic Construct
KKDILK

SEQ ID NO: 21363 - protein, 6 aa, synthetic construct
  REGION 1..6: note = Synthetic Construct
KKDINK

SEQ ID NO: 21364 - protein, 6 aa, synthetic construct
  REGION 1..6: note = Synthetic Construct
KKDIQK

SEQ ID NO: 21365 - protein, 6 aa, synthetic construct
  REGION 1..6: note = Synthetic Construct
KKDIRK

SEQ ID NO: 21366 - protein, 6 aa, synthetic construct
  REGION 1..6: note = Synthetic Construct
KKDISK

SEQ ID NO: 21367 - protein, 6 aa, synthetic construct
  REGION 1..6: note = Synthetic Construct
KKDITK

SEQ ID NO: 21368 - protein, 6 aa, synthetic construct
  REGION 1..6: note = Synthetic Construct
KKDIYK

SEQ ID NO: 21369 - protein, 6 aa, synthetic construct
  REGION 1..6: note = Synthetic Construct
KKDLAK

SEQ ID NO: 21370 - protein, 6 aa, synthetic construct
  REGION 1..6: note = Synthetic Construct
KKDLDK

SEQ ID NO: 21371 - protein, 6 aa, synthetic construct
  REGION 1..6: note = Synthetic Construct
KKDLEK

SEQ ID NO: 21372 - protein, 6 aa, synthetic construct
  REGION 1..6: note = Synthetic Construct
KKDLFK

SEQ ID NO: 21373 - protein, 6 aa, synthetic construct
  REGION 1..6: note = Synthetic Construct
KKDLGK

SEQ ID NO: 21374 - protein, 6 aa, synthetic construct
  REGION 1..6: note = Synthetic Construct
KKDLHK

SEQ ID NO: 21375 - protein, 6 aa, synthetic construct
  REGION 1..6: note = Synthetic Construct
KKDLIK

SEQ ID NO: 21376 - protein, 6 aa, synthetic construct
  REGION 1..6: note = Synthetic Construct
KKDLLK

SEQ ID NO: 21377 - protein, 6 aa, synthetic construct
  REGION 1..6: note = Synthetic Construct
KKDLNK

SEQ ID NO: 21378 - protein, 6 aa, synthetic construct
  REGION 1..6: note = Synthetic Construct
KKDLQK

SEQ ID NO: 21379 - protein, 6 aa, synthetic construct
  REGION 1..6: note = Synthetic Construct
KKDLRK

SEQ ID NO: 21380 - protein, 6 aa, synthetic construct
  REGION 1..6: note = Synthetic Construct
KKDLSK

SEQ ID NO: 21381 - protein, 6 aa, synthetic construct
  REGION 1..6: note = Synthetic Construct
KKDLTK

SEQ ID NO: 21382 - protein, 6 aa, synthetic construct
  REGION 1..6: note = Synthetic Construct
KKDLYK

SEQ ID NO: 21383 - protein, 6 aa, synthetic construct
  REGION 1..6: note = Synthetic Construct
KKDNAK

SEQ ID NO: 21384 - protein, 6 aa, synthetic construct
  REGION 1..6: note = Synthetic Construct
KKDNDK

SEQ ID NO: 21385 - protein, 6 aa, synthetic construct
  REGION 1..6: note = Synthetic Construct
KKDNEK

SEQ ID NO: 21386 - protein, 6 aa, synthetic construct
  REGION 1..6: note = Synthetic Construct
KKDNFK

SEQ ID NO: 21387 - protein, 6 aa, synthetic construct
  REGION 1..6: note = Synthetic Construct
KKDNGK

SEQ ID NO: 21388 - protein, 6 aa, synthetic construct
  REGION 1..6: note = Synthetic Construct
KKDNHK

SEQ ID NO: 21389 - protein, 6 aa, synthetic construct
  REGION 1..6: note = Synthetic Construct
KKDNIK

SEQ ID NO: 21390 - protein, 6 aa, synthetic construct
  REGION 1..6: note = Synthetic Construct
KKDNLK

SEQ ID NO: 21391 - protein, 6 aa, synthetic construct
  REGION 1..6: note = Synthetic Construct
KKDNNK

SEQ ID NO: 21392 - protein, 6 aa, synthetic construct
  REGION 1..6: note = Synthetic Construct
KKDNQK

SEQ ID NO: 21393 - protein, 6 aa, synthetic construct
  REGION 1..6: note = Synthetic Construct
KKDNRK

SEQ ID NO: 21394 - protein, 6 aa, synthetic construct
  REGION 1..6: note = Synthetic Construct
KKDNSK

SEQ ID NO: 21395 - protein, 6 aa, synthetic construct
  REGION 1..6: note = Synthetic Construct
KKDNTK

SEQ ID NO: 21396 - protein, 6 aa, synthetic construct
  REGION 1..6: note = Synthetic Construct
KKDNYK

SEQ ID NO: 21397 - protein, 6 aa, synthetic construct
  REGION 1..6: note = Synthetic Construct
KKDQAK

SEQ ID NO: 21398 - protein, 6 aa, synthetic construct
  REGION 1..6: note = Synthetic Construct
KKDQDK

SEQ ID NO: 21399 - protein, 6 aa, synthetic construct
  REGION 1..6: note = Synthetic Construct
KKDQEK

SEQ ID NO: 21400 - protein, 6 aa, synthetic construct
  REGION 1..6: note = Synthetic Construct
KKDQFK

SEQ ID NO: 21401 - protein, 6 aa, synthetic construct
  REGION 1..6: note = Synthetic Construct
KKDQGK

SEQ ID NO: 21402 - protein, 6 aa, synthetic construct
  REGION 1..6: note = Synthetic Construct
KKDQHK

SEQ ID NO: 21403 - protein, 6 aa, synthetic construct
  REGION 1..6: note = Synthetic Construct
KKDQIK

SEQ ID NO: 21404 - protein, 6 aa, synthetic construct
  REGION 1..6: note = Synthetic Construct
KKDQLK

SEQ ID NO: 21405 - protein, 6 aa, synthetic construct
  REGION 1..6: note = Synthetic Construct
KKDQNK

SEQ ID NO: 21406 - protein, 6 aa, synthetic construct
  REGION 1..6: note = Synthetic Construct
KKDQQK

SEQ ID NO: 21407 - protein, 6 aa, synthetic construct
  REGION 1..6: note = Synthetic Construct
KKDQRK

SEQ ID NO: 21408 - protein, 6 aa, synthetic construct
  REGION 1..6: note = Synthetic Construct
KKDQSK

SEQ ID NO: 21409 - protein, 6 aa, synthetic construct
  REGION 1..6: note = Synthetic Construct
KKDQTK

SEQ ID NO: 21410 - protein, 6 aa, synthetic construct
  REGION 1..6: note = Synthetic Construct
KKDQYK

SEQ ID NO: 21411 - protein, 6 aa, synthetic construct
  REGION 1..6: note = Synthetic Construct
KKDRAK

SEQ ID NO: 21412 - protein, 6 aa, synthetic construct
  REGION 1..6: note = Synthetic Construct
KKDRDK

SEQ ID NO: 21413 - protein, 6 aa, synthetic construct
  REGION 1..6: note = Synthetic Construct
KKDREK

SEQ ID NO: 21414 - protein, 6 aa, synthetic construct
  REGION 1..6: note = Synthetic Construct
KKDRFK

SEQ ID NO: 21415 - protein, 6 aa, synthetic construct
  REGION 1..6: note = Synthetic Construct
KKDRGK

SEQ ID NO: 21416 - protein, 6 aa, synthetic construct
  REGION 1..6: note = Synthetic Construct
KKDRHK

SEQ ID NO: 21417 - protein, 6 aa, synthetic construct
  REGION 1..6: note = Synthetic Construct
KKDRIK

SEQ ID NO: 21418 - protein, 6 aa, synthetic construct
  REGION 1..6: note = Synthetic Construct
KKDRLK

SEQ ID NO: 21419 - protein, 6 aa, synthetic construct
  REGION 1..6: note = Synthetic Construct
KKDRNK

SEQ ID NO: 21420 - protein, 6 aa, synthetic construct
  REGION 1..6: note = Synthetic Construct
KKDRQK

SEQ ID NO: 21421 - protein, 6 aa, synthetic construct
  REGION 1..6: note = Synthetic Construct
KKDRRK

SEQ ID NO: 21422 - protein, 6 aa, synthetic construct
  REGION 1..6: note = Synthetic Construct
KKDRSK

SEQ ID NO: 21423 - protein, 6 aa, synthetic construct
  REGION 1..6: note = Synthetic Construct
KKDRTK

SEQ ID NO: 21424 - protein, 6 aa, synthetic construct
  REGION 1..6: note = Synthetic Construct
KKDRYK

SEQ ID NO: 21425 - protein, 6 aa, synthetic construct
  REGION 1..6: note = Synthetic Construct
KKDSAK

SEQ ID NO: 21426 - protein, 6 aa, synthetic construct
  REGION 1..6: note = Synthetic Construct
KKDSDK

SEQ ID NO: 21427 - protein, 6 aa, synthetic construct
  REGION 1..6: note = Synthetic Construct
KKDSEK

SEQ ID NO: 21428 - protein, 6 aa, synthetic construct
  REGION 1..6: note = Synthetic Construct
KKDSFK

SEQ ID NO: 21429 - protein, 6 aa, synthetic construct
  REGION 1..6: note = Synthetic Construct
KKDSGK

SEQ ID NO: 21430 - protein, 6 aa, synthetic construct
  REGION 1..6: note = Synthetic Construct
KKDSHK

SEQ ID NO: 21431 - protein, 6 aa, synthetic construct
  REGION 1..6: note = Synthetic Construct
KKDSIK

SEQ ID NO: 21432 - protein, 6 aa, synthetic construct
  REGION 1..6: note = Synthetic Construct
KKDSLK

SEQ ID NO: 21433 - protein, 6 aa, synthetic construct
  REGION 1..6: note = Synthetic Construct
KKDSNK

SEQ ID NO: 21434 - protein, 6 aa, synthetic construct
  REGION 1..6: note = Synthetic Construct
KKDSQK

SEQ ID NO: 21435 - protein, 6 aa, synthetic construct
  REGION 1..6: note = Synthetic Construct
KKDSRK

SEQ ID NO: 21436 - protein, 6 aa, synthetic construct
  REGION 1..6: note = Synthetic Construct
KKDSSK

SEQ ID NO: 21437 - protein, 6 aa, synthetic construct
  REGION 1..6: note = Synthetic Construct
KKDSTK

SEQ ID NO: 21438 - protein, 6 aa, synthetic construct
  REGION 1..6: note = Synthetic Construct
KKDSYK

SEQ ID NO: 21439 - protein, 6 aa, synthetic construct
  REGION 1..6: note = Synthetic Construct
KKDTAK

SEQ ID NO: 21440 - protein, 6 aa, synthetic construct
  REGION 1..6: note = Synthetic Construct
KKDTDK

SEQ ID NO: 21441 - protein, 6 aa, synthetic construct
  REGION 1..6: note = Synthetic Construct
KKDTEK

SEQ ID NO: 21442 - protein, 6 aa, synthetic construct
  REGION 1..6: note = Synthetic Construct
KKDTFK

SEQ ID NO: 21443 - protein, 6 aa, synthetic construct
  REGION 1..6: note = Synthetic Construct
KKDTGK

SEQ ID NO: 21444 - protein, 6 aa, synthetic construct
  REGION 1..6: note = Synthetic Construct
KKDTHK

SEQ ID NO: 21445 - protein, 6 aa, synthetic construct
  REGION 1..6: note = Synthetic Construct
KKDTIK

SEQ ID NO: 21446 - protein, 6 aa, synthetic construct
  REGION 1..6: note = Synthetic Construct
KKDTLK

SEQ ID NO: 21447 - protein, 6 aa, synthetic construct
  REGION 1..6: note = Synthetic Construct
KKDTNK

SEQ ID NO: 21448 - protein, 6 aa, synthetic construct
  REGION 1..6: note = Synthetic Construct
KKDTQK

SEQ ID NO: 21449 - protein, 6 aa, synthetic construct
  REGION 1..6: note = Synthetic Construct
KKDTRK

SEQ ID NO: 21450 - protein, 6 aa, synthetic construct
  REGION 1..6: note = Synthetic Construct
KKDTSK

SEQ ID NO: 21451 - protein, 6 aa, synthetic construct
  REGION 1..6: note = Synthetic Construct
KKDTTK

SEQ ID NO: 21452 - protein, 6 aa, synthetic construct
  REGION 1..6: note = Synthetic Construct
KKDTYK

SEQ ID NO: 21453 - protein, 6 aa, synthetic construct
  REGION 1..6: note = Synthetic Construct
KKDYAK

SEQ ID NO: 21454 - protein, 6 aa, synthetic construct
  REGION 1..6: note = Synthetic Construct
KKDYDK

SEQ ID NO: 21455 - protein, 6 aa, synthetic construct
  REGION 1..6: note = Synthetic Construct
KKDYEK

SEQ ID NO: 21456 - protein, 6 aa, synthetic construct
  REGION 1..6: note = Synthetic Construct
KKDYFK

SEQ ID NO: 21457 - protein, 6 aa, synthetic construct
  REGION 1..6: note = Synthetic Construct
KKDYGK

SEQ ID NO: 21458 - protein, 6 aa, synthetic construct
  REGION 1..6: note = Synthetic Construct
KKDYHK

SEQ ID NO: 21459 - protein, 6 aa, synthetic construct
  REGION 1..6: note = Synthetic Construct
KKDYIK

SEQ ID NO: 21460 - protein, 6 aa, synthetic construct
  REGION 1..6: note = Synthetic Construct
KKDYLK

SEQ ID NO: 21461 - protein, 6 aa, synthetic construct
  REGION 1..6: note = Synthetic Construct
KKDYNK

SEQ ID NO: 21462 - protein, 6 aa, synthetic construct
  REGION 1..6: note = Synthetic Construct
KKDYQK

SEQ ID NO: 21463 - protein, 6 aa, synthetic construct
  REGION 1..6: note = Synthetic Construct
KKDYRK

SEQ ID NO: 21464 - protein, 6 aa, synthetic construct
  REGION 1..6: note = Synthetic Construct
KKDYSK

SEQ ID NO: 21465 - protein, 6 aa, synthetic construct
  REGION 1..6: note = Synthetic Construct
KKDYTK

SEQ ID NO: 21466 - protein, 6 aa, synthetic construct
  REGION 1..6: note = Synthetic Construct
KKDYYK

SEQ ID NO: 21467 - protein, 6 aa, synthetic construct
  REGION 1..6: note = Synthetic Construct
KKEAAK

SEQ ID NO: 21468 - protein, 6 aa, synthetic construct
  REGION 1..6: note = Synthetic Construct
KKEADK

SEQ ID NO: 21469 - protein, 6 aa, synthetic construct
  REGION 1..6: note = Synthetic Construct
KKEAEK

SEQ ID NO: 21470 - protein, 6 aa, synthetic construct
  REGION 1..6: note = Synthetic Construct
KKEAFK

SEQ ID NO: 21471 - protein, 6 aa, synthetic construct
  REGION 1..6: note = Synthetic Construct
KKEAGK

SEQ ID NO: 21472 - protein, 6 aa, synthetic construct
  REGION 1..6: note = Synthetic Construct
KKEAHK

SEQ ID NO: 21473 - protein, 6 aa, synthetic construct
  REGION 1..6: note = Synthetic Construct
KKEAIK

SEQ ID NO: 21474 - protein, 6 aa, synthetic construct
  REGION 1..6: note = Synthetic Construct
KKEALK

SEQ ID NO: 21475 - protein, 6 aa, synthetic construct
  REGION 1..6: note = Synthetic Construct
KKEANK

SEQ ID NO: 21476 - protein, 6 aa, synthetic construct
  REGION 1..6: note = Synthetic Construct
KKEAQK

SEQ ID NO: 21477 - protein, 6 aa, synthetic construct
  REGION 1..6: note = Synthetic Construct
KKEARK

SEQ ID NO: 21478 - protein, 6 aa, synthetic construct
  REGION 1..6: note = Synthetic Construct
KKEASK

SEQ ID NO: 21479 - protein, 6 aa, synthetic construct
  REGION 1..6: note = Synthetic Construct
KKEATK

SEQ ID NO: 21480 - protein, 6 aa, synthetic construct
  REGION 1..6: note = Synthetic Construct
KKEAYK

SEQ ID NO: 21481 - protein, 6 aa, synthetic construct
  REGION 1..6: note = Synthetic Construct
KKEDAK

SEQ ID NO: 21482 - protein, 6 aa, synthetic construct
  REGION 1..6: note = Synthetic Construct
KKEDDK

SEQ ID NO: 21483 - protein, 6 aa, synthetic construct
  REGION 1..6: note = Synthetic Construct
KKEDEK

SEQ ID NO: 21484 - protein, 6 aa, synthetic construct
  REGION 1..6: note = Synthetic Construct
KKEDFK

SEQ ID NO: 21485 - protein, 6 aa, synthetic construct
  REGION 1..6: note = Synthetic Construct
KKEDGK

SEQ ID NO: 21486 - protein, 6 aa, synthetic construct
  REGION 1..6: note = Synthetic Construct
KKEDHK

SEQ ID NO: 21487 - protein, 6 aa, synthetic construct
  REGION 1..6: note = Synthetic Construct
KKEDIK

SEQ ID NO: 21488 - protein, 6 aa, synthetic construct
  REGION 1..6: note = Synthetic Construct
KKEDLK

SEQ ID NO: 21489 - protein, 6 aa, synthetic construct
  REGION 1..6: note = Synthetic Construct
KKEDNK

SEQ ID NO: 21490 - protein, 6 aa, synthetic construct
  REGION 1..6: note = Synthetic Construct
KKEDQK

SEQ ID NO: 21491 - protein, 6 aa, synthetic construct
  REGION 1..6: note = Synthetic Construct
KKEDRK

SEQ ID NO: 21492 - protein, 6 aa, synthetic construct
  REGION 1..6: note = Synthetic Construct
KKEDSK

SEQ ID NO: 21493 - protein, 6 aa, synthetic construct
  REGION 1..6: note = Synthetic Construct
KKEDTK

SEQ ID NO: 21494 - protein, 6 aa, synthetic construct
  REGION 1..6: note = Synthetic Construct
KKEDYK

SEQ ID NO: 21495 - protein, 6 aa, synthetic construct
  REGION 1..6: note = Synthetic Construct
KKEEAK

SEQ ID NO: 21496 - protein, 6 aa, synthetic construct
  REGION 1..6: note = Synthetic Construct
KKEEDK

SEQ ID NO: 21497 - protein, 6 aa, synthetic construct
  REGION 1..6: note = Synthetic Construct
KKEEEK

SEQ ID NO: 21498 - protein, 6 aa, synthetic construct
  REGION 1..6: note = Synthetic Construct
KKEEFK

SEQ ID NO: 21499 - protein, 6 aa, synthetic construct
  REGION 1..6: note = Synthetic Construct
KKEEGK

SEQ ID NO: 21500 - protein, 6 aa, synthetic construct
  REGION 1..6: note = Synthetic Construct
KKEEHK

SEQ ID NO: 21501 - protein, 6 aa, synthetic construct
  REGION 1..6: note = Synthetic Construct
KKEEIK

SEQ ID NO: 21502 - protein, 6 aa, synthetic construct
  REGION 1..6: note = Synthetic Construct
KKEELK

SEQ ID NO: 21503 - protein, 6 aa, synthetic construct
  REGION 1..6: note = Synthetic Construct
KKEENK

SEQ ID NO: 21504 - protein, 6 aa, synthetic construct
  REGION 1..6: note = Synthetic Construct
KKEEQK

SEQ ID NO: 21505 - protein, 6 aa, synthetic construct
  REGION 1..6: note = Synthetic Construct
KKEERK

SEQ ID NO: 21506 - protein, 6 aa, synthetic construct
  REGION 1..6: note = Synthetic Construct
KKEESK

SEQ ID NO: 21507 - protein, 6 aa, synthetic construct
  REGION 1..6: note = Synthetic Construct
KKEETK

SEQ ID NO: 21508 - protein, 6 aa, synthetic construct
  REGION 1..6: note = Synthetic Construct
KKEEYK

SEQ ID NO: 21509 - protein, 6 aa, synthetic construct
  REGION 1..6: note = Synthetic Construct
KKEFAK

SEQ ID NO: 21510 - protein, 6 aa, synthetic construct
  REGION 1..6: note = Synthetic Construct
KKEFDK

SEQ ID NO: 21511 - protein, 6 aa, synthetic construct
  REGION 1..6: note = Synthetic Construct
KKEFEK

SEQ ID NO: 21512 - protein, 6 aa, synthetic construct
  REGION 1..6: note = Synthetic Construct
KKEFFK

SEQ ID NO: 21513 - protein, 6 aa, synthetic construct
  REGION 1..6: note = Synthetic Construct
KKEFGK

SEQ ID NO: 21514 - protein, 6 aa, synthetic construct
  REGION 1..6: note = Synthetic Construct
KKEFHK

SEQ ID NO: 21515 - protein, 6 aa, synthetic construct
  REGION 1..6: note = Synthetic Construct
KKEFIK

SEQ ID NO: 21516 - protein, 6 aa, synthetic construct
  REGION 1..6: note = Synthetic Construct
KKEFLK

SEQ ID NO: 21517 - protein, 6 aa, synthetic construct
  REGION 1..6: note = Synthetic Construct
KKEFNK

SEQ ID NO: 21518 - protein, 6 aa, synthetic construct
  REGION 1..6: note = Synthetic Construct
KKEFQK

SEQ ID NO: 21519 - protein, 6 aa, synthetic construct
  REGION 1..6: note = Synthetic Construct
KKEFRK

SEQ ID NO: 21520 - protein, 6 aa, synthetic construct
  REGION 1..6: note = Synthetic Construct
KKEFSK

SEQ ID NO: 21521 - protein, 6 aa, synthetic construct
  REGION 1..6: note = Synthetic Construct
KKEFTK

SEQ ID NO: 21522 - protein, 6 aa, synthetic construct
  REGION 1..6: note = Synthetic Construct
KKEFYK

SEQ ID NO: 21523 - protein, 6 aa, synthetic construct
  REGION 1..6: note = Synthetic Construct
KKEGAK

SEQ ID NO: 21524 - protein, 6 aa, synthetic construct
  REGION 1..6: note = Synthetic Construct
KKEGDK

SEQ ID NO: 21525 - protein, 6 aa, synthetic construct
  REGION 1..6: note = Synthetic Construct
KKEGEK

SEQ ID NO: 21526 - protein, 6 aa, synthetic construct
  REGION 1..6: note = Synthetic Construct
KKEGFK

SEQ ID NO: 21527 - protein, 6 aa, synthetic construct
  REGION 1..6: note = Synthetic Construct
KKEGGK

SEQ ID NO: 21528 - protein, 6 aa, synthetic construct
  REGION 1..6: note = Synthetic Construct
KKEGHK

SEQ ID NO: 21529 - protein, 6 aa, synthetic construct
  REGION 1..6: note = Synthetic Construct
KKEGIK

SEQ ID NO: 21530 - protein, 6 aa, synthetic construct
  REGION 1..6: note = Synthetic Construct
KKEGLK

SEQ ID NO: 21531 - protein, 6 aa, synthetic construct
  REGION 1..6: note = Synthetic Construct
KKEGNK

SEQ ID NO: 21532 - protein, 6 aa, synthetic construct
  REGION 1..6: note = Synthetic Construct
KKEGQK

SEQ ID NO: 21533 - protein, 6 aa, synthetic construct
  REGION 1..6: note = Synthetic Construct
KKEGRK

SEQ ID NO: 21534 - protein, 6 aa, synthetic construct
  REGION 1..6: note = Synthetic Construct
KKEGSK

SEQ ID NO: 21535 - protein, 6 aa, synthetic construct
  REGION 1..6: note = Synthetic Construct
KKEGTK

SEQ ID NO: 21536 - protein, 6 aa, synthetic construct
  REGION 1..6: note = Synthetic Construct
KKEGYK

SEQ ID NO: 21537 - protein, 6 aa, synthetic construct
  REGION 1..6: note = Synthetic Construct
KKEHAK

SEQ ID NO: 21538 - protein, 6 aa, synthetic construct
  REGION 1..6: note = Synthetic Construct
KKEHDK

SEQ ID NO: 21539 - protein, 6 aa, synthetic construct
  REGION 1..6: note = Synthetic Construct
KKEHEK

SEQ ID NO: 21540 - protein, 6 aa, synthetic construct
  REGION 1..6: note = Synthetic Construct
KKEHFK

SEQ ID NO: 21541 - protein, 6 aa, synthetic construct
  REGION 1..6: note = Synthetic Construct
KKEHGK

SEQ ID NO: 21542 - protein, 6 aa, synthetic construct
  REGION 1..6: note = Synthetic Construct
KKEHHK

SEQ ID NO: 21543 - protein, 6 aa, synthetic construct
  REGION 1..6: note = Synthetic Construct
KKEHIK

SEQ ID NO: 21544 - protein, 6 aa, synthetic construct
  REGION 1..6: note = Synthetic Construct
KKEHLK

SEQ ID NO: 21545 - protein, 6 aa, synthetic construct
  REGION 1..6: note = Synthetic Construct
KKEHNK

SEQ ID NO: 21546 - protein, 6 aa, synthetic construct
  REGION 1..6: note = Synthetic Construct
KKEHQK

SEQ ID NO: 21547 - protein, 6 aa, synthetic construct
  REGION 1..6: note = Synthetic Construct
KKEHRK

SEQ ID NO: 21548 - protein, 6 aa, synthetic construct
  REGION 1..6: note = Synthetic Construct
KKEHSK

SEQ ID NO: 21549 - protein, 6 aa, synthetic construct
  REGION 1..6: note = Synthetic Construct
KKEHTK

SEQ ID NO: 21550 - protein, 6 aa, synthetic construct
  REGION 1..6: note = Synthetic Construct
KKEHYK

SEQ ID NO: 21551 - protein, 6 aa, synthetic construct
  REGION 1..6: note = Synthetic Construct
KKEIAK

SEQ ID NO: 21552 - protein, 6 aa, synthetic construct
  REGION 1..6: note = Synthetic Construct
KKEIDK

SEQ ID NO: 21553 - protein, 6 aa, synthetic construct
  REGION 1..6: note = Synthetic Construct
KKEIEK

SEQ ID NO: 21554 - protein, 6 aa, synthetic construct
  REGION 1..6: note = Synthetic Construct
KKEIFK

SEQ ID NO: 21555 - protein, 6 aa, synthetic construct
  REGION 1..6: note = Synthetic Construct
KKEIGK

SEQ ID NO: 21556 - protein, 6 aa, synthetic construct
  REGION 1..6: note = Synthetic Construct
KKEIHK

SEQ ID NO: 21557 - protein, 6 aa, synthetic construct
  REGION 1..6: note = Synthetic Construct
KKEIIK

SEQ ID NO: 21558 - protein, 6 aa, synthetic construct
  REGION 1..6: note = Synthetic Construct
KKEILK

SEQ ID NO: 21559 - protein, 6 aa, synthetic construct
  REGION 1..6: note = Synthetic Construct
KKEINK

SEQ ID NO: 21560 - protein, 6 aa, synthetic construct
  REGION 1..6: note = Synthetic Construct
KKEIQK

SEQ ID NO: 21561 - protein, 6 aa, synthetic construct
  REGION 1..6: note = Synthetic Construct
KKEIRK

SEQ ID NO: 21562 - protein, 6 aa, synthetic construct
  REGION 1..6: note = Synthetic Construct
KKEISK

SEQ ID NO: 21563 - protein, 6 aa, synthetic construct
  REGION 1..6: note = Synthetic Construct
KKEITK

SEQ ID NO: 21564 - protein, 6 aa, synthetic construct
  REGION 1..6: note = Synthetic Construct
KKEIYK

SEQ ID NO: 21565 - protein, 6 aa, synthetic construct
  REGION 1..6: note = Synthetic Construct
KKELAK

SEQ ID NO: 21566 - protein, 6 aa, synthetic construct
  REGION 1..6: note = Synthetic Construct
KKELDK

SEQ ID NO: 21567 - protein, 6 aa, synthetic construct
  REGION 1..6: note = Synthetic Construct
KKELEK

SEQ ID NO: 21568 - protein, 6 aa, synthetic construct
  REGION 1..6: note = Synthetic Construct
KKELFK

SEQ ID NO: 21569 - protein, 6 aa, synthetic construct
  REGION 1..6: note = Synthetic Construct
KKELGK

SEQ ID NO: 21570 - protein, 6 aa, synthetic construct
  REGION 1..6: note = Synthetic Construct
KKELHK

SEQ ID NO: 21571 - protein, 6 aa, synthetic construct
  REGION 1..6: note = Synthetic Construct
KKELIK

SEQ ID NO: 21572 - protein, 6 aa, synthetic construct
  REGION 1..6: note = Synthetic Construct
KKELLK

SEQ ID NO: 21573 - protein, 6 aa, synthetic construct
  REGION 1..6: note = Synthetic Construct
KKELNK

SEQ ID NO: 21574 - protein, 6 aa, synthetic construct
  REGION 1..6: note = Synthetic Construct
KKELQK

SEQ ID NO: 21575 - protein, 6 aa, synthetic construct
  REGION 1..6: note = Synthetic Construct
KKELRK

SEQ ID NO: 21576 - protein, 6 aa, synthetic construct
  REGION 1..6: note = Synthetic Construct
KKELSK

SEQ ID NO: 21577 - protein, 6 aa, synthetic construct
  REGION 1..6: note = Synthetic Construct
KKELTK

SEQ ID NO: 21578 - protein, 6 aa, synthetic construct
  REGION 1..6: note = Synthetic Construct
KKELYK

SEQ ID NO: 21579 - protein, 6 aa, synthetic construct
  REGION 1..6: note = Synthetic Construct
KKENAK

SEQ ID NO: 21580 - protein, 6 aa, synthetic construct
  REGION 1..6: note = Synthetic Construct
KKENDK

SEQ ID NO: 21581 - protein, 6 aa, synthetic construct
  REGION 1..6: note = Synthetic Construct
KKENEK

SEQ ID NO: 21582 - protein, 6 aa, synthetic construct
  REGION 1..6: note = Synthetic Construct
KKENFK

SEQ ID NO: 21583 - protein, 6 aa, synthetic construct
  REGION 1..6: note = Synthetic Construct
KKENGK

SEQ ID NO: 21584 - protein, 6 aa, synthetic construct
  REGION 1..6: note = Synthetic Construct
KKENHK

SEQ ID NO: 21585 - protein, 6 aa, synthetic construct
  REGION 1..6: note = Synthetic Construct
KKENIK

SEQ ID NO: 21586 - protein, 6 aa, synthetic construct
  REGION 1..6: note = Synthetic Construct
KKENLK

SEQ ID NO: 21587 - protein, 6 aa, synthetic construct
  REGION 1..6: note = Synthetic Construct
KKENNK

SEQ ID NO: 21588 - protein, 6 aa, synthetic construct
  REGION 1..6: note = Synthetic Construct
KKENQK

SEQ ID NO: 21589 - protein, 6 aa, synthetic construct
  REGION 1..6: note = Synthetic Construct
KKENRK

SEQ ID NO: 21590 - protein, 6 aa, synthetic construct
  REGION 1..6: note = Synthetic Construct
KKENSK

SEQ ID NO: 21591 - protein, 6 aa, synthetic construct
  REGION 1..6: note = Synthetic Construct
KKENTK

SEQ ID NO: 21592 - protein, 6 aa, synthetic construct
  REGION 1..6: note = Synthetic Construct
KKENYK

SEQ ID NO: 21593 - protein, 6 aa, synthetic construct
  REGION 1..6: note = Synthetic Construct
KKEQAK

SEQ ID NO: 21594 - protein, 6 aa, synthetic construct
  REGION 1..6: note = Synthetic Construct
KKEQDK

SEQ ID NO: 21595 - protein, 6 aa, synthetic construct
  REGION 1..6: note = Synthetic Construct
KKEQEK

SEQ ID NO: 21596 - protein, 6 aa, synthetic construct
  REGION 1..6: note = Synthetic Construct
KKEQFK

SEQ ID NO: 21597 - protein, 6 aa, synthetic construct
  REGION 1..6: note = Synthetic Construct
KKEQGK

SEQ ID NO: 21598 - protein, 6 aa, synthetic construct
  REGION 1..6: note = Synthetic Construct
KKEQHK

SEQ ID NO: 21599 - protein, 6 aa, synthetic construct
  REGION 1..6: note = Synthetic Construct
KKEQIK

SEQ ID NO: 21600 - protein, 6 aa, synthetic construct
  REGION 1..6: note = Synthetic Construct
KKEQLK

SEQ ID NO: 21601 - protein, 6 aa, synthetic construct
  REGION 1..6: note = Synthetic Construct
KKEQNK

SEQ ID NO: 21602 - protein, 6 aa, synthetic construct
  REGION 1..6: note = Synthetic Construct
KKEQQK

SEQ ID NO: 21603 - protein, 6 aa, synthetic construct
  REGION 1..6: note = Synthetic Construct
KKEQRK

SEQ ID NO: 21604 - protein, 6 aa, synthetic construct
  REGION 1..6: note = Synthetic Construct
KKEQSK

SEQ ID NO: 21605 - protein, 6 aa, synthetic construct
  REGION 1..6: note = Synthetic Construct
KKEQTK

SEQ ID NO: 21606 - protein, 6 aa, synthetic construct
  REGION 1..6: note = Synthetic Construct
KKEQYK

SEQ ID NO: 21607 - protein, 6 aa, synthetic construct
  REGION 1..6: note = Synthetic Construct
KKERAK

SEQ ID NO: 21608 - protein, 6 aa, synthetic construct
  REGION 1..6: note = Synthetic Construct
KKERDK

SEQ ID NO: 21609 - protein, 6 aa, synthetic construct
  REGION 1..6: note = Synthetic Construct
KKEREK

SEQ ID NO: 21610 - protein, 6 aa, synthetic construct
  REGION 1..6: note = Synthetic Construct
KKERFK

SEQ ID NO: 21611 - protein, 6 aa, synthetic construct
  REGION 1..6: note = Synthetic Construct
KKERGK

SEQ ID NO: 21612 - protein, 6 aa, synthetic construct
  REGION 1..6: note = Synthetic Construct
KKERHK

SEQ ID NO: 21613 - protein, 6 aa, synthetic construct
  REGION 1..6: note = Synthetic Construct
KKERIK

SEQ ID NO: 21614 - protein, 6 aa, synthetic construct
  REGION 1..6: note = Synthetic Construct
KKERLK

SEQ ID NO: 21615 - protein, 6 aa, synthetic construct
  REGION 1..6: note = Synthetic Construct
KKERNK

SEQ ID NO: 21616 - protein, 6 aa, synthetic construct
  REGION 1..6: note = Synthetic Construct
KKERQK

SEQ ID NO: 21617 - protein, 6 aa, synthetic construct
  REGION 1..6: note = Synthetic Construct
KKERRK

SEQ ID NO: 21618 - protein, 6 aa, synthetic construct
  REGION 1..6: note = Synthetic Construct
KKERSK

SEQ ID NO: 21619 - protein, 6 aa, synthetic construct
  REGION 1..6: note = Synthetic Construct
KKERTK

SEQ ID NO: 21620 - protein, 6 aa, synthetic construct
  REGION 1..6: note = Synthetic Construct
KKERYK

SEQ ID NO: 21621 - protein, 6 aa, synthetic construct
  REGION 1..6: note = Synthetic Construct
KKESAK

SEQ ID NO: 21622 - protein, 6 aa, synthetic construct
  REGION 1..6: note = Synthetic Construct
KKESDK

SEQ ID NO: 21623 - protein, 6 aa, synthetic construct
  REGION 1..6: note = Synthetic Construct
KKESEK

SEQ ID NO: 21624 - protein, 6 aa, synthetic construct
  REGION 1..6: note = Synthetic Construct
KKESFK

SEQ ID NO: 21625 - protein, 6 aa, synthetic construct
  REGION 1..6: note = Synthetic Construct
KKESGK

SEQ ID NO: 21626 - protein, 6 aa, synthetic construct
  REGION 1..6: note = Synthetic Construct
KKESHK

SEQ ID NO: 21627 - protein, 6 aa, synthetic construct
  REGION 1..6: note = Synthetic Construct
KKESIK

SEQ ID NO: 21628 - protein, 6 aa, synthetic construct
  REGION 1..6: note = Synthetic Construct
KKESLK

SEQ ID NO: 21629 - protein, 6 aa, synthetic construct
  REGION 1..6: note = Synthetic Construct
KKESNK

SEQ ID NO: 21630 - protein, 6 aa, synthetic construct
  REGION 1..6: note = Synthetic Construct
KKESQK

SEQ ID NO: 21631 - protein, 6 aa, synthetic construct
  REGION 1..6: note = Synthetic Construct
KKESRK

SEQ ID NO: 21632 - protein, 6 aa, synthetic construct
  REGION 1..6: note = Synthetic Construct
KKESSK

SEQ ID NO: 21633 - protein, 6 aa, synthetic construct
  REGION 1..6: note = Synthetic Construct
KKESTK

SEQ ID NO: 21634 - protein, 6 aa, synthetic construct
  REGION 1..6: note = Synthetic Construct
KKESYK

SEQ ID NO: 21635 - protein, 6 aa, synthetic construct
  REGION 1..6: note = Synthetic Construct
KKETAK

SEQ ID NO: 21636 - protein, 6 aa, synthetic construct
  REGION 1..6: note = Synthetic Construct
KKETDK

SEQ ID NO: 21637 - protein, 6 aa, synthetic construct
  REGION 1..6: note = Synthetic Construct
KKETEK

SEQ ID NO: 21638 - protein, 6 aa, synthetic construct
  REGION 1..6: note = Synthetic Construct
KKETFK

SEQ ID NO: 21639 - protein, 6 aa, synthetic construct
  REGION 1..6: note = Synthetic Construct
KKETGK

SEQ ID NO: 21640 - protein, 6 aa, synthetic construct
  REGION 1..6: note = Synthetic Construct
KKETHK

SEQ ID NO: 21641 - protein, 6 aa, synthetic construct
  REGION 1..6: note = Synthetic Construct
KKETIK

SEQ ID NO: 21642 - protein, 6 aa, synthetic construct
  REGION 1..6: note = Synthetic Construct
KKETLK

SEQ ID NO: 21643 - protein, 6 aa, synthetic construct
  REGION 1..6: note = Synthetic Construct
KKETNK

SEQ ID NO: 21644 - protein, 6 aa, synthetic construct
  REGION 1..6: note = Synthetic Construct
KKETQK

SEQ ID NO: 21645 - protein, 6 aa, synthetic construct
  REGION 1..6: note = Synthetic Construct
KKETRK

SEQ ID NO: 21646 - protein, 6 aa, synthetic construct
  REGION 1..6: note = Synthetic Construct
KKETSK

SEQ ID NO: 21647 - protein, 6 aa, synthetic construct
  REGION 1..6: note = Synthetic Construct
KKETTK

SEQ ID NO: 21648 - protein, 6 aa, synthetic construct
  REGION 1..6: note = Synthetic Construct
KKETYK

SEQ ID NO: 21649 - protein, 6 aa, synthetic construct
  REGION 1..6: note = Synthetic Construct
KKEYAK

SEQ ID NO: 21650 - protein, 6 aa, synthetic construct
  REGION 1..6: note = Synthetic Construct
KKEYDK

SEQ ID NO: 21651 - protein, 6 aa, synthetic construct
  REGION 1..6: note = Synthetic Construct
KKEYEK

SEQ ID NO: 21652 - protein, 6 aa, synthetic construct
  REGION 1..6: note = Synthetic Construct
KKEYFK

SEQ ID NO: 21653 - protein, 6 aa, synthetic construct
  REGION 1..6: note = Synthetic Construct
KKEYGK

SEQ ID NO: 21654 - protein, 6 aa, synthetic construct
  REGION 1..6: note = Synthetic Construct
KKEYHK

SEQ ID NO: 21655 - protein, 6 aa, synthetic construct
  REGION 1..6: note = Synthetic Construct
KKEYIK

SEQ ID NO: 21656 - protein, 6 aa, synthetic construct
  REGION 1..6: note = Synthetic Construct
KKEYLK

SEQ ID NO: 21657 - protein, 6 aa, synthetic construct
  REGION 1..6: note = Synthetic Construct
KKEYNK

SEQ ID NO: 21658 - protein, 6 aa, synthetic construct
  REGION 1..6: note = Synthetic Construct
KKEYQK

SEQ ID NO: 21659 - protein, 6 aa, synthetic construct
  REGION 1..6: note = Synthetic Construct
KKEYRK

SEQ ID NO: 21660 - protein, 6 aa, synthetic construct
  REGION 1..6: note = Synthetic Construct
KKEYSK

SEQ ID NO: 21661 - protein, 6 aa, synthetic construct
  REGION 1..6: note = Synthetic Construct
KKEYTK

SEQ ID NO: 21662 - protein, 6 aa, synthetic construct
  REGION 1..6: note = Synthetic Construct
KKEYYK

SEQ ID NO: 21663 - protein, 6 aa, synthetic construct
  REGION 1..6: note = Synthetic Construct
KKFAAK

SEQ ID NO: 21664 - protein, 6 aa, synthetic construct
  REGION 1..6: note = Synthetic Construct
KKFADK

SEQ ID NO: 21665 - protein, 6 aa, synthetic construct
  REGION 1..6: note = Synthetic Construct
KKFAEK

SEQ ID NO: 21666 - protein, 6 aa, synthetic construct
  REGION 1..6: note = Synthetic Construct
KKFAFK

SEQ ID NO: 21667 - protein, 6 aa, synthetic construct
  REGION 1..6: note = Synthetic Construct
KKFAGK

SEQ ID NO: 21668 - protein, 6 aa, synthetic construct
  REGION 1..6: note = Synthetic Construct
KKFAHK

SEQ ID NO: 21669 - protein, 6 aa, synthetic construct
  REGION 1..6: note = Synthetic Construct
KKFAIK

SEQ ID NO: 21670 - protein, 6 aa, synthetic construct
  REGION 1..6: note = Synthetic Construct
KKFALK

SEQ ID NO: 21671 - protein, 6 aa, synthetic construct
  REGION 1..6: note = Synthetic Construct
KKFANK

SEQ ID NO: 21672 - protein, 6 aa, synthetic construct
  REGION 1..6: note = Synthetic Construct
KKFAQK

SEQ ID NO: 21673 - protein, 6 aa, synthetic construct
  REGION 1..6: note = Synthetic Construct
KKFARK

SEQ ID NO: 21674 - protein, 6 aa, synthetic construct
  REGION 1..6: note = Synthetic Construct
KKFASK

SEQ ID NO: 21675 - protein, 6 aa, synthetic construct
  REGION 1..6: note = Synthetic Construct
KKFATK

SEQ ID NO: 21676 - protein, 6 aa, synthetic construct
  REGION 1..6: note = Synthetic Construct
KKFAYK

SEQ ID NO: 21677 - protein, 6 aa, synthetic construct
  REGION 1..6: note = Synthetic Construct
KKFDAK

SEQ ID NO: 21678 - protein, 6 aa, synthetic construct
  REGION 1..6: note = Synthetic Construct
KKFDDK

SEQ ID NO: 21679 - protein, 6 aa, synthetic construct
  REGION 1..6: note = Synthetic Construct
KKFDEK

SEQ ID NO: 21680 - protein, 6 aa, synthetic construct
  REGION 1..6: note = Synthetic Construct
KKFDFK

SEQ ID NO: 21681 - protein, 6 aa, synthetic construct
  REGION 1..6: note = Synthetic Construct
KKFDGK

SEQ ID NO: 21682 - protein, 6 aa, synthetic construct
  REGION 1..6: note = Synthetic Construct
KKFDHK

SEQ ID NO: 21683 - protein, 6 aa, synthetic construct
  REGION 1..6: note = Synthetic Construct
KKFDIK

SEQ ID NO: 21684 - protein, 6 aa, synthetic construct
  REGION 1..6: note = Synthetic Construct
KKFDLK

SEQ ID NO: 21685 - protein, 6 aa, synthetic construct
  REGION 1..6: note = Synthetic Construct
KKFDNK

SEQ ID NO: 21686 - protein, 6 aa, synthetic construct
  REGION 1..6: note = Synthetic Construct
KKFDQK

SEQ ID NO: 21687 - protein, 6 aa, synthetic construct
  REGION 1..6: note = Synthetic Construct
KKFDRK

SEQ ID NO: 21688 - protein, 6 aa, synthetic construct
  REGION 1..6: note = Synthetic Construct
KKFDSK

SEQ ID NO: 21689 - protein, 6 aa, synthetic construct
  REGION 1..6: note = Synthetic Construct
KKFDTK

SEQ ID NO: 21690 - protein, 6 aa, synthetic construct
  REGION 1..6: note = Synthetic Construct
KKFDYK

SEQ ID NO: 21691 - protein, 6 aa, synthetic construct
  REGION 1..6: note = Synthetic Construct
KKFEAK

SEQ ID NO: 21692 - protein, 6 aa, synthetic construct
  REGION 1..6: note = Synthetic Construct
KKFEDK

SEQ ID NO: 21693 - protein, 6 aa, synthetic construct
  REGION 1..6: note = Synthetic Construct
KKFEEK

SEQ ID NO: 21694 - protein, 6 aa, synthetic construct
  REGION 1..6: note = Synthetic Construct
KKFEFK

SEQ ID NO: 21695 - protein, 6 aa, synthetic construct
  REGION 1..6: note = Synthetic Construct
KKFEGK

SEQ ID NO: 21696 - protein, 6 aa, synthetic construct
  REGION 1..6: note = Synthetic Construct
KKFEHK

SEQ ID NO: 21697 - protein, 6 aa, synthetic construct
  REGION 1..6: note = Synthetic Construct
KKFEIK

SEQ ID NO: 21698 - protein, 6 aa, synthetic construct
  REGION 1..6: note = Synthetic Construct
KKFELK

SEQ ID NO: 21699 - protein, 6 aa, synthetic construct
  REGION 1..6: note = Synthetic Construct
KKFENK

SEQ ID NO: 21700 - protein, 6 aa, synthetic construct
  REGION 1..6: note = Synthetic Construct
KKFEQK

SEQ ID NO: 21701 - protein, 6 aa, synthetic construct
  REGION 1..6: note = Synthetic Construct
KKFERK

SEQ ID NO: 21702 - protein, 6 aa, synthetic construct
  REGION 1..6: note = Synthetic Construct
KKFESK

SEQ ID NO: 21703 - protein, 6 aa, synthetic construct
  REGION 1..6: note = Synthetic Construct
KKFETK

SEQ ID NO: 21704 - protein, 6 aa, synthetic construct
  REGION 1..6: note = Synthetic Construct
KKFEYK

SEQ ID NO: 21705 - protein, 6 aa, synthetic construct
  REGION 1..6: note = Synthetic Construct
KKFFAK

SEQ ID NO: 21706 - protein, 6 aa, synthetic construct
  REGION 1..6: note = Synthetic Construct
KKFFDK

SEQ ID NO: 21707 - protein, 6 aa, synthetic construct
  REGION 1..6: note = Synthetic Construct
KKFFEK

SEQ ID NO: 21708 - protein, 6 aa, synthetic construct
  REGION 1..6: note = Synthetic Construct
KKFFFK

SEQ ID NO: 21709 - protein, 6 aa, synthetic construct
  REGION 1..6: note = Synthetic Construct
KKFFGK

SEQ ID NO: 21710 - protein, 6 aa, synthetic construct
  REGION 1..6: note = Synthetic Construct
KKFFHK

SEQ ID NO: 21711 - protein, 6 aa, synthetic construct
  REGION 1..6: note = Synthetic Construct
KKFFIK

SEQ ID NO: 21712 - protein, 6 aa, synthetic construct
  REGION 1..6: note = Synthetic Construct
KKFFLK

SEQ ID NO: 21713 - protein, 6 aa, synthetic construct
  REGION 1..6: note = Synthetic Construct
KKFFNK

SEQ ID NO: 21714 - protein, 6 aa, synthetic construct
  REGION 1..6: note = Synthetic Construct
KKFFQK

SEQ ID NO: 21715 - protein, 6 aa, synthetic construct
  REGION 1..6: note = Synthetic Construct
KKFFRK

SEQ ID NO: 21716 - protein, 6 aa, synthetic construct
  REGION 1..6: note = Synthetic Construct
KKFFSK

SEQ ID NO: 21717 - protein, 6 aa, synthetic construct
  REGION 1..6: note = Synthetic Construct
KKFFTK

SEQ ID NO: 21718 - protein, 6 aa, synthetic construct
  REGION 1..6: note = Synthetic Construct
KKFFYK

SEQ ID NO: 21719 - protein, 6 aa, synthetic construct
  REGION 1..6: note = Synthetic Construct
KKFGAK

SEQ ID NO: 21720 - protein, 6 aa, synthetic construct
  REGION 1..6: note = Synthetic Construct
KKFGDK

SEQ ID NO: 21721 - protein, 6 aa, synthetic construct
  REGION 1..6: note = Synthetic Construct
KKFGEK

SEQ ID NO: 21722 - protein, 6 aa, synthetic construct
  REGION 1..6: note = Synthetic Construct
KKFGFK

SEQ ID NO: 21723 - protein, 6 aa, synthetic construct
  REGION 1..6: note = Synthetic Construct
KKFGGK

SEQ ID NO: 21724 - protein, 6 aa, synthetic construct
  REGION 1..6: note = Synthetic Construct
KKFGHK

SEQ ID NO: 21725 - protein, 6 aa, synthetic construct
  REGION 1..6: note = Synthetic Construct
KKFGIK

SEQ ID NO: 21726 - protein, 6 aa, synthetic construct
  REGION 1..6: note = Synthetic Construct
KKFGLK

SEQ ID NO: 21727 - protein, 6 aa, synthetic construct
  REGION 1..6: note = Synthetic Construct
KKFGNK

SEQ ID NO: 21728 - protein, 6 aa, synthetic construct
  REGION 1..6: note = Synthetic Construct
KKFGQK

SEQ ID NO: 21729 - protein, 6 aa, synthetic construct
  REGION 1..6: note = Synthetic Construct
KKFGRK

SEQ ID NO: 21730 - protein, 6 aa, synthetic construct
  REGION 1..6: note = Synthetic Construct
KKFGSK

SEQ ID NO: 21731 - protein, 6 aa, synthetic construct
  REGION 1..6: note = Synthetic Construct
KKFGTK

SEQ ID NO: 21732 - protein, 6 aa, synthetic construct
  REGION 1..6: note = Synthetic Construct
KKFGYK

SEQ ID NO: 21733 - protein, 6 aa, synthetic construct
  REGION 1..6: note = Synthetic Construct
KKFHAK

SEQ ID NO: 21734 - protein, 6 aa, synthetic construct
  REGION 1..6: note = Synthetic Construct
KKFHDK

SEQ ID NO: 21735 - protein, 6 aa, synthetic construct
  REGION 1..6: note = Synthetic Construct
KKFHEK

SEQ ID NO: 21736 - protein, 6 aa, synthetic construct
  REGION 1..6: note = Synthetic Construct
KKFHFK

SEQ ID NO: 21737 - protein, 6 aa, synthetic construct
  REGION 1..6: note = Synthetic Construct
KKFHGK

SEQ ID NO: 21738 - protein, 6 aa, synthetic construct
  REGION 1..6: note = Synthetic Construct
KKFHHK

SEQ ID NO: 21739 - protein, 6 aa, synthetic construct
  REGION 1..6: note = Synthetic Construct
KKFHIK

SEQ ID NO: 21740 - protein, 6 aa, synthetic construct
  REGION 1..6: note = Synthetic Construct
KKFHLK

SEQ ID NO: 21741 - protein, 6 aa, synthetic construct
  REGION 1..6: note = Synthetic Construct
KKFHNK

SEQ ID NO: 21742 - protein, 6 aa, synthetic construct
  REGION 1..6: note = Synthetic Construct
KKFHQK

SEQ ID NO: 21743 - protein, 6 aa, synthetic construct
  REGION 1..6: note = Synthetic Construct
KKFHRK

SEQ ID NO: 21744 - protein, 6 aa, synthetic construct
  REGION 1..6: note = Synthetic Construct
KKFHSK

SEQ ID NO: 21745 - protein, 6 aa, synthetic construct
  REGION 1..6: note = Synthetic Construct
KKFHTK

SEQ ID NO: 21746 - protein, 6 aa, synthetic construct
  REGION 1..6: note = Synthetic Construct
KKFHYK

SEQ ID NO: 21747 - protein, 6 aa, synthetic construct
  REGION 1..6: note = Synthetic Construct
KKFIAK

SEQ ID NO: 21748 - protein, 6 aa, synthetic construct
  REGION 1..6: note = Synthetic Construct
KKFIDK

SEQ ID NO: 21749 - protein, 6 aa, synthetic construct
  REGION 1..6: note = Synthetic Construct
KKFIEK

SEQ ID NO: 21750 - protein, 6 aa, synthetic construct
  REGION 1..6: note = Synthetic Construct
KKFIFK

SEQ ID NO: 21751 - protein, 6 aa, synthetic construct
  REGION 1..6: note = Synthetic Construct
KKFIGK

SEQ ID NO: 21752 - protein, 6 aa, synthetic construct
  REGION 1..6: note = Synthetic Construct
KKFIHK

SEQ ID NO: 21753 - protein, 6 aa, synthetic construct
  REGION 1..6: note = Synthetic Construct
KKFIIK

SEQ ID NO: 21754 - protein, 6 aa, synthetic construct
  REGION 1..6: note = Synthetic Construct
KKFILK

SEQ ID NO: 21755 - protein, 6 aa, synthetic construct
  REGION 1..6: note = Synthetic Construct
KKFINK

SEQ ID NO: 21756 - protein, 6 aa, synthetic construct
  REGION 1..6: note = Synthetic Construct
KKFIQK

SEQ ID NO: 21757 - protein, 6 aa, synthetic construct
  REGION 1..6: note = Synthetic Construct
KKFIRK

SEQ ID NO: 21758 - protein, 6 aa, synthetic construct
  REGION 1..6: note = Synthetic Construct
KKFISK

SEQ ID NO: 21759 - protein, 6 aa, synthetic construct
  REGION 1..6: note = Synthetic Construct
KKFITK

SEQ ID NO: 21760 - protein, 6 aa, synthetic construct
  REGION 1..6: note = Synthetic Construct
KKFIYK

SEQ ID NO: 21761 - protein, 6 aa, synthetic construct
  REGION 1..6: note = Synthetic Construct
KKFLAK

SEQ ID NO: 21762 - protein, 6 aa, synthetic construct
  REGION 1..6: note = Synthetic Construct
KKFLDK

SEQ ID NO: 21763 - protein, 6 aa, synthetic construct
  REGION 1..6: note = Synthetic Construct
KKFLEK

SEQ ID NO: 21764 - protein, 6 aa, synthetic construct
  REGION 1..6: note = Synthetic Construct
KKFLFK

SEQ ID NO: 21765 - protein, 6 aa, synthetic construct
  REGION 1..6: note = Synthetic Construct
KKFLGK

SEQ ID NO: 21766 - protein, 6 aa, synthetic construct
  REGION 1..6: note = Synthetic Construct
KKFLHK

SEQ ID NO: 21767 - protein, 6 aa, synthetic construct
  REGION 1..6: note = Synthetic Construct
KKFLIK

SEQ ID NO: 21768 - protein, 6 aa, synthetic construct
  REGION 1..6: note = Synthetic Construct
KKFLLK

SEQ ID NO: 21769 - protein, 6 aa, synthetic construct
  REGION 1..6: note = Synthetic Construct
KKFLNK

SEQ ID NO: 21770 - protein, 6 aa, synthetic construct
  REGION 1..6: note = Synthetic Construct
KKFLQK

SEQ ID NO: 21771 - protein, 6 aa, synthetic construct
  REGION 1..6: note = Synthetic Construct
KKFLRK

SEQ ID NO: 21772 - protein, 6 aa, synthetic construct
  REGION 1..6: note = Synthetic Construct
KKFLSK

SEQ ID NO: 21773 - protein, 6 aa, synthetic construct
  REGION 1..6: note = Synthetic Construct
KKFLTK

SEQ ID NO: 21774 - protein, 6 aa, synthetic construct
  REGION 1..6: note = Synthetic Construct
KKFLYK

SEQ ID NO: 21775 - protein, 6 aa, synthetic construct
  REGION 1..6: note = Synthetic Construct
KKFNAK

SEQ ID NO: 21776 - protein, 6 aa, synthetic construct
  REGION 1..6: note = Synthetic Construct
KKFNDK

SEQ ID NO: 21777 - protein, 6 aa, synthetic construct
  REGION 1..6: note = Synthetic Construct
KKFNEK

SEQ ID NO: 21778 - protein, 6 aa, synthetic construct
  REGION 1..6: note = Synthetic Construct
KKFNFK

SEQ ID NO: 21779 - protein, 6 aa, synthetic construct
  REGION 1..6: note = Synthetic Construct
KKFNGK

SEQ ID NO: 21780 - protein, 6 aa, synthetic construct
  REGION 1..6: note = Synthetic Construct
KKFNHK

SEQ ID NO: 21781 - protein, 6 aa, synthetic construct
  REGION 1..6: note = Synthetic Construct
KKFNIK

SEQ ID NO: 21782 - protein, 6 aa, synthetic construct
  REGION 1..6: note = Synthetic Construct
KKFNLK

SEQ ID NO: 21783 - protein, 6 aa, synthetic construct
  REGION 1..6: note = Synthetic Construct
KKFNNK

SEQ ID NO: 21784 - protein, 6 aa, synthetic construct
  REGION 1..6: note = Synthetic Construct
KKFNQK

SEQ ID NO: 21785 - protein, 6 aa, synthetic construct
  REGION 1..6: note = Synthetic Construct
KKFNRK

SEQ ID NO: 21786 - protein, 6 aa, synthetic construct
  REGION 1..6: note = Synthetic Construct
KKFNSK

SEQ ID NO: 21787 - protein, 6 aa, synthetic construct
  REGION 1..6: note = Synthetic Construct
KKFNTK

SEQ ID NO: 21788 - protein, 6 aa, synthetic construct
  REGION 1..6: note = Synthetic Construct
KKFNYK

SEQ ID NO: 21789 - protein, 6 aa, synthetic construct
  REGION 1..6: note = Synthetic Construct
KKFQAK

SEQ ID NO: 21790 - protein, 6 aa, synthetic construct
  REGION 1..6: note = Synthetic Construct
KKFQDK

SEQ ID NO: 21791 - protein, 6 aa, synthetic construct
  REGION 1..6: note = Synthetic Construct
KKFQEK

SEQ ID NO: 21792 - protein, 6 aa, synthetic construct
  REGION 1..6: note = Synthetic Construct
KKFQFK

SEQ ID NO: 21793 - protein, 6 aa, synthetic construct
  REGION 1..6: note = Synthetic Construct
KKFQGK

SEQ ID NO: 21794 - protein, 6 aa, synthetic construct
  REGION 1..6: note = Synthetic Construct
KKFQHK

SEQ ID NO: 21795 - protein, 6 aa, synthetic construct
  REGION 1..6: note = Synthetic Construct
KKFQIK

SEQ ID NO: 21796 - protein, 6 aa, synthetic construct
  REGION 1..6: note = Synthetic Construct
KKFQLK

SEQ ID NO: 21797 - protein, 6 aa, synthetic construct
  REGION 1..6: note = Synthetic Construct
KKFQNK

SEQ ID NO: 21798 - protein, 6 aa, synthetic construct
  REGION 1..6: note = Synthetic Construct
KKFQQK

SEQ ID NO: 21799 - protein, 6 aa, synthetic construct
  REGION 1..6: note = Synthetic Construct
KKFQRK

SEQ ID NO: 21800 - protein, 6 aa, synthetic construct
  REGION 1..6: note = Synthetic Construct
KKFQSK

SEQ ID NO: 21801 - protein, 6 aa, synthetic construct
  REGION 1..6: note = Synthetic Construct
KKFQTK

SEQ ID NO: 21802 - protein, 6 aa, synthetic construct
  REGION 1..6: note = Synthetic Construct
KKFQYK

SEQ ID NO: 21803 - protein, 6 aa, synthetic construct
  REGION 1..6: note = Synthetic Construct
KKFRAK

SEQ ID NO: 21804 - protein, 6 aa, synthetic construct
  REGION 1..6: note = Synthetic Construct
KKFRDK

SEQ ID NO: 21805 - protein, 6 aa, synthetic construct
  REGION 1..6: note = Synthetic Construct
KKFREK

SEQ ID NO: 21806 - protein, 6 aa, synthetic construct
  REGION 1..6: note = Synthetic Construct
KKFRFK

SEQ ID NO: 21807 - protein, 6 aa, synthetic construct
  REGION 1..6: note = Synthetic Construct
KKFRGK

SEQ ID NO: 21808 - protein, 6 aa, synthetic construct
  REGION 1..6: note = Synthetic Construct
KKFRHK

SEQ ID NO: 21809 - protein, 6 aa, synthetic construct
  REGION 1..6: note = Synthetic Construct
KKFRIK

SEQ ID NO: 21810 - protein, 6 aa, synthetic construct
  REGION 1..6: note = Synthetic Construct
KKFRLK

SEQ ID NO: 21811 - protein, 6 aa, synthetic construct
  REGION 1..6: note = Synthetic Construct
KKFRNK

SEQ ID NO: 21812 - protein, 6 aa, synthetic construct
  REGION 1..6: note = Synthetic Construct
KKFRQK

SEQ ID NO: 21813 - protein, 6 aa, synthetic construct
  REGION 1..6: note = Synthetic Construct
KKFRRK

SEQ ID NO: 21814 - protein, 6 aa, synthetic construct
  REGION 1..6: note = Synthetic Construct
KKFRSK

SEQ ID NO: 21815 - protein, 6 aa, synthetic construct
  REGION 1..6: note = Synthetic Construct
KKFRTK

SEQ ID NO: 21816 - protein, 6 aa, synthetic construct
  REGION 1..6: note = Synthetic Construct
KKFRYK

SEQ ID NO: 21817 - protein, 6 aa, synthetic construct
  REGION 1..6: note = Synthetic Construct
KKFSAK

SEQ ID NO: 21818 - protein, 6 aa, synthetic construct
  REGION 1..6: note = Synthetic Construct
KKFSDK

SEQ ID NO: 21819 - protein, 6 aa, synthetic construct
  REGION 1..6: note = Synthetic Construct
KKFSEK

SEQ ID NO: 21820 - protein, 6 aa, synthetic construct
  REGION 1..6: note = Synthetic Construct
KKFSFK

SEQ ID NO: 21821 - protein, 6 aa, synthetic construct
  REGION 1..6: note = Synthetic Construct
KKFSGK

SEQ ID NO: 21822 - protein, 6 aa, synthetic construct
  REGION 1..6: note = Synthetic Construct
KKFSHK

SEQ ID NO: 21823 - protein, 6 aa, synthetic construct
  REGION 1..6: note = Synthetic Construct
KKFSIK

SEQ ID NO: 21824 - protein, 6 aa, synthetic construct
  REGION 1..6: note = Synthetic Construct
KKFSLK

SEQ ID NO: 21825 - protein, 6 aa, synthetic construct
  REGION 1..6: note = Synthetic Construct
KKFSNK

SEQ ID NO: 21826 - protein, 6 aa, synthetic construct
  REGION 1..6: note = Synthetic Construct
KKFSQK

SEQ ID NO: 21827 - protein, 6 aa, synthetic construct
  REGION 1..6: note = Synthetic Construct
KKFSRK

SEQ ID NO: 21828 - protein, 6 aa, synthetic construct
  REGION 1..6: note = Synthetic Construct
KKFSSK

SEQ ID NO: 21829 - protein, 6 aa, synthetic construct
  REGION 1..6: note = Synthetic Construct
KKFSTK

SEQ ID NO: 21830 - protein, 6 aa, synthetic construct
  REGION 1..6: note = Synthetic Construct
KKFSYK

SEQ ID NO: 21831 - protein, 6 aa, synthetic construct
  REGION 1..6: note = Synthetic Construct
KKFTAK

SEQ ID NO: 21832 - protein, 6 aa, synthetic construct
  REGION 1..6: note = Synthetic Construct
KKFTDK

SEQ ID NO: 21833 - protein, 6 aa, synthetic construct
  REGION 1..6: note = Synthetic Construct
KKFTEK

SEQ ID NO: 21834 - protein, 6 aa, synthetic construct
  REGION 1..6: note = Synthetic Construct
KKFTFK

SEQ ID NO: 21835 - protein, 6 aa, synthetic construct
  REGION 1..6: note = Synthetic Construct
KKFTGK

SEQ ID NO: 21836 - protein, 6 aa, synthetic construct
  REGION 1..6: note = Synthetic Construct
KKFTHK

SEQ ID NO: 21837 - protein, 6 aa, synthetic construct
  REGION 1..6: note = Synthetic Construct
KKFTIK

SEQ ID NO: 21838 - protein, 6 aa, synthetic construct
  REGION 1..6: note = Synthetic Construct
KKFTLK

SEQ ID NO: 21839 - protein, 6 aa, synthetic construct
  REGION 1..6: note = Synthetic Construct
KKFTNK

SEQ ID NO: 21840 - protein, 6 aa, synthetic construct
  REGION 1..6: note = Synthetic Construct
KKFTQK

SEQ ID NO: 21841 - protein, 6 aa, synthetic construct
  REGION 1..6: note = Synthetic Construct
KKFTRK

SEQ ID NO: 21842 - protein, 6 aa, synthetic construct
  REGION 1..6: note = Synthetic Construct
KKFTSK

SEQ ID NO: 21843 - protein, 6 aa, synthetic construct
  REGION 1..6: note = Synthetic Construct
KKFTTK

SEQ ID NO: 21844 - protein, 6 aa, synthetic construct
  REGION 1..6: note = Synthetic Construct
KKFTYK

SEQ ID NO: 21845 - protein, 6 aa, synthetic construct
  REGION 1..6: note = Synthetic Construct
KKFYAK

SEQ ID NO: 21846 - protein, 6 aa, synthetic construct
  REGION 1..6: note = Synthetic Construct
KKFYDK

SEQ ID NO: 21847 - protein, 6 aa, synthetic construct
  REGION 1..6: note = Synthetic Construct
KKFYEK

SEQ ID NO: 21848 - protein, 6 aa, synthetic construct
  REGION 1..6: note = Synthetic Construct
KKFYFK

SEQ ID NO: 21849 - protein, 6 aa, synthetic construct
  REGION 1..6: note = Synthetic Construct
KKFYGK

SEQ ID NO: 21850 - protein, 6 aa, synthetic construct
  REGION 1..6: note = Synthetic Construct
KKFYHK

SEQ ID NO: 21851 - protein, 6 aa, synthetic construct
  REGION 1..6: note = Synthetic Construct
KKFYIK

SEQ ID NO: 21852 - protein, 6 aa, synthetic construct
  REGION 1..6: note = Synthetic Construct
KKFYLK

SEQ ID NO: 21853 - protein, 6 aa, synthetic construct
  REGION 1..6: note = Synthetic Construct
KKFYNK

SEQ ID NO: 21854 - protein, 6 aa, synthetic construct
  REGION 1..6: note = Synthetic Construct
KKFYQK

SEQ ID NO: 21855 - protein, 6 aa, synthetic construct
  REGION 1..6: note = Synthetic Construct
KKFYRK

SEQ ID NO: 21856 - protein, 6 aa, synthetic construct
  REGION 1..6: note = Synthetic Construct
KKFYSK

SEQ ID NO: 21857 - protein, 6 aa, synthetic construct
  REGION 1..6: note = Synthetic Construct
KKFYTK

SEQ ID NO: 21858 - protein, 6 aa, synthetic construct
  REGION 1..6: note = Synthetic Construct
KKFYYK

SEQ ID NO: 21859 - protein, 6 aa, synthetic construct
  REGION 1..6: note = Synthetic Construct
KKGAAK

SEQ ID NO: 21860 - protein, 6 aa, synthetic construct
  REGION 1..6: note = Synthetic Construct
KKGADK

SEQ ID NO: 21861 - protein, 6 aa, synthetic construct
  REGION 1..6: note = Synthetic Construct
KKGAEK

SEQ ID NO: 21862 - protein, 6 aa, synthetic construct
  REGION 1..6: note = Synthetic Construct
KKGAFK

SEQ ID NO: 21863 - protein, 6 aa, synthetic construct
  REGION 1..6: note = Synthetic Construct
KKGAGK

SEQ ID NO: 21864 - protein, 6 aa, synthetic construct
  REGION 1..6: note = Synthetic Construct
KKGAHK

SEQ ID NO: 21865 - protein, 6 aa, synthetic construct
  REGION 1..6: note = Synthetic Construct
KKGAIK

SEQ ID NO: 21866 - protein, 6 aa, synthetic construct
  REGION 1..6: note = Synthetic Construct
KKGALK

SEQ ID NO: 21867 - protein, 6 aa, synthetic construct
  REGION 1..6: note = Synthetic Construct
KKGANK

SEQ ID NO: 21868 - protein, 6 aa, synthetic construct
  REGION 1..6: note = Synthetic Construct
KKGAQK

SEQ ID NO: 21869 - protein, 6 aa, synthetic construct
  REGION 1..6: note = Synthetic Construct
KKGARK

SEQ ID NO: 21870 - protein, 6 aa, synthetic construct
  REGION 1..6: note = Synthetic Construct
KKGASK

SEQ ID NO: 21871 - protein, 6 aa, synthetic construct
  REGION 1..6: note = Synthetic Construct
KKGATK

SEQ ID NO: 21872 - protein, 6 aa, synthetic construct
  REGION 1..6: note = Synthetic Construct
KKGAYK

SEQ ID NO: 21873 - protein, 6 aa, synthetic construct
  REGION 1..6: note = Synthetic Construct
KKGDAK

SEQ ID NO: 21874 - protein, 6 aa, synthetic construct
  REGION 1..6: note = Synthetic Construct
KKGDDK

SEQ ID NO: 21875 - protein, 6 aa, synthetic construct
  REGION 1..6: note = Synthetic Construct
KKGDEK

SEQ ID NO: 21876 - protein, 6 aa, synthetic construct
  REGION 1..6: note = Synthetic Construct
KKGDFK

SEQ ID NO: 21877 - protein, 6 aa, synthetic construct
  REGION 1..6: note = Synthetic Construct
KKGDGK

SEQ ID NO: 21878 - protein, 6 aa, synthetic construct
  REGION 1..6: note = Synthetic Construct
KKGDHK

SEQ ID NO: 21879 - protein, 6 aa, synthetic construct
  REGION 1..6: note = Synthetic Construct
KKGDIK

SEQ ID NO: 21880 - protein, 6 aa, synthetic construct
  REGION 1..6: note = Synthetic Construct
KKGDLK

SEQ ID NO: 21881 - protein, 6 aa, synthetic construct
  REGION 1..6: note = Synthetic Construct
KKGDNK

SEQ ID NO: 21882 - protein, 6 aa, synthetic construct
  REGION 1..6: note = Synthetic Construct
KKGDQK

SEQ ID NO: 21883 - protein, 6 aa, synthetic construct
  REGION 1..6: note = Synthetic Construct
KKGDRK

SEQ ID NO: 21884 - protein, 6 aa, synthetic construct
  REGION 1..6: note = Synthetic Construct
KKGDSK

SEQ ID NO: 21885 - protein, 6 aa, synthetic construct
  REGION 1..6: note = Synthetic Construct
KKGDTK

SEQ ID NO: 21886 - protein, 6 aa, synthetic construct
  REGION 1..6: note = Synthetic Construct
KKGDYK

SEQ ID NO: 21887 - protein, 6 aa, synthetic construct
  REGION 1..6: note = Synthetic Construct
KKGEAK

SEQ ID NO: 21888 - protein, 6 aa, synthetic construct
  REGION 1..6: note = Synthetic Construct
KKGEDK

SEQ ID NO: 21889 - protein, 6 aa, synthetic construct
  REGION 1..6: note = Synthetic Construct
KKGEEK

SEQ ID NO: 21890 - protein, 6 aa, synthetic construct
  REGION 1..6: note = Synthetic Construct
KKGEFK

SEQ ID NO: 21891 - protein, 6 aa, synthetic construct
  REGION 1..6: note = Synthetic Construct
KKGEGK

SEQ ID NO: 21892 - protein, 6 aa, synthetic construct
  REGION 1..6: note = Synthetic Construct
KKGEHK

SEQ ID NO: 21893 - protein, 6 aa, synthetic construct
  REGION 1..6: note = Synthetic Construct
KKGEIK

SEQ ID NO: 21894 - protein, 6 aa, synthetic construct
  REGION 1..6: note = Synthetic Construct
KKGELK

SEQ ID NO: 21895 - protein, 6 aa, synthetic construct
  REGION 1..6: note = Synthetic Construct
KKGENK

SEQ ID NO: 21896 - protein, 6 aa, synthetic construct
  REGION 1..6: note = Synthetic Construct
KKGEQK

SEQ ID NO: 21897 - protein, 6 aa, synthetic construct
  REGION 1..6: note = Synthetic Construct
KKGERK

SEQ ID NO: 21898 - protein, 6 aa, synthetic construct
  REGION 1..6: note = Synthetic Construct
KKGESK

SEQ ID NO: 21899 - protein, 6 aa, synthetic construct
  REGION 1..6: note = Synthetic Construct
KKGETK

SEQ ID NO: 21900 - protein, 6 aa, synthetic construct
  REGION 1..6: note = Synthetic Construct
KKGEYK

SEQ ID NO: 21901 - protein, 6 aa, synthetic construct
  REGION 1..6: note = Synthetic Construct
KKGFAK

SEQ ID NO: 21902 - protein, 6 aa, synthetic construct
  REGION 1..6: note = Synthetic Construct
KKGFDK

SEQ ID NO: 21903 - protein, 6 aa, synthetic construct
  REGION 1..6: note = Synthetic Construct
KKGFEK

SEQ ID NO: 21904 - protein, 6 aa, synthetic construct
  REGION 1..6: note = Synthetic Construct
KKGFFK

SEQ ID NO: 21905 - protein, 6 aa, synthetic construct
  REGION 1..6: note = Synthetic Construct
KKGFGK

SEQ ID NO: 21906 - protein, 6 aa, synthetic construct
  REGION 1..6: note = Synthetic Construct
KKGFHK

SEQ ID NO: 21907 - protein, 6 aa, synthetic construct
  REGION 1..6: note = Synthetic Construct
KKGFIK

SEQ ID NO: 21908 - protein, 6 aa, synthetic construct
  REGION 1..6: note = Synthetic Construct
KKGFLK

SEQ ID NO: 21909 - protein, 6 aa, synthetic construct
  REGION 1..6: note = Synthetic Construct
KKGFNK

SEQ ID NO: 21910 - protein, 6 aa, synthetic construct
  REGION 1..6: note = Synthetic Construct
KKGFQK

SEQ ID NO: 21911 - protein, 6 aa, synthetic construct
  REGION 1..6: note = Synthetic Construct
KKGFRK

SEQ ID NO: 21912 - protein, 6 aa, synthetic construct
  REGION 1..6: note = Synthetic Construct
KKGFSK

SEQ ID NO: 21913 - protein, 6 aa, synthetic construct
  REGION 1..6: note = Synthetic Construct
KKGFTK

SEQ ID NO: 21914 - protein, 6 aa, synthetic construct
  REGION 1..6: note = Synthetic Construct
KKGFYK

SEQ ID NO: 21915 - protein, 6 aa, synthetic construct
  REGION 1..6: note = Synthetic Construct
KKGGAK

SEQ ID NO: 21916 - protein, 6 aa, synthetic construct
  REGION 1..6: note = Synthetic Construct
KKGGDK

SEQ ID NO: 21917 - protein, 6 aa, synthetic construct
  REGION 1..6: note = Synthetic Construct
KKGGEK

SEQ ID NO: 21918 - protein, 6 aa, synthetic construct
  REGION 1..6: note = Synthetic Construct
KKGGFK

SEQ ID NO: 21919 - protein, 6 aa, synthetic construct
  REGION 1..6: note = Synthetic Construct
KKGGGK

SEQ ID NO: 21920 - protein, 6 aa, synthetic construct
  REGION 1..6: note = Synthetic Construct
KKGGHK

SEQ ID NO: 21921 - protein, 6 aa, synthetic construct
  REGION 1..6: note = Synthetic Construct
KKGGIK

SEQ ID NO: 21922 - protein, 6 aa, synthetic construct
  REGION 1..6: note = Synthetic Construct
KKGGLK

SEQ ID NO: 21923 - protein, 6 aa, synthetic construct
  REGION 1..6: note = Synthetic Construct
KKGGNK

SEQ ID NO: 21924 - protein, 6 aa, synthetic construct
  REGION 1..6: note = Synthetic Construct
KKGGQK

SEQ ID NO: 21925 - protein, 6 aa, synthetic construct
  REGION 1..6: note = Synthetic Construct
KKGGRK

SEQ ID NO: 21926 - protein, 6 aa, synthetic construct
  REGION 1..6: note = Synthetic Construct
KKGGSK

SEQ ID NO: 21927 - protein, 6 aa, synthetic construct
  REGION 1..6: note = Synthetic Construct
KKGGTK

SEQ ID NO: 21928 - protein, 6 aa, synthetic construct
  REGION 1..6: note = Synthetic Construct
KKGGYK

SEQ ID NO: 21929 - protein, 6 aa, synthetic construct
  REGION 1..6: note = Synthetic Construct
KKGHAK

SEQ ID NO: 21930 - protein, 6 aa, synthetic construct
  REGION 1..6: note = Synthetic Construct
KKGHDK

SEQ ID NO: 21931 - protein, 6 aa, synthetic construct
  REGION 1..6: note = Synthetic Construct
KKGHEK

SEQ ID NO: 21932 - protein, 6 aa, synthetic construct
  REGION 1..6: note = Synthetic Construct
KKGHFK

SEQ ID NO: 21933 - protein, 6 aa, synthetic construct
  REGION 1..6: note = Synthetic Construct
KKGHGK

SEQ ID NO: 21934 - protein, 6 aa, synthetic construct
  REGION 1..6: note = Synthetic Construct
KKGHHK

SEQ ID NO: 21935 - protein, 6 aa, synthetic construct
  REGION 1..6: note = Synthetic Construct
KKGHIK

SEQ ID NO: 21936 - protein, 6 aa, synthetic construct
  REGION 1..6: note = Synthetic Construct
KKGHLK

SEQ ID NO: 21937 - protein, 6 aa, synthetic construct
  REGION 1..6: note = Synthetic Construct
KKGHNK

SEQ ID NO: 21938 - protein, 6 aa, synthetic construct
  REGION 1..6: note = Synthetic Construct
KKGHQK

SEQ ID NO: 21939 - protein, 6 aa, synthetic construct
  REGION 1..6: note = Synthetic Construct
KKGHRK

SEQ ID NO: 21940 - protein, 6 aa, synthetic construct
  REGION 1..6: note = Synthetic Construct
KKGHSK

SEQ ID NO: 21941 - protein, 6 aa, synthetic construct
  REGION 1..6: note = Synthetic Construct
KKGHTK

SEQ ID NO: 21942 - protein, 6 aa, synthetic construct
  REGION 1..6: note = Synthetic Construct
KKGHYK

SEQ ID NO: 21943 - protein, 6 aa, synthetic construct
  REGION 1..6: note = Synthetic Construct
KKGIAK

SEQ ID NO: 21944 - protein, 6 aa, synthetic construct
  REGION 1..6: note = Synthetic Construct
KKGIDK

SEQ ID NO: 21945 - protein, 6 aa, synthetic construct
  REGION 1..6: note = Synthetic Construct
KKGIEK

SEQ ID NO: 21946 - protein, 6 aa, synthetic construct
  REGION 1..6: note = Synthetic Construct
KKGIFK

SEQ ID NO: 21947 - protein, 6 aa, synthetic construct
  REGION 1..6: note = Synthetic Construct
KKGIGK

SEQ ID NO: 21948 - protein, 6 aa, synthetic construct
  REGION 1..6: note = Synthetic Construct
KKGIHK

SEQ ID NO: 21949 - protein, 6 aa, synthetic construct
  REGION 1..6: note = Synthetic Construct
KKGIIK

SEQ ID NO: 21950 - protein, 6 aa, synthetic construct
  REGION 1..6: note = Synthetic Construct
KKGILK

SEQ ID NO: 21951 - protein, 6 aa, synthetic construct
  REGION 1..6: note = Synthetic Construct
KKGINK

SEQ ID NO: 21952 - protein, 6 aa, synthetic construct
  REGION 1..6: note = Synthetic Construct
KKGIQK

SEQ ID NO: 21953 - protein, 6 aa, synthetic construct
  REGION 1..6: note = Synthetic Construct
KKGIRK

SEQ ID NO: 21954 - protein, 6 aa, synthetic construct
  REGION 1..6: note = Synthetic Construct
KKGISK

SEQ ID NO: 21955 - protein, 6 aa, synthetic construct
  REGION 1..6: note = Synthetic Construct
KKGITK

SEQ ID NO: 21956 - protein, 6 aa, synthetic construct
  REGION 1..6: note = Synthetic Construct
KKGIYK

SEQ ID NO: 21957 - protein, 6 aa, synthetic construct
  REGION 1..6: note = Synthetic Construct
KKGLAK

SEQ ID NO: 21958 - protein, 6 aa, synthetic construct
  REGION 1..6: note = Synthetic Construct
KKGLDK

SEQ ID NO: 21959 - protein, 6 aa, synthetic construct
  REGION 1..6: note = Synthetic Construct
KKGLEK

SEQ ID NO: 21960 - protein, 6 aa, synthetic construct
  REGION 1..6: note = Synthetic Construct
KKGLFK

SEQ ID NO: 21961 - protein, 6 aa, synthetic construct
  REGION 1..6: note = Synthetic Construct
KKGLGK

SEQ ID NO: 21962 - protein, 6 aa, synthetic construct
  REGION 1..6: note = Synthetic Construct
KKGLHK

SEQ ID NO: 21963 - protein, 6 aa, synthetic construct
  REGION 1..6: note = Synthetic Construct
KKGLIK

SEQ ID NO: 21964 - protein, 6 aa, synthetic construct
  REGION 1..6: note = Synthetic Construct
KKGLLK

SEQ ID NO: 21965 - protein, 6 aa, synthetic construct
  REGION 1..6: note = Synthetic Construct
KKGLNK

SEQ ID NO: 21966 - protein, 6 aa, synthetic construct
  REGION 1..6: note = Synthetic Construct
KKGLQK

SEQ ID NO: 21967 - protein, 6 aa, synthetic construct
  REGION 1..6: note = Synthetic Construct
KKGLRK

SEQ ID NO: 21968 - protein, 6 aa, synthetic construct
  REGION 1..6: note = Synthetic Construct
KKGLSK

SEQ ID NO: 21969 - protein, 6 aa, synthetic construct
  REGION 1..6: note = Synthetic Construct
KKGLTK

SEQ ID NO: 21970 - protein, 6 aa, synthetic construct
  REGION 1..6: note = Synthetic Construct
KKGLYK

SEQ ID NO: 21971 - protein, 6 aa, synthetic construct
  REGION 1..6: note = Synthetic Construct
KKGNAK

SEQ ID NO: 21972 - protein, 6 aa, synthetic construct
  REGION 1..6: note = Synthetic Construct
KKGNDK

SEQ ID NO: 21973 - protein, 6 aa, synthetic construct
  REGION 1..6: note = Synthetic Construct
KKGNEK

SEQ ID NO: 21974 - protein, 6 aa, synthetic construct
  REGION 1..6: note = Synthetic Construct
KKGNFK

SEQ ID NO: 21975 - protein, 6 aa, synthetic construct
  REGION 1..6: note = Synthetic Construct
KKGNGK

SEQ ID NO: 21976 - protein, 6 aa, synthetic construct
  REGION 1..6: note = Synthetic Construct
KKGNHK

SEQ ID NO: 21977 - protein, 6 aa, synthetic construct
  REGION 1..6: note = Synthetic Construct
KKGNIK

SEQ ID NO: 21978 - protein, 6 aa, synthetic construct
  REGION 1..6: note = Synthetic Construct
KKGNLK

SEQ ID NO: 21979 - protein, 6 aa, synthetic construct
  REGION 1..6: note = Synthetic Construct
KKGNNK

SEQ ID NO: 21980 - protein, 6 aa, synthetic construct
  REGION 1..6: note = Synthetic Construct
KKGNQK

SEQ ID NO: 21981 - protein, 6 aa, synthetic construct
  REGION 1..6: note = Synthetic Construct
KKGNRK

SEQ ID NO: 21982 - protein, 6 aa, synthetic construct
  REGION 1..6: note = Synthetic Construct
KKGNSK

SEQ ID NO: 21983 - protein, 6 aa, synthetic construct
  REGION 1..6: note = Synthetic Construct
KKGNTK

SEQ ID NO: 21984 - protein, 6 aa, synthetic construct
  REGION 1..6: note = Synthetic Construct
KKGNYK

SEQ ID NO: 21985 - protein, 6 aa, synthetic construct
  REGION 1..6: note = Synthetic Construct
KKGQAK

SEQ ID NO: 21986 - protein, 6 aa, synthetic construct
  REGION 1..6: note = Synthetic Construct
KKGQDK

SEQ ID NO: 21987 - protein, 6 aa, synthetic construct
  REGION 1..6: note = Synthetic Construct
KKGQEK

SEQ ID NO: 21988 - protein, 6 aa, synthetic construct
  REGION 1..6: note = Synthetic Construct
KKGQFK

SEQ ID NO: 21989 - protein, 6 aa, synthetic construct
  REGION 1..6: note = Synthetic Construct
KKGQGK

SEQ ID NO: 21990 - protein, 6 aa, synthetic construct
  REGION 1..6: note = Synthetic Construct
KKGQHK

SEQ ID NO: 21991 - protein, 6 aa, synthetic construct
  REGION 1..6: note = Synthetic Construct
KKGQIK

SEQ ID NO: 21992 - protein, 6 aa, synthetic construct
  REGION 1..6: note = Synthetic Construct
KKGQLK

SEQ ID NO: 21993 - protein, 6 aa, synthetic construct
  REGION 1..6: note = Synthetic Construct
KKGQNK

SEQ ID NO: 21994 - protein, 6 aa, synthetic construct
  REGION 1..6: note = Synthetic Construct
KKGQQK

SEQ ID NO: 21995 - protein, 6 aa, synthetic construct
  REGION 1..6: note = Synthetic Construct
KKGQRK

SEQ ID NO: 21996 - protein, 6 aa, synthetic construct
  REGION 1..6: note = Synthetic Construct
KKGQSK

SEQ ID NO: 21997 - protein, 6 aa, synthetic construct
  REGION 1..6: note = Synthetic Construct
KKGQTK

SEQ ID NO: 21998 - protein, 6 aa, synthetic construct
  REGION 1..6: note = Synthetic Construct
KKGQYK

SEQ ID NO: 21999 - protein, 6 aa, synthetic construct
  REGION 1..6: note = Synthetic Construct
KKGRAK

SEQ ID NO: 22000 - protein, 6 aa, synthetic construct
  REGION 1..6: note = Synthetic Construct
KKGRDK

SEQ ID NO: 22001 - protein, 6 aa, synthetic construct
  REGION 1..6: note = Synthetic Construct
KKGREK

SEQ ID NO: 22002 - protein, 6 aa, synthetic construct
  REGION 1..6: note = Synthetic Construct
KKGRFK

SEQ ID NO: 22003 - protein, 6 aa, synthetic construct
  REGION 1..6: note = Synthetic Construct
KKGRGK

SEQ ID NO: 22004 - protein, 6 aa, synthetic construct
  REGION 1..6: note = Synthetic Construct
KKGRHK

SEQ ID NO: 22005 - protein, 6 aa, synthetic construct
  REGION 1..6: note = Synthetic Construct
KKGRIK

SEQ ID NO: 22006 - protein, 6 aa, synthetic construct
  REGION 1..6: note = Synthetic Construct
KKGRLK

SEQ ID NO: 22007 - protein, 6 aa, synthetic construct
  REGION 1..6: note = Synthetic Construct
KKGRNK

SEQ ID NO: 22008 - protein, 6 aa, synthetic construct
  REGION 1..6: note = Synthetic Construct
KKGRQK

SEQ ID NO: 22009 - protein, 6 aa, synthetic construct
  REGION 1..6: note = Synthetic Construct
KKGRRK

SEQ ID NO: 22010 - protein, 6 aa, synthetic construct
  REGION 1..6: note = Synthetic Construct
KKGRSK

SEQ ID NO: 22011 - protein, 6 aa, synthetic construct
  REGION 1..6: note = Synthetic Construct
KKGRTK

SEQ ID NO: 22012 - protein, 6 aa, synthetic construct
  REGION 1..6: note = Synthetic Construct
KKGRYK

SEQ ID NO: 22013 - protein, 6 aa, synthetic construct
  REGION 1..6: note = Synthetic Construct
KKGSAK

SEQ ID NO: 22014 - protein, 6 aa, synthetic construct
  REGION 1..6: note = Synthetic Construct
KKGSDK

SEQ ID NO: 22015 - protein, 6 aa, synthetic construct
  REGION 1..6: note = Synthetic Construct
KKGSEK

SEQ ID NO: 22016 - protein, 6 aa, synthetic construct
  REGION 1..6: note = Synthetic Construct
KKGSFK

SEQ ID NO: 22017 - protein, 6 aa, synthetic construct
  REGION 1..6: note = Synthetic Construct
KKGSGK

SEQ ID NO: 22018 - protein, 6 aa, synthetic construct
  REGION 1..6: note = Synthetic Construct
KKGSHK

SEQ ID NO: 22019 - protein, 6 aa, synthetic construct
  REGION 1..6: note = Synthetic Construct
KKGSIK

SEQ ID NO: 22020 - protein, 6 aa, synthetic construct
  REGION 1..6: note = Synthetic Construct
KKGSLK

SEQ ID NO: 22021 - protein, 6 aa, synthetic construct
  REGION 1..6: note = Synthetic Construct
KKGSNK

SEQ ID NO: 22022 - protein, 6 aa, synthetic construct
  REGION 1..6: note = Synthetic Construct
KKGSQK

SEQ ID NO: 22023 - protein, 6 aa, synthetic construct
  REGION 1..6: note = Synthetic Construct
KKGSRK

SEQ ID NO: 22024 - protein, 6 aa, synthetic construct
  REGION 1..6: note = Synthetic Construct
KKGSSK

SEQ ID NO: 22025 - protein, 6 aa, synthetic construct
  REGION 1..6: note = Synthetic Construct
KKGSTK

SEQ ID NO: 22026 - protein, 6 aa, synthetic construct
  REGION 1..6: note = Synthetic Construct
KKGSYK

SEQ ID NO: 22027 - protein, 6 aa, synthetic construct
  REGION 1..6: note = Synthetic Construct
KKGTAK

SEQ ID NO: 22028 - protein, 6 aa, synthetic construct
  REGION 1..6: note = Synthetic Construct
KKGTDK

SEQ ID NO: 22029 - protein, 6 aa, synthetic construct
  REGION 1..6: note = Synthetic Construct
KKGTEK

SEQ ID NO: 22030 - protein, 6 aa, synthetic construct
  REGION 1..6: note = Synthetic Construct
KKGTFK

SEQ ID NO: 22031 - protein, 6 aa, synthetic construct
  REGION 1..6: note = Synthetic Construct
KKGTGK

SEQ ID NO: 22032 - protein, 6 aa, synthetic construct
  REGION 1..6: note = Synthetic Construct
KKGTHK

SEQ ID NO: 22033 - protein, 6 aa, synthetic construct
  REGION 1..6: note = Synthetic Construct
KKGTIK

SEQ ID NO: 22034 - protein, 6 aa, synthetic construct
  REGION 1..6: note = Synthetic Construct
KKGTLK

SEQ ID NO: 22035 - protein, 6 aa, synthetic construct
  REGION 1..6: note = Synthetic Construct
KKGTNK

SEQ ID NO: 22036 - protein, 6 aa, synthetic construct
  REGION 1..6: note = Synthetic Construct
KKGTQK

SEQ ID NO: 22037 - protein, 6 aa, synthetic construct
  REGION 1..6: note = Synthetic Construct
KKGTRK

SEQ ID NO: 22038 - protein, 6 aa, synthetic construct
  REGION 1..6: note = Synthetic Construct
KKGTSK

SEQ ID NO: 22039 - protein, 6 aa, synthetic construct
  REGION 1..6: note = Synthetic Construct
KKGTTK

SEQ ID NO: 22040 - protein, 6 aa, synthetic construct
  REGION 1..6: note = Synthetic Construct
KKGTYK

SEQ ID NO: 22041 - protein, 6 aa, synthetic construct
  REGION 1..6: note = Synthetic Construct
KKGYAK

SEQ ID NO: 22042 - protein, 6 aa, synthetic construct
  REGION 1..6: note = Synthetic Construct
KKGYDK

SEQ ID NO: 22043 - protein, 6 aa, synthetic construct
  REGION 1..6: note = Synthetic Construct
KKGYEK

SEQ ID NO: 22044 - protein, 6 aa, synthetic construct
  REGION 1..6: note = Synthetic Construct
KKGYFK

SEQ ID NO: 22045 - protein, 6 aa, synthetic construct
  REGION 1..6: note = Synthetic Construct
KKGYGK

SEQ ID NO: 22046 - protein, 6 aa, synthetic construct
  REGION 1..6: note = Synthetic Construct
KKGYHK

SEQ ID NO: 22047 - protein, 6 aa, synthetic construct
  REGION 1..6: note = Synthetic Construct
KKGYIK

SEQ ID NO: 22048 - protein, 6 aa, synthetic construct
  REGION 1..6: note = Synthetic Construct
KKGYLK

SEQ ID NO: 22049 - protein, 6 aa, synthetic construct
  REGION 1..6: note = Synthetic Construct
KKGYNK

SEQ ID NO: 22050 - protein, 6 aa, synthetic construct
  REGION 1..6: note = Synthetic Construct
KKGYQK

SEQ ID NO: 22051 - protein, 6 aa, synthetic construct
  REGION 1..6: note = Synthetic Construct
KKGYRK

SEQ ID NO: 22052 - protein, 6 aa, synthetic construct
  REGION 1..6: note = Synthetic Construct
KKGYSK

SEQ ID NO: 22053 - protein, 6 aa, synthetic construct
  REGION 1..6: note = Synthetic Construct
KKGYTK

SEQ ID NO: 22054 - protein, 6 aa, synthetic construct
  REGION 1..6: note = Synthetic Construct
KKGYYK

SEQ ID NO: 22055 - protein, 6 aa, synthetic construct
  REGION 1..6: note = Synthetic Construct
KKHAAK

SEQ ID NO: 22056 - protein, 6 aa, synthetic construct
  REGION 1..6: note = Synthetic Construct
KKHADK

SEQ ID NO: 22057 - protein, 6 aa, synthetic construct
  REGION 1..6: note = Synthetic Construct
KKHAEK

SEQ ID NO: 22058 - protein, 6 aa, synthetic construct
  REGION 1..6: note = Synthetic Construct
KKHAFK

SEQ ID NO: 22059 - protein, 6 aa, synthetic construct
  REGION 1..6: note = Synthetic Construct
KKHAGK

SEQ ID NO: 22060 - protein, 6 aa, synthetic construct
  REGION 1..6: note = Synthetic Construct
KKHAHK

SEQ ID NO: 22061 - protein, 6 aa, synthetic construct
  REGION 1..6: note = Synthetic Construct
KKHAIK

SEQ ID NO: 22062 - protein, 6 aa, synthetic construct
  REGION 1..6: note = Synthetic Construct
KKHALK

SEQ ID NO: 22063 - protein, 6 aa, synthetic construct
  REGION 1..6: note = Synthetic Construct
KKHANK

SEQ ID NO: 22064 - protein, 6 aa, synthetic construct
  REGION 1..6: note = Synthetic Construct
KKHAQK

SEQ ID NO: 22065 - protein, 6 aa, synthetic construct
  REGION 1..6: note = Synthetic Construct
KKHARK

SEQ ID NO: 22066 - protein, 6 aa, synthetic construct
  REGION 1..6: note = Synthetic Construct
KKHASK

SEQ ID NO: 22067 - protein, 6 aa, synthetic construct
  REGION 1..6: note = Synthetic Construct
KKHATK

SEQ ID NO: 22068 - protein, 6 aa, synthetic construct
  REGION 1..6: note = Synthetic Construct
KKHAYK

SEQ ID NO: 22069 - protein, 6 aa, synthetic construct
  REGION 1..6: note = Synthetic Construct
KKHDAK

SEQ ID NO: 22070 - protein, 6 aa, synthetic construct
  REGION 1..6: note = Synthetic Construct
KKHDDK

SEQ ID NO: 22071 - protein, 6 aa, synthetic construct
  REGION 1..6: note = Synthetic Construct
KKHDEK

SEQ ID NO: 22072 - protein, 6 aa, synthetic construct
  REGION 1..6: note = Synthetic Construct
KKHDFK

SEQ ID NO: 22073 - protein, 6 aa, synthetic construct
  REGION 1..6: note = Synthetic Construct
KKHDGK

SEQ ID NO: 22074 - protein, 6 aa, synthetic construct
  REGION 1..6: note = Synthetic Construct
KKHDHK

SEQ ID NO: 22075 - protein, 6 aa, synthetic construct
  REGION 1..6: note = Synthetic Construct
KKHDIK

SEQ ID NO: 22076 - protein, 6 aa, synthetic construct
  REGION 1..6: note = Synthetic Construct
KKHDLK

SEQ ID NO: 22077 - protein, 6 aa, synthetic construct
  REGION 1..6: note = Synthetic Construct
KKHDNK

SEQ ID NO: 22078 - protein, 6 aa, synthetic construct
  REGION 1..6: note = Synthetic Construct
KKHDQK

SEQ ID NO: 22079 - protein, 6 aa, synthetic construct
  REGION 1..6: note = Synthetic Construct
KKHDRK

SEQ ID NO: 22080 - protein, 6 aa, synthetic construct
  REGION 1..6: note = Synthetic Construct
KKHDSK

SEQ ID NO: 22081 - protein, 6 aa, synthetic construct
  REGION 1..6: note = Synthetic Construct
KKHDTK

SEQ ID NO: 22082 - protein, 6 aa, synthetic construct
  REGION 1..6: note = Synthetic Construct
KKHDYK

SEQ ID NO: 22083 - protein, 6 aa, synthetic construct
  REGION 1..6: note = Synthetic Construct
KKHEAK

SEQ ID NO: 22084 - protein, 6 aa, synthetic construct
  REGION 1..6: note = Synthetic Construct
KKHEDK

SEQ ID NO: 22085 - protein, 6 aa, synthetic construct
  REGION 1..6: note = Synthetic Construct
KKHEEK

SEQ ID NO: 22086 - protein, 6 aa, synthetic construct
  REGION 1..6: note = Synthetic Construct
KKHEFK

SEQ ID NO: 22087 - protein, 6 aa, synthetic construct
  REGION 1..6: note = Synthetic Construct
KKHEGK

SEQ ID NO: 22088 - protein, 6 aa, synthetic construct
  REGION 1..6: note = Synthetic Construct
KKHEHK

SEQ ID NO: 22089 - protein, 6 aa, synthetic construct
  REGION 1..6: note = Synthetic Construct
KKHEIK

SEQ ID NO: 22090 - protein, 6 aa, synthetic construct
  REGION 1..6: note = Synthetic Construct
KKHELK

SEQ ID NO: 22091 - protein, 6 aa, synthetic construct
  REGION 1..6: note = Synthetic Construct
KKHENK

SEQ ID NO: 22092 - protein, 6 aa, synthetic construct
  REGION 1..6: note = Synthetic Construct
KKHEQK

SEQ ID NO: 22093 - protein, 6 aa, synthetic construct
  REGION 1..6: note = Synthetic Construct
KKHERK

SEQ ID NO: 22094 - protein, 6 aa, synthetic construct
  REGION 1..6: note = Synthetic Construct
KKHESK

SEQ ID NO: 22095 - protein, 6 aa, synthetic construct
  REGION 1..6: note = Synthetic Construct
KKHETK

SEQ ID NO: 22096 - protein, 6 aa, synthetic construct
  REGION 1..6: note = Synthetic Construct
KKHEYK

SEQ ID NO: 22097 - protein, 6 aa, synthetic construct
  REGION 1..6: note = Synthetic Construct
KKHFAK

SEQ ID NO: 22098 - protein, 6 aa, synthetic construct
  REGION 1..6: note = Synthetic Construct
KKHFDK

SEQ ID NO: 22099 - protein, 6 aa, synthetic construct
  REGION 1..6: note = Synthetic Construct
KKHFEK

SEQ ID NO: 22100 - protein, 6 aa, synthetic construct
  REGION 1..6: note = Synthetic Construct
KKHFFK

SEQ ID NO: 22101 - protein, 6 aa, synthetic construct
  REGION 1..6: note = Synthetic Construct
KKHFGK

SEQ ID NO: 22102 - protein, 6 aa, synthetic construct
  REGION 1..6: note = Synthetic Construct
KKHFHK

SEQ ID NO: 22103 - protein, 6 aa, synthetic construct
  REGION 1..6: note = Synthetic Construct
KKHFIK

SEQ ID NO: 22104 - protein, 6 aa, synthetic construct
  REGION 1..6: note = Synthetic Construct
KKHFLK

SEQ ID NO: 22105 - protein, 6 aa, synthetic construct
  REGION 1..6: note = Synthetic Construct
KKHFNK

SEQ ID NO: 22106 - protein, 6 aa, synthetic construct
  REGION 1..6: note = Synthetic Construct
KKHFQK

SEQ ID NO: 22107 - protein, 6 aa, synthetic construct
  REGION 1..6: note = Synthetic Construct
KKHFRK

SEQ ID NO: 22108 - protein, 6 aa, synthetic construct
  REGION 1..6: note = Synthetic Construct
KKHFSK

SEQ ID NO: 22109 - protein, 6 aa, synthetic construct
  REGION 1..6: note = Synthetic Construct
KKHFTK

SEQ ID NO: 22110 - protein, 6 aa, synthetic construct
  REGION 1..6: note = Synthetic Construct
KKHFYK

SEQ ID NO: 22111 - protein, 6 aa, synthetic construct
  REGION 1..6: note = Synthetic Construct
KKHGAK

SEQ ID NO: 22112 - protein, 6 aa, synthetic construct
  REGION 1..6: note = Synthetic Construct
KKHGDK

SEQ ID NO: 22113 - protein, 6 aa, synthetic construct
  REGION 1..6: note = Synthetic Construct
KKHGEK

SEQ ID NO: 22114 - protein, 6 aa, synthetic construct
  REGION 1..6: note = Synthetic Construct
KKHGFK

SEQ ID NO: 22115 - protein, 6 aa, synthetic construct
  REGION 1..6: note = Synthetic Construct
KKHGGK

SEQ ID NO: 22116 - protein, 6 aa, synthetic construct
  REGION 1..6: note = Synthetic Construct
KKHGHK

SEQ ID NO: 22117 - protein, 6 aa, synthetic construct
  REGION 1..6: note = Synthetic Construct
KKHGIK

SEQ ID NO: 22118 - protein, 6 aa, synthetic construct
  REGION 1..6: note = Synthetic Construct
KKHGLK

SEQ ID NO: 22119 - protein, 6 aa, synthetic construct
  REGION 1..6: note = Synthetic Construct
KKHGNK

SEQ ID NO: 22120 - protein, 6 aa, synthetic construct
  REGION 1..6: note = Synthetic Construct
KKHGQK

SEQ ID NO: 22121 - protein, 6 aa, synthetic construct
  REGION 1..6: note = Synthetic Construct
KKHGRK

SEQ ID NO: 22122 - protein, 6 aa, synthetic construct
  REGION 1..6: note = Synthetic Construct
KKHGSK

SEQ ID NO: 22123 - protein, 6 aa, synthetic construct
  REGION 1..6: note = Synthetic Construct
KKHGTK

SEQ ID NO: 22124 - protein, 6 aa, synthetic construct
  REGION 1..6: note = Synthetic Construct
KKHGYK

SEQ ID NO: 22125 - protein, 6 aa, synthetic construct
  REGION 1..6: note = Synthetic Construct
KKHHAK

SEQ ID NO: 22126 - protein, 6 aa, synthetic construct
  REGION 1..6: note = Synthetic Construct
KKHHDK

SEQ ID NO: 22127 - protein, 6 aa, synthetic construct
  REGION 1..6: note = Synthetic Construct
KKHHEK

SEQ ID NO: 22128 - protein, 6 aa, synthetic construct
  REGION 1..6: note = Synthetic Construct
KKHHFK

SEQ ID NO: 22129 - protein, 6 aa, synthetic construct
  REGION 1..6: note = Synthetic Construct
KKHHGK

SEQ ID NO: 22130 - protein, 6 aa, synthetic construct
  REGION 1..6: note = Synthetic Construct
KKHHHK

SEQ ID NO: 22131 - protein, 6 aa, synthetic construct
  REGION 1..6: note = Synthetic Construct
KKHHIK

SEQ ID NO: 22132 - protein, 6 aa, synthetic construct
  REGION 1..6: note = Synthetic Construct
KKHHLK

SEQ ID NO: 22133 - protein, 6 aa, synthetic construct
  REGION 1..6: note = Synthetic Construct
KKHHNK

SEQ ID NO: 22134 - protein, 6 aa, synthetic construct
  REGION 1..6: note = Synthetic Construct
KKHHQK

SEQ ID NO: 22135 - protein, 6 aa, synthetic construct
  REGION 1..6: note = Synthetic Construct
KKHHRK

SEQ ID NO: 22136 - protein, 6 aa, synthetic construct
  REGION 1..6: note = Synthetic Construct
KKHHSK

SEQ ID NO: 22137 - protein, 6 aa, synthetic construct
  REGION 1..6: note = Synthetic Construct
KKHHTK

SEQ ID NO: 22138 - protein, 6 aa, synthetic construct
  REGION 1..6: note = Synthetic Construct
KKHHYK

SEQ ID NO: 22139 - protein, 6 aa, synthetic construct
  REGION 1..6: note = Synthetic Construct
KKHIAK

SEQ ID NO: 22140 - protein, 6 aa, synthetic construct
  REGION 1..6: note = Synthetic Construct
KKHIDK

SEQ ID NO: 22141 - protein, 6 aa, synthetic construct
  REGION 1..6: note = Synthetic Construct
KKHIEK

SEQ ID NO: 22142 - protein, 6 aa, synthetic construct
  REGION 1..6: note = Synthetic Construct
KKHIFK

SEQ ID NO: 22143 - protein, 6 aa, synthetic construct
  REGION 1..6: note = Synthetic Construct
KKHIGK

SEQ ID NO: 22144 - protein, 6 aa, synthetic construct
  REGION 1..6: note = Synthetic Construct
KKHIHK

SEQ ID NO: 22145 - protein, 6 aa, synthetic construct
  REGION 1..6: note = Synthetic Construct
KKHIIK

SEQ ID NO: 22146 - protein, 6 aa, synthetic construct
  REGION 1..6: note = Synthetic Construct
KKHILK

SEQ ID NO: 22147 - protein, 6 aa, synthetic construct
  REGION 1..6: note = Synthetic Construct
KKHINK

SEQ ID NO: 22148 - protein, 6 aa, synthetic construct
  REGION 1..6: note = Synthetic Construct
KKHIQK

SEQ ID NO: 22149 - protein, 6 aa, synthetic construct
  REGION 1..6: note = Synthetic Construct
KKHIRK

SEQ ID NO: 22150 - protein, 6 aa, synthetic construct
  REGION 1..6: note = Synthetic Construct
KKHISK

SEQ ID NO: 22151 - protein, 6 aa, synthetic construct
  REGION 1..6: note = Synthetic Construct
KKHITK

SEQ ID NO: 22152 - protein, 6 aa, synthetic construct
  REGION 1..6: note = Synthetic Construct
KKHIYK

SEQ ID NO: 22153 - protein, 6 aa, synthetic construct
  REGION 1..6: note = Synthetic Construct
KKHLAK

SEQ ID NO: 22154 - protein, 6 aa, synthetic construct
  REGION 1..6: note = Synthetic Construct
KKHLDK

SEQ ID NO: 22155 - protein, 6 aa, synthetic construct
  REGION 1..6: note = Synthetic Construct
KKHLEK

SEQ ID NO: 22156 - protein, 6 aa, synthetic construct
  REGION 1..6: note = Synthetic Construct
KKHLFK

SEQ ID NO: 22157 - protein, 6 aa, synthetic construct
  REGION 1..6: note = Synthetic Construct
KKHLGK

SEQ ID NO: 22158 - protein, 6 aa, synthetic construct
  REGION 1..6: note = Synthetic Construct
KKHLHK

SEQ ID NO: 22159 - protein, 6 aa, synthetic construct
  REGION 1..6: note = Synthetic Construct
KKHLIK

SEQ ID NO: 22160 - protein, 6 aa, synthetic construct
  REGION 1..6: note = Synthetic Construct
KKHLLK

SEQ ID NO: 22161 - protein, 6 aa, synthetic construct
  REGION 1..6: note = Synthetic Construct
KKHLNK

SEQ ID NO: 22162 - protein, 6 aa, synthetic construct
  REGION 1..6: note = Synthetic Construct
KKHLQK

SEQ ID NO: 22163 - protein, 6 aa, synthetic construct
  REGION 1..6: note = Synthetic Construct
KKHLRK

SEQ ID NO: 22164 - protein, 6 aa, synthetic construct
  REGION 1..6: note = Synthetic Construct
KKHLSK

SEQ ID NO: 22165 - protein, 6 aa, synthetic construct
  REGION 1..6: note = Synthetic Construct
KKHLTK

SEQ ID NO: 22166 - protein, 6 aa, synthetic construct
  REGION 1..6: note = Synthetic Construct
KKHLYK

SEQ ID NO: 22167 - protein, 6 aa, synthetic construct
  REGION 1..6: note = Synthetic Construct
KKHNAK

SEQ ID NO: 22168 - protein, 6 aa, synthetic construct
  REGION 1..6: note = Synthetic Construct
KKHNDK

SEQ ID NO: 22169 - protein, 6 aa, synthetic construct
  REGION 1..6: note = Synthetic Construct
KKHNEK

SEQ ID NO: 22170 - protein, 6 aa, synthetic construct
  REGION 1..6: note = Synthetic Construct
KKHNFK

SEQ ID NO: 22171 - protein, 6 aa, synthetic construct
  REGION 1..6: note = Synthetic Construct
KKHNGK

SEQ ID NO: 22172 - protein, 6 aa, synthetic construct
  REGION 1..6: note = Synthetic Construct
KKHNHK

SEQ ID NO: 22173 - protein, 6 aa, synthetic construct
  REGION 1..6: note = Synthetic Construct
KKHNIK

SEQ ID NO: 22174 - protein, 6 aa, synthetic construct
  REGION 1..6: note = Synthetic Construct
KKHNLK

SEQ ID NO: 22175 - protein, 6 aa, synthetic construct
  REGION 1..6: note = Synthetic Construct
KKHNNK

SEQ ID NO: 22176 - protein, 6 aa, synthetic construct
  REGION 1..6: note = Synthetic Construct
KKHNQK

SEQ ID NO: 22177 - protein, 6 aa, synthetic construct
  REGION 1..6: note = Synthetic Construct
KKHNRK

SEQ ID NO: 22178 - protein, 6 aa, synthetic construct
  REGION 1..6: note = Synthetic Construct
KKHNSK

SEQ ID NO: 22179 - protein, 6 aa, synthetic construct
  REGION 1..6: note = Synthetic Construct
KKHNTK

SEQ ID NO: 22180 - protein, 6 aa, synthetic construct
  REGION 1..6: note = Synthetic Construct
KKHNYK

SEQ ID NO: 22181 - protein, 6 aa, synthetic construct
  REGION 1..6: note = Synthetic Construct
KKHQAK

SEQ ID NO: 22182 - protein, 6 aa, synthetic construct
  REGION 1..6: note = Synthetic Construct
KKHQDK

SEQ ID NO: 22183 - protein, 6 aa, synthetic construct
  REGION 1..6: note = Synthetic Construct
KKHQEK

SEQ ID NO: 22184 - protein, 6 aa, synthetic construct
  REGION 1..6: note = Synthetic Construct
KKHQFK

SEQ ID NO: 22185 - protein, 6 aa, synthetic construct
  REGION 1..6: note = Synthetic Construct
KKHQGK

SEQ ID NO: 22186 - protein, 6 aa, synthetic construct
  REGION 1..6: note = Synthetic Construct
KKHQHK

SEQ ID NO: 22187 - protein, 6 aa, synthetic construct
  REGION 1..6: note = Synthetic Construct
KKHQIK

SEQ ID NO: 22188 - protein, 6 aa, synthetic construct
  REGION 1..6: note = Synthetic Construct
KKHQLK

SEQ ID NO: 22189 - protein, 6 aa, synthetic construct
  REGION 1..6: note = Synthetic Construct
KKHQNK

SEQ ID NO: 22190 - protein, 6 aa, synthetic construct
  REGION 1..6: note = Synthetic Construct
KKHQQK

SEQ ID NO: 22191 - protein, 6 aa, synthetic construct
  REGION 1..6: note = Synthetic Construct
KKHQRK

SEQ ID NO: 22192 - protein, 6 aa, synthetic construct
  REGION 1..6: note = Synthetic Construct
KKHQSK

SEQ ID NO: 22193 - protein, 6 aa, synthetic construct
  REGION 1..6: note = Synthetic Construct
KKHQTK

SEQ ID NO: 22194 - protein, 6 aa, synthetic construct
  REGION 1..6: note = Synthetic Construct
KKHQYK

SEQ ID NO: 22195 - protein, 6 aa, synthetic construct
  REGION 1..6: note = Synthetic Construct
KKHRAK

SEQ ID NO: 22196 - protein, 6 aa, synthetic construct
  REGION 1..6: note = Synthetic Construct
KKHRDK

SEQ ID NO: 22197 - protein, 6 aa, synthetic construct
  REGION 1..6: note = Synthetic Construct
KKHREK

SEQ ID NO: 22198 - protein, 6 aa, synthetic construct
  REGION 1..6: note = Synthetic Construct
KKHRFK

SEQ ID NO: 22199 - protein, 6 aa, synthetic construct
  REGION 1..6: note = Synthetic Construct
KKHRGK

SEQ ID NO: 22200 - protein, 6 aa, synthetic construct
  REGION 1..6: note = Synthetic Construct
KKHRHK

SEQ ID NO: 22201 - protein, 6 aa, synthetic construct
  REGION 1..6: note = Synthetic Construct
KKHRIK

SEQ ID NO: 22202 - protein, 6 aa, synthetic construct
  REGION 1..6: note = Synthetic Construct
KKHRLK

SEQ ID NO: 22203 - protein, 6 aa, synthetic construct
  REGION 1..6: note = Synthetic Construct
KKHRNK

SEQ ID NO: 22204 - protein, 6 aa, synthetic construct
  REGION 1..6: note = Synthetic Construct
KKHRQK

SEQ ID NO: 22205 - protein, 6 aa, synthetic construct
  REGION 1..6: note = Synthetic Construct
KKHRRK

SEQ ID NO: 22206 - protein, 6 aa, synthetic construct
  REGION 1..6: note = Synthetic Construct
KKHRSK

SEQ ID NO: 22207 - protein, 6 aa, synthetic construct
  REGION 1..6: note = Synthetic Construct
KKHRTK

SEQ ID NO: 22208 - protein, 6 aa, synthetic construct
  REGION 1..6: note = Synthetic Construct
KKHRYK

SEQ ID NO: 22209 - protein, 6 aa, synthetic construct
  REGION 1..6: note = Synthetic Construct
KKHSAK

SEQ ID NO: 22210 - protein, 6 aa, synthetic construct
  REGION 1..6: note = Synthetic Construct
KKHSDK

SEQ ID NO: 22211 - protein, 6 aa, synthetic construct
  REGION 1..6: note = Synthetic Construct
KKHSEK

SEQ ID NO: 22212 - protein, 6 aa, synthetic construct
  REGION 1..6: note = Synthetic Construct
KKHSFK

SEQ ID NO: 22213 - protein, 6 aa, synthetic construct
  REGION 1..6: note = Synthetic Construct
KKHSGK

SEQ ID NO: 22214 - protein, 6 aa, synthetic construct
  REGION 1..6: note = Synthetic Construct
KKHSHK

SEQ ID NO: 22215 - protein, 6 aa, synthetic construct
  REGION 1..6: note = Synthetic Construct
KKHSIK

SEQ ID NO: 22216 - protein, 6 aa, synthetic construct
  REGION 1..6: note = Synthetic Construct
KKHSLK

SEQ ID NO: 22217 - protein, 6 aa, synthetic construct
  REGION 1..6: note = Synthetic Construct
KKHSNK

SEQ ID NO: 22218 - protein, 6 aa, synthetic construct
  REGION 1..6: note = Synthetic Construct
KKHSQK

SEQ ID NO: 22219 - protein, 6 aa, synthetic construct
  REGION 1..6: note = Synthetic Construct
KKHSRK

SEQ ID NO: 22220 - protein, 6 aa, synthetic construct
  REGION 1..6: note = Synthetic Construct
KKHSSK

SEQ ID NO: 22221 - protein, 6 aa, synthetic construct
  REGION 1..6: note = Synthetic Construct
KKHSTK

SEQ ID NO: 22222 - protein, 6 aa, synthetic construct
  REGION 1..6: note = Synthetic Construct
KKHSYK

SEQ ID NO: 22223 - protein, 6 aa, synthetic construct
  REGION 1..6: note = Synthetic Construct
KKHTAK

SEQ ID NO: 22224 - protein, 6 aa, synthetic construct
  REGION 1..6: note = Synthetic Construct
KKHTDK

SEQ ID NO: 22225 - protein, 6 aa, synthetic construct
  REGION 1..6: note = Synthetic Construct
KKHTEK

SEQ ID NO: 22226 - protein, 6 aa, synthetic construct
  REGION 1..6: note = Synthetic Construct
KKHTFK

SEQ ID NO: 22227 - protein, 6 aa, synthetic construct
  REGION 1..6: note = Synthetic Construct
KKHTGK

SEQ ID NO: 22228 - protein, 6 aa, synthetic construct
  REGION 1..6: note = Synthetic Construct
KKHTHK

SEQ ID NO: 22229 - protein, 6 aa, synthetic construct
  REGION 1..6: note = Synthetic Construct
KKHTIK

SEQ ID NO: 22230 - protein, 6 aa, synthetic construct
  REGION 1..6: note = Synthetic Construct
KKHTLK

SEQ ID NO: 22231 - protein, 6 aa, synthetic construct
  REGION 1..6: note = Synthetic Construct
KKHTNK

SEQ ID NO: 22232 - protein, 6 aa, synthetic construct
  REGION 1..6: note = Synthetic Construct
KKHTQK

SEQ ID NO: 22233 - protein, 6 aa, synthetic construct
  REGION 1..6: note = Synthetic Construct
KKHTRK

SEQ ID NO: 22234 - protein, 6 aa, synthetic construct
  REGION 1..6: note = Synthetic Construct
KKHTSK

SEQ ID NO: 22235 - protein, 6 aa, synthetic construct
  REGION 1..6: note = Synthetic Construct
KKHTTK

SEQ ID NO: 22236 - protein, 6 aa, synthetic construct
  REGION 1..6: note = Synthetic Construct
KKHTYK

SEQ ID NO: 22237 - protein, 6 aa, synthetic construct
  REGION 1..6: note = Synthetic Construct
KKHYAK

SEQ ID NO: 22238 - protein, 6 aa, synthetic construct
  REGION 1..6: note = Synthetic Construct
KKHYDK

SEQ ID NO: 22239 - protein, 6 aa, synthetic construct
  REGION 1..6: note = Synthetic Construct
KKHYEK

SEQ ID NO: 22240 - protein, 6 aa, synthetic construct
  REGION 1..6: note = Synthetic Construct
KKHYFK

SEQ ID NO: 22241 - protein, 6 aa, synthetic construct
  REGION 1..6: note = Synthetic Construct
KKHYGK

SEQ ID NO: 22242 - protein, 6 aa, synthetic construct
  REGION 1..6: note = Synthetic Construct
KKHYHK

SEQ ID NO: 22243 - protein, 6 aa, synthetic construct
  REGION 1..6: note = Synthetic Construct
KKHYIK

SEQ ID NO: 22244 - protein, 6 aa, synthetic construct
  REGION 1..6: note = Synthetic Construct
KKHYLK

SEQ ID NO: 22245 - protein, 6 aa, synthetic construct
  REGION 1..6: note = Synthetic Construct
KKHYNK

SEQ ID NO: 22246 - protein, 6 aa, synthetic construct
  REGION 1..6: note = Synthetic Construct
KKHYQK

SEQ ID NO: 22247 - protein, 6 aa, synthetic construct
  REGION 1..6: note = Synthetic Construct
KKHYRK

SEQ ID NO: 22248 - protein, 6 aa, synthetic construct
  REGION 1..6: note = Synthetic Construct
KKHYSK

SEQ ID NO: 22249 - protein, 6 aa, synthetic construct
  REGION 1..6: note = Synthetic Construct
KKHYTK

SEQ ID NO: 22250 - protein, 6 aa, synthetic construct
  REGION 1..6: note = Synthetic Construct
KKHYYK

SEQ ID NO: 22251 - protein, 6 aa, synthetic construct
  REGION 1..6: note = Synthetic Construct
KKIAAK

SEQ ID NO: 22252 - protein, 6 aa, synthetic construct
  REGION 1..6: note = Synthetic Construct
KKIADK

SEQ ID NO: 22253 - protein, 6 aa, synthetic construct
  REGION 1..6: note = Synthetic Construct
KKIAEK

SEQ ID NO: 22254 - protein, 6 aa, synthetic construct
  REGION 1..6: note = Synthetic Construct
KKIAFK

SEQ ID NO: 22255 - protein, 6 aa, synthetic construct
  REGION 1..6: note = Synthetic Construct
KKIAGK

SEQ ID NO: 22256 - protein, 6 aa, synthetic construct
  REGION 1..6: note = Synthetic Construct
KKIAHK

SEQ ID NO: 22257 - protein, 6 aa, synthetic construct
  REGION 1..6: note = Synthetic Construct
KKIAIK

SEQ ID NO: 22258 - protein, 6 aa, synthetic construct
  REGION 1..6: note = Synthetic Construct
KKIALK

SEQ ID NO: 22259 - protein, 6 aa, synthetic construct
  REGION 1..6: note = Synthetic Construct
KKIANK

SEQ ID NO: 22260 - protein, 6 aa, synthetic construct
  REGION 1..6: note = Synthetic Construct
KKIAQK

SEQ ID NO: 22261 - protein, 6 aa, synthetic construct
  REGION 1..6: note = Synthetic Construct
KKIARK

SEQ ID NO: 22262 - protein, 6 aa, synthetic construct
  REGION 1..6: note = Synthetic Construct
KKIASK

SEQ ID NO: 22263 - protein, 6 aa, synthetic construct
  REGION 1..6: note = Synthetic Construct
KKIATK

SEQ ID NO: 22264 - protein, 6 aa, synthetic construct
  REGION 1..6: note = Synthetic Construct
KKIAYK

SEQ ID NO: 22265 - protein, 6 aa, synthetic construct
  REGION 1..6: note = Synthetic Construct
KKIDAK

SEQ ID NO: 22266 - protein, 6 aa, synthetic construct
  REGION 1..6: note = Synthetic Construct
KKIDDK

SEQ ID NO: 22267 - protein, 6 aa, synthetic construct
  REGION 1..6: note = Synthetic Construct
KKIDEK

SEQ ID NO: 22268 - protein, 6 aa, synthetic construct
  REGION 1..6: note = Synthetic Construct
KKIDFK

SEQ ID NO: 22269 - protein, 6 aa, synthetic construct
  REGION 1..6: note = Synthetic Construct
KKIDGK

SEQ ID NO: 22270 - protein, 6 aa, synthetic construct
  REGION 1..6: note = Synthetic Construct
KKIDHK

SEQ ID NO: 22271 - protein, 6 aa, synthetic construct
  REGION 1..6: note = Synthetic Construct
KKIDIK

SEQ ID NO: 22272 - protein, 6 aa, synthetic construct
  REGION 1..6: note = Synthetic Construct
KKIDLK

SEQ ID NO: 22273 - protein, 6 aa, synthetic construct
  REGION 1..6: note = Synthetic Construct
KKIDNK

SEQ ID NO: 22274 - protein, 6 aa, synthetic construct
  REGION 1..6: note = Synthetic Construct
KKIDQK

SEQ ID NO: 22275 - protein, 6 aa, synthetic construct
  REGION 1..6: note = Synthetic Construct
KKIDRK

SEQ ID NO: 22276 - protein, 6 aa, synthetic construct
  REGION 1..6: note = Synthetic Construct
KKIDSK

SEQ ID NO: 22277 - protein, 6 aa, synthetic construct
  REGION 1..6: note = Synthetic Construct
KKIDTK

SEQ ID NO: 22278 - protein, 6 aa, synthetic construct
  REGION 1..6: note = Synthetic Construct
KKIDYK

SEQ ID NO: 22279 - protein, 6 aa, synthetic construct
  REGION 1..6: note = Synthetic Construct
KKIEAK

SEQ ID NO: 22280 - protein, 6 aa, synthetic construct
  REGION 1..6: note = Synthetic Construct
KKIEDK

SEQ ID NO: 22281 - protein, 6 aa, synthetic construct
  REGION 1..6: note = Synthetic Construct
KKIEEK

SEQ ID NO: 22282 - protein, 6 aa, synthetic construct
  REGION 1..6: note = Synthetic Construct
KKIEFK

SEQ ID NO: 22283 - protein, 6 aa, synthetic construct
  REGION 1..6: note = Synthetic Construct
KKIEGK

SEQ ID NO: 22284 - protein, 6 aa, synthetic construct
  REGION 1..6: note = Synthetic Construct
KKIEHK

SEQ ID NO: 22285 - protein, 6 aa, synthetic construct
  REGION 1..6: note = Synthetic Construct
KKIEIK

SEQ ID NO: 22286 - protein, 6 aa, synthetic construct
  REGION 1..6: note = Synthetic Construct
KKIELK

SEQ ID NO: 22287 - protein, 6 aa, synthetic construct
  REGION 1..6: note = Synthetic Construct
KKIENK

SEQ ID NO: 22288 - protein, 6 aa, synthetic construct
  REGION 1..6: note = Synthetic Construct
KKIEQK

SEQ ID NO: 22289 - protein, 6 aa, synthetic construct
  REGION 1..6: note = Synthetic Construct
KKIERK

SEQ ID NO: 22290 - protein, 6 aa, synthetic construct
  REGION 1..6: note = Synthetic Construct
KKIESK

SEQ ID NO: 22291 - protein, 6 aa, synthetic construct
  REGION 1..6: note = Synthetic Construct
KKIETK

SEQ ID NO: 22292 - protein, 6 aa, synthetic construct
  REGION 1..6: note = Synthetic Construct
KKIEYK

SEQ ID NO: 22293 - protein, 6 aa, synthetic construct
  REGION 1..6: note = Synthetic Construct
KKIFAK

SEQ ID NO: 22294 - protein, 6 aa, synthetic construct
  REGION 1..6: note = Synthetic Construct
KKIFDK

SEQ ID NO: 22295 - protein, 6 aa, synthetic construct
  REGION 1..6: note = Synthetic Construct
KKIFEK

SEQ ID NO: 22296 - protein, 6 aa, synthetic construct
  REGION 1..6: note = Synthetic Construct
KKIFFK

SEQ ID NO: 22297 - protein, 6 aa, synthetic construct
  REGION 1..6: note = Synthetic Construct
KKIFGK

SEQ ID NO: 22298 - protein, 6 aa, synthetic construct
  REGION 1..6: note = Synthetic Construct
KKIFHK

SEQ ID NO: 22299 - protein, 6 aa, synthetic construct
  REGION 1..6: note = Synthetic Construct
KKIFIK

SEQ ID NO: 22300 - protein, 6 aa, synthetic construct
  REGION 1..6: note = Synthetic Construct
KKIFLK

SEQ ID NO: 22301 - protein, 6 aa, synthetic construct
  REGION 1..6: note = Synthetic Construct
KKIFNK

SEQ ID NO: 22302 - protein, 6 aa, synthetic construct
  REGION 1..6: note = Synthetic Construct
KKIFQK

SEQ ID NO: 22303 - protein, 6 aa, synthetic construct
  REGION 1..6: note = Synthetic Construct
KKIFRK

SEQ ID NO: 22304 - protein, 6 aa, synthetic construct
  REGION 1..6: note = Synthetic Construct
KKIFSK

SEQ ID NO: 22305 - protein, 6 aa, synthetic construct
  REGION 1..6: note = Synthetic Construct
KKIFTK

SEQ ID NO: 22306 - protein, 6 aa, synthetic construct
  REGION 1..6: note = Synthetic Construct
KKIFYK

SEQ ID NO: 22307 - protein, 6 aa, synthetic construct
  REGION 1..6: note = Synthetic Construct
KKIGAK

SEQ ID NO: 22308 - protein, 6 aa, synthetic construct
  REGION 1..6: note = Synthetic Construct
KKIGDK

SEQ ID NO: 22309 - protein, 6 aa, synthetic construct
  REGION 1..6: note = Synthetic Construct
KKIGEK

SEQ ID NO: 22310 - protein, 6 aa, synthetic construct
  REGION 1..6: note = Synthetic Construct
KKIGFK

SEQ ID NO: 22311 - protein, 6 aa, synthetic construct
  REGION 1..6: note = Synthetic Construct
KKIGGK

SEQ ID NO: 22312 - protein, 6 aa, synthetic construct
  REGION 1..6: note = Synthetic Construct
KKIGHK

SEQ ID NO: 22313 - protein, 6 aa, synthetic construct
  REGION 1..6: note = Synthetic Construct
KKIGIK

SEQ ID NO: 22314 - protein, 6 aa, synthetic construct
  REGION 1..6: note = Synthetic Construct
KKIGLK

SEQ ID NO: 22315 - protein, 6 aa, synthetic construct
  REGION 1..6: note = Synthetic Construct
KKIGNK

SEQ ID NO: 22316 - protein, 6 aa, synthetic construct
  REGION 1..6: note = Synthetic Construct
KKIGQK

SEQ ID NO: 22317 - protein, 6 aa, synthetic construct
  REGION 1..6: note = Synthetic Construct
KKIGRK

SEQ ID NO: 22318 - protein, 6 aa, synthetic construct
  REGION 1..6: note = Synthetic Construct
KKIGSK

SEQ ID NO: 22319 - protein, 6 aa, synthetic construct
  REGION 1..6: note = Synthetic Construct
KKIGTK

SEQ ID NO: 22320 - protein, 6 aa, synthetic construct
  REGION 1..6: note = Synthetic Construct
KKIGYK

SEQ ID NO: 22321 - protein, 6 aa, synthetic construct
  REGION 1..6: note = Synthetic Construct
KKIHAK

SEQ ID NO: 22322 - protein, 6 aa, synthetic construct
  REGION 1..6: note = Synthetic Construct
KKIHDK

SEQ ID NO: 22323 - protein, 6 aa, synthetic construct
  REGION 1..6: note = Synthetic Construct
KKIHEK

SEQ ID NO: 22324 - protein, 6 aa, synthetic construct
  REGION 1..6: note = Synthetic Construct
KKIHFK

SEQ ID NO: 22325 - protein, 6 aa, synthetic construct
  REGION 1..6: note = Synthetic Construct
KKIHGK

SEQ ID NO: 22326 - protein, 6 aa, synthetic construct
  REGION 1..6: note = Synthetic Construct
KKIHHK

SEQ ID NO: 22327 - protein, 6 aa, synthetic construct
  REGION 1..6: note = Synthetic Construct
KKIHIK

SEQ ID NO: 22328 - protein, 6 aa, synthetic construct
  REGION 1..6: note = Synthetic Construct
KKIHLK

SEQ ID NO: 22329 - protein, 6 aa, synthetic construct
  REGION 1..6: note = Synthetic Construct
KKIHNK

SEQ ID NO: 22330 - protein, 6 aa, synthetic construct
  REGION 1..6: note = Synthetic Construct
KKIHQK

SEQ ID NO: 22331 - protein, 6 aa, synthetic construct
  REGION 1..6: note = Synthetic Construct
KKIHRK

SEQ ID NO: 22332 - protein, 6 aa, synthetic construct
  REGION 1..6: note = Synthetic Construct
KKIHSK

SEQ ID NO: 22333 - protein, 6 aa, synthetic construct
  REGION 1..6: note = Synthetic Construct
KKIHTK

SEQ ID NO: 22334 - protein, 6 aa, synthetic construct
  REGION 1..6: note = Synthetic Construct
KKIHYK

SEQ ID NO: 22335 - protein, 6 aa, synthetic construct
  REGION 1..6: note = Synthetic Construct
KKIIAK

SEQ ID NO: 22336 - protein, 6 aa, synthetic construct
  REGION 1..6: note = Synthetic Construct
KKIIDK

SEQ ID NO: 22337 - protein, 6 aa, synthetic construct
  REGION 1..6: note = Synthetic Construct
KKIIEK

SEQ ID NO: 22338 - protein, 6 aa, synthetic construct
  REGION 1..6: note = Synthetic Construct
KKIIFK

SEQ ID NO: 22339 - protein, 6 aa, synthetic construct
  REGION 1..6: note = Synthetic Construct
KKIIGK

SEQ ID NO: 22340 - protein, 6 aa, synthetic construct
  REGION 1..6: note = Synthetic Construct
KKIIHK

SEQ ID NO: 22341 - protein, 6 aa, synthetic construct
  REGION 1..6: note = Synthetic Construct
KKIIIK

SEQ ID NO: 22342 - protein, 6 aa, synthetic construct
  REGION 1..6: note = Synthetic Construct
KKIILK

SEQ ID NO: 22343 - protein, 6 aa, synthetic construct
  REGION 1..6: note = Synthetic Construct
KKIINK

SEQ ID NO: 22344 - protein, 6 aa, synthetic construct
  REGION 1..6: note = Synthetic Construct
KKIIQK

SEQ ID NO: 22345 - protein, 6 aa, synthetic construct
  REGION 1..6: note = Synthetic Construct
KKIIRK

SEQ ID NO: 22346 - protein, 6 aa, synthetic construct
  REGION 1..6: note = Synthetic Construct
KKIISK

SEQ ID NO: 22347 - protein, 6 aa, synthetic construct
  REGION 1..6: note = Synthetic Construct
KKIITK

SEQ ID NO: 22348 - protein, 6 aa, synthetic construct
  REGION 1..6: note = Synthetic Construct
KKIIYK

SEQ ID NO: 22349 - protein, 6 aa, synthetic construct
  REGION 1..6: note = Synthetic Construct
KKILAK

SEQ ID NO: 22350 - protein, 6 aa, synthetic construct
  REGION 1..6: note = Synthetic Construct
KKILDK

SEQ ID NO: 22351 - protein, 6 aa, synthetic construct
  REGION 1..6: note = Synthetic Construct
KKILEK

SEQ ID NO: 22352 - protein, 6 aa, synthetic construct
  REGION 1..6: note = Synthetic Construct
KKILFK

SEQ ID NO: 22353 - protein, 6 aa, synthetic construct
  REGION 1..6: note = Synthetic Construct
KKILGK

SEQ ID NO: 22354 - protein, 6 aa, synthetic construct
  REGION 1..6: note = Synthetic Construct
KKILHK

SEQ ID NO: 22355 - protein, 6 aa, synthetic construct
  REGION 1..6: note = Synthetic Construct
KKILIK

SEQ ID NO: 22356 - protein, 6 aa, synthetic construct
  REGION 1..6: note = Synthetic Construct
KKILLK

SEQ ID NO: 22357 - protein, 6 aa, synthetic construct
  REGION 1..6: note = Synthetic Construct
KKILNK

SEQ ID NO: 22358 - protein, 6 aa, synthetic construct
  REGION 1..6: note = Synthetic Construct
KKILQK

SEQ ID NO: 22359 - protein, 6 aa, synthetic construct
  REGION 1..6: note = Synthetic Construct
KKILRK

SEQ ID NO: 22360 - protein, 6 aa, synthetic construct
  REGION 1..6: note = Synthetic Construct
KKILSK

SEQ ID NO: 22361 - protein, 6 aa, synthetic construct
  REGION 1..6: note = Synthetic Construct
KKILTK

SEQ ID NO: 22362 - protein, 6 aa, synthetic construct
  REGION 1..6: note = Synthetic Construct
KKILYK

SEQ ID NO: 22363 - protein, 6 aa, synthetic construct
  REGION 1..6: note = Synthetic Construct
KKINAK

SEQ ID NO: 22364 - protein, 6 aa, synthetic construct
  REGION 1..6: note = Synthetic Construct
KKINDK

SEQ ID NO: 22365 - protein, 6 aa, synthetic construct
  REGION 1..6: note = Synthetic Construct
KKINEK

SEQ ID NO: 22366 - protein, 6 aa, synthetic construct
  REGION 1..6: note = Synthetic Construct
KKINFK

SEQ ID NO: 22367 - protein, 6 aa, synthetic construct
  REGION 1..6: note = Synthetic Construct
KKINGK

SEQ ID NO: 22368 - protein, 6 aa, synthetic construct
  REGION 1..6: note = Synthetic Construct
KKINHK

SEQ ID NO: 22369 - protein, 6 aa, synthetic construct
  REGION 1..6: note = Synthetic Construct
KKINIK

SEQ ID NO: 22370 - protein, 6 aa, synthetic construct
  REGION 1..6: note = Synthetic Construct
KKINLK

SEQ ID NO: 22371 - protein, 6 aa, synthetic construct
  REGION 1..6: note = Synthetic Construct
KKINNK

SEQ ID NO: 22372 - protein, 6 aa, synthetic construct
  REGION 1..6: note = Synthetic Construct
KKINQK

SEQ ID NO: 22373 - protein, 6 aa, synthetic construct
  REGION 1..6: note = Synthetic Construct
KKINRK

SEQ ID NO: 22374 - protein, 6 aa, synthetic construct
  REGION 1..6: note = Synthetic Construct
KKINSK

SEQ ID NO: 22375 - protein, 6 aa, synthetic construct
  REGION 1..6: note = Synthetic Construct
KKINTK

SEQ ID NO: 22376 - protein, 6 aa, synthetic construct
  REGION 1..6: note = Synthetic Construct
KKINYK

SEQ ID NO: 22377 - protein, 6 aa, synthetic construct
  REGION 1..6: note = Synthetic Construct
KKIQAK

SEQ ID NO: 22378 - protein, 6 aa, synthetic construct
  REGION 1..6: note = Synthetic Construct
KKIQDK

SEQ ID NO: 22379 - protein, 6 aa, synthetic construct
  REGION 1..6: note = Synthetic Construct
KKIQEK

SEQ ID NO: 22380 - protein, 6 aa, synthetic construct
  REGION 1..6: note = Synthetic Construct
KKIQFK

SEQ ID NO: 22381 - protein, 6 aa, synthetic construct
  REGION 1..6: note = Synthetic Construct
KKIQGK

SEQ ID NO: 22382 - protein, 6 aa, synthetic construct
  REGION 1..6: note = Synthetic Construct
KKIQHK

SEQ ID NO: 22383 - protein, 6 aa, synthetic construct
  REGION 1..6: note = Synthetic Construct
KKIQIK

SEQ ID NO: 22384 - protein, 6 aa, synthetic construct
  REGION 1..6: note = Synthetic Construct
KKIQLK

SEQ ID NO: 22385 - protein, 6 aa, synthetic construct
  REGION 1..6: note = Synthetic Construct
KKIQNK

SEQ ID NO: 22386 - protein, 6 aa, synthetic construct
  REGION 1..6: note = Synthetic Construct
KKIQQK

SEQ ID NO: 22387 - protein, 6 aa, synthetic construct
  REGION 1..6: note = Synthetic Construct
KKIQRK

SEQ ID NO: 22388 - protein, 6 aa, synthetic construct
  REGION 1..6: note = Synthetic Construct
KKIQSK

SEQ ID NO: 22389 - protein, 6 aa, synthetic construct
  REGION 1..6: note = Synthetic Construct
KKIQTK

SEQ ID NO: 22390 - protein, 6 aa, synthetic construct
  REGION 1..6: note = Synthetic Construct
KKIQYK

SEQ ID NO: 22391 - protein, 6 aa, synthetic construct
  REGION 1..6: note = Synthetic Construct
KKIRAK

SEQ ID NO: 22392 - protein, 6 aa, synthetic construct
  REGION 1..6: note = Synthetic Construct
KKIRDK

SEQ ID NO: 22393 - protein, 6 aa, synthetic construct
  REGION 1..6: note = Synthetic Construct
KKIREK

SEQ ID NO: 22394 - protein, 6 aa, synthetic construct
  REGION 1..6: note = Synthetic Construct
KKIRFK

SEQ ID NO: 22395 - protein, 6 aa, synthetic construct
  REGION 1..6: note = Synthetic Construct
KKIRGK

SEQ ID NO: 22396 - protein, 6 aa, synthetic construct
  REGION 1..6: note = Synthetic Construct
KKIRHK

SEQ ID NO: 22397 - protein, 6 aa, synthetic construct
  REGION 1..6: note = Synthetic Construct
KKIRIK

SEQ ID NO: 22398 - protein, 6 aa, synthetic construct
  REGION 1..6: note = Synthetic Construct
KKIRLK

SEQ ID NO: 22399 - protein, 6 aa, synthetic construct
  REGION 1..6: note = Synthetic Construct
KKIRNK

SEQ ID NO: 22400 - protein, 6 aa, synthetic construct
  REGION 1..6: note = Synthetic Construct
KKIRQK

SEQ ID NO: 22401 - protein, 6 aa, synthetic construct
  REGION 1..6: note = Synthetic Construct
KKIRRK

SEQ ID NO: 22402 - protein, 6 aa, synthetic construct
  REGION 1..6: note = Synthetic Construct
KKIRSK

SEQ ID NO: 22403 - protein, 6 aa, synthetic construct
  REGION 1..6: note = Synthetic Construct
KKIRTK

SEQ ID NO: 22404 - protein, 6 aa, synthetic construct
  REGION 1..6: note = Synthetic Construct
KKIRYK

SEQ ID NO: 22405 - protein, 6 aa, synthetic construct
  REGION 1..6: note = Synthetic Construct
KKISAK

SEQ ID NO: 22406 - protein, 6 aa, synthetic construct
  REGION 1..6: note = Synthetic Construct
KKISDK

SEQ ID NO: 22407 - protein, 6 aa, synthetic construct
  REGION 1..6: note = Synthetic Construct
KKISEK

SEQ ID NO: 22408 - protein, 6 aa, synthetic construct
  REGION 1..6: note = Synthetic Construct
KKISFK

SEQ ID NO: 22409 - protein, 6 aa, synthetic construct
  REGION 1..6: note = Synthetic Construct
KKISGK

SEQ ID NO: 22410 - protein, 6 aa, synthetic construct
  REGION 1..6: note = Synthetic Construct
KKISHK

SEQ ID NO: 22411 - protein, 6 aa, synthetic construct
  REGION 1..6: note = Synthetic Construct
KKISIK

SEQ ID NO: 22412 - protein, 6 aa, synthetic construct
  REGION 1..6: note = Synthetic Construct
KKISLK

SEQ ID NO: 22413 - protein, 6 aa, synthetic construct
  REGION 1..6: note = Synthetic Construct
KKISNK

SEQ ID NO: 22414 - protein, 6 aa, synthetic construct
  REGION 1..6: note = Synthetic Construct
KKISQK

SEQ ID NO: 22415 - protein, 6 aa, synthetic construct
  REGION 1..6: note = Synthetic Construct
KKISRK

SEQ ID NO: 22416 - protein, 6 aa, synthetic construct
  REGION 1..6: note = Synthetic Construct
KKISSK

SEQ ID NO: 22417 - protein, 6 aa, synthetic construct
  REGION 1..6: note = Synthetic Construct
KKISTK

SEQ ID NO: 22418 - protein, 6 aa, synthetic construct
  REGION 1..6: note = Synthetic Construct
KKISYK

SEQ ID NO: 22419 - protein, 6 aa, synthetic construct
  REGION 1..6: note = Synthetic Construct
KKITAK

SEQ ID NO: 22420 - protein, 6 aa, synthetic construct
  REGION 1..6: note = Synthetic Construct
KKITDK

SEQ ID NO: 22421 - protein, 6 aa, synthetic construct
  REGION 1..6: note = Synthetic Construct
KKITEK

SEQ ID NO: 22422 - protein, 6 aa, synthetic construct
  REGION 1..6: note = Synthetic Construct
KKITFK

SEQ ID NO: 22423 - protein, 6 aa, synthetic construct
  REGION 1..6: note = Synthetic Construct
KKITGK

SEQ ID NO: 22424 - protein, 6 aa, synthetic construct
  REGION 1..6: note = Synthetic Construct
KKITHK

SEQ ID NO: 22425 - protein, 6 aa, synthetic construct
  REGION 1..6: note = Synthetic Construct
KKITIK

SEQ ID NO: 22426 - protein, 6 aa, synthetic construct
  REGION 1..6: note = Synthetic Construct
KKITLK

SEQ ID NO: 22427 - protein, 6 aa, synthetic construct
  REGION 1..6: note = Synthetic Construct
KKITNK

SEQ ID NO: 22428 - protein, 6 aa, synthetic construct
  REGION 1..6: note = Synthetic Construct
KKITQK

SEQ ID NO: 22429 - protein, 6 aa, synthetic construct
  REGION 1..6: note = Synthetic Construct
KKITRK

SEQ ID NO: 22430 - protein, 6 aa, synthetic construct
  REGION 1..6: note = Synthetic Construct
KKITSK

SEQ ID NO: 22431 - protein, 6 aa, synthetic construct
  REGION 1..6: note = Synthetic Construct
KKITTK

SEQ ID NO: 22432 - protein, 6 aa, synthetic construct
  REGION 1..6: note = Synthetic Construct
KKITYK

SEQ ID NO: 22433 - protein, 6 aa, synthetic construct
  REGION 1..6: note = Synthetic Construct
KKIYAK

SEQ ID NO: 22434 - protein, 6 aa, synthetic construct
  REGION 1..6: note = Synthetic Construct
KKIYDK

SEQ ID NO: 22435 - protein, 6 aa, synthetic construct
  REGION 1..6: note = Synthetic Construct
KKIYEK

SEQ ID NO: 22436 - protein, 6 aa, synthetic construct
  REGION 1..6: note = Synthetic Construct
KKIYFK

SEQ ID NO: 22437 - protein, 6 aa, synthetic construct
  REGION 1..6: note = Synthetic Construct
KKIYGK

SEQ ID NO: 22438 - protein, 6 aa, synthetic construct
  REGION 1..6: note = Synthetic Construct
KKIYHK

SEQ ID NO: 22439 - protein, 6 aa, synthetic construct
  REGION 1..6: note = Synthetic Construct
KKIYIK

SEQ ID NO: 22440 - protein, 6 aa, synthetic construct
  REGION 1..6: note = Synthetic Construct
KKIYLK

SEQ ID NO: 22441 - protein, 6 aa, synthetic construct
  REGION 1..6: note = Synthetic Construct
KKIYNK

SEQ ID NO: 22442 - protein, 6 aa, synthetic construct
  REGION 1..6: note = Synthetic Construct
KKIYQK

SEQ ID NO: 22443 - protein, 6 aa, synthetic construct
  REGION 1..6: note = Synthetic Construct
KKIYRK

SEQ ID NO: 22444 - protein, 6 aa, synthetic construct
  REGION 1..6: note = Synthetic Construct
KKIYSK

SEQ ID NO: 22445 - protein, 6 aa, synthetic construct
  REGION 1..6: note = Synthetic Construct
KKIYTK

SEQ ID NO: 22446 - protein, 6 aa, synthetic construct
  REGION 1..6: note = Synthetic Construct
KKIYYK

SEQ ID NO: 22447 - protein, 6 aa, synthetic construct
  REGION 1..6: note = Synthetic Construct
KKLAAK

SEQ ID NO: 22448 - protein, 6 aa, synthetic construct
  REGION 1..6: note = Synthetic Construct
KKLADK

SEQ ID NO: 22449 - protein, 6 aa, synthetic construct
  REGION 1..6: note = Synthetic Construct
KKLAEK

SEQ ID NO: 22450 - protein, 6 aa, synthetic construct
  REGION 1..6: note = Synthetic Construct
KKLAFK

SEQ ID NO: 22451 - protein, 6 aa, synthetic construct
  REGION 1..6: note = Synthetic Construct
KKLAGK

SEQ ID NO: 22452 - protein, 6 aa, synthetic construct
  REGION 1..6: note = Synthetic Construct
KKLAHK

SEQ ID NO: 22453 - protein, 6 aa, synthetic construct
  REGION 1..6: note = Synthetic Construct
KKLAIK

SEQ ID NO: 22454 - protein, 6 aa, synthetic construct
  REGION 1..6: note = Synthetic Construct
KKLALK

SEQ ID NO: 22455 - protein, 6 aa, synthetic construct
  REGION 1..6: note = Synthetic Construct
KKLANK

SEQ ID NO: 22456 - protein, 6 aa, synthetic construct
  REGION 1..6: note = Synthetic Construct
KKLAQK

SEQ ID NO: 22457 - protein, 6 aa, synthetic construct
  REGION 1..6: note = Synthetic Construct
KKLARK

SEQ ID NO: 22458 - protein, 6 aa, synthetic construct
  REGION 1..6: note = Synthetic Construct
KKLASK

SEQ ID NO: 22459 - protein, 6 aa, synthetic construct
  REGION 1..6: note = Synthetic Construct
KKLATK

SEQ ID NO: 22460 - protein, 6 aa, synthetic construct
  REGION 1..6: note = Synthetic Construct
KKLAYK

SEQ ID NO: 22461 - protein, 6 aa, synthetic construct
  REGION 1..6: note = Synthetic Construct
KKLDAK

SEQ ID NO: 22462 - protein, 6 aa, synthetic construct
  REGION 1..6: note = Synthetic Construct
KKLDDK

SEQ ID NO: 22463 - protein, 6 aa, synthetic construct
  REGION 1..6: note = Synthetic Construct
KKLDEK

SEQ ID NO: 22464 - protein, 6 aa, synthetic construct
  REGION 1..6: note = Synthetic Construct
KKLDFK

SEQ ID NO: 22465 - protein, 6 aa, synthetic construct
  REGION 1..6: note = Synthetic Construct
KKLDGK

SEQ ID NO: 22466 - protein, 6 aa, synthetic construct
  REGION 1..6: note = Synthetic Construct
KKLDHK

SEQ ID NO: 22467 - protein, 6 aa, synthetic construct
  REGION 1..6: note = Synthetic Construct
KKLDIK

SEQ ID NO: 22468 - protein, 6 aa, synthetic construct
  REGION 1..6: note = Synthetic Construct
KKLDLK

SEQ ID NO: 22469 - protein, 6 aa, synthetic construct
  REGION 1..6: note = Synthetic Construct
KKLDNK

SEQ ID NO: 22470 - protein, 6 aa, synthetic construct
  REGION 1..6: note = Synthetic Construct
KKLDQK

SEQ ID NO: 22471 - protein, 6 aa, synthetic construct
  REGION 1..6: note = Synthetic Construct
KKLDRK

SEQ ID NO: 22472 - protein, 6 aa, synthetic construct
  REGION 1..6: note = Synthetic Construct
KKLDSK

SEQ ID NO: 22473 - protein, 6 aa, synthetic construct
  REGION 1..6: note = Synthetic Construct
KKLDTK

SEQ ID NO: 22474 - protein, 6 aa, synthetic construct
  REGION 1..6: note = Synthetic Construct
KKLDYK

SEQ ID NO: 22475 - protein, 6 aa, synthetic construct
  REGION 1..6: note = Synthetic Construct
KKLEAK

SEQ ID NO: 22476 - protein, 6 aa, synthetic construct
  REGION 1..6: note = Synthetic Construct
KKLEDK

SEQ ID NO: 22477 - protein, 6 aa, synthetic construct
  REGION 1..6: note = Synthetic Construct
KKLEEK

SEQ ID NO: 22478 - protein, 6 aa, synthetic construct
  REGION 1..6: note = Synthetic Construct
KKLEFK

SEQ ID NO: 22479 - protein, 6 aa, synthetic construct
  REGION 1..6: note = Synthetic Construct
KKLEGK

SEQ ID NO: 22480 - protein, 6 aa, synthetic construct
  REGION 1..6: note = Synthetic Construct
KKLEHK

SEQ ID NO: 22481 - protein, 6 aa, synthetic construct
  REGION 1..6: note = Synthetic Construct
KKLEIK

SEQ ID NO: 22482 - protein, 6 aa, synthetic construct
  REGION 1..6: note = Synthetic Construct
KKLELK

SEQ ID NO: 22483 - protein, 6 aa, synthetic construct
  REGION 1..6: note = Synthetic Construct
KKLENK

SEQ ID NO: 22484 - protein, 6 aa, synthetic construct
  REGION 1..6: note = Synthetic Construct
KKLEQK

SEQ ID NO: 22485 - protein, 6 aa, synthetic construct
  REGION 1..6: note = Synthetic Construct
KKLERK

SEQ ID NO: 22486 - protein, 6 aa, synthetic construct
  REGION 1..6: note = Synthetic Construct
KKLESK

SEQ ID NO: 22487 - protein, 6 aa, synthetic construct
  REGION 1..6: note = Synthetic Construct
KKLETK

SEQ ID NO: 22488 - protein, 6 aa, synthetic construct
  REGION 1..6: note = Synthetic Construct
KKLEYK

SEQ ID NO: 22489 - protein, 6 aa, synthetic construct
  REGION 1..6: note = Synthetic Construct
KKLFAK

SEQ ID NO: 22490 - protein, 6 aa, synthetic construct
  REGION 1..6: note = Synthetic Construct
KKLFDK

SEQ ID NO: 22491 - protein, 6 aa, synthetic construct
  REGION 1..6: note = Synthetic Construct
KKLFEK

SEQ ID NO: 22492 - protein, 6 aa, synthetic construct
  REGION 1..6: note = Synthetic Construct
KKLFFK

SEQ ID NO: 22493 - protein, 6 aa, synthetic construct
  REGION 1..6: note = Synthetic Construct
KKLFGK

SEQ ID NO: 22494 - protein, 6 aa, synthetic construct
  REGION 1..6: note = Synthetic Construct
KKLFHK

SEQ ID NO: 22495 - protein, 6 aa, synthetic construct
  REGION 1..6: note = Synthetic Construct
KKLFIK

SEQ ID NO: 22496 - protein, 6 aa, synthetic construct
  REGION 1..6: note = Synthetic Construct
KKLFLK

SEQ ID NO: 22497 - protein, 6 aa, synthetic construct
  REGION 1..6: note = Synthetic Construct
KKLFNK

SEQ ID NO: 22498 - protein, 6 aa, synthetic construct
  REGION 1..6: note = Synthetic Construct
KKLFQK

SEQ ID NO: 22499 - protein, 6 aa, synthetic construct
  REGION 1..6: note = Synthetic Construct
KKLFRK

SEQ ID NO: 22500 - protein, 6 aa, synthetic construct
  REGION 1..6: note = Synthetic Construct
KKLFSK

SEQ ID NO: 22501 - protein, 6 aa, synthetic construct
  REGION 1..6: note = Synthetic Construct
KKLFTK

SEQ ID NO: 22502 - protein, 6 aa, synthetic construct
  REGION 1..6: note = Synthetic Construct
KKLFYK

SEQ ID NO: 22503 - protein, 6 aa, synthetic construct
  REGION 1..6: note = Synthetic Construct
KKLGAK

SEQ ID NO: 22504 - protein, 6 aa, synthetic construct
  REGION 1..6: note = Synthetic Construct
KKLGDK

SEQ ID NO: 22505 - protein, 6 aa, synthetic construct
  REGION 1..6: note = Synthetic Construct
KKLGEK

SEQ ID NO: 22506 - protein, 6 aa, synthetic construct
  REGION 1..6: note = Synthetic Construct
KKLGFK

SEQ ID NO: 22507 - protein, 6 aa, synthetic construct
  REGION 1..6: note = Synthetic Construct
KKLGGK

SEQ ID NO: 22508 - protein, 6 aa, synthetic construct
  REGION 1..6: note = Synthetic Construct
KKLGHK

SEQ ID NO: 22509 - protein, 6 aa, synthetic construct
  REGION 1..6: note = Synthetic Construct
KKLGIK

SEQ ID NO: 22510 - protein, 6 aa, synthetic construct
  REGION 1..6: note = Synthetic Construct
KKLGLK

SEQ ID NO: 22511 - protein, 6 aa, synthetic construct
  REGION 1..6: note = Synthetic Construct
KKLGNK

SEQ ID NO: 22512 - protein, 6 aa, synthetic construct
  REGION 1..6: note = Synthetic Construct
KKLGQK

SEQ ID NO: 22513 - protein, 6 aa, synthetic construct
  REGION 1..6: note = Synthetic Construct
KKLGRK

SEQ ID NO: 22514 - protein, 6 aa, synthetic construct
  REGION 1..6: note = Synthetic Construct
KKLGSK

SEQ ID NO: 22515 - protein, 6 aa, synthetic construct
  REGION 1..6: note = Synthetic Construct
KKLGTK

SEQ ID NO: 22516 - protein, 6 aa, synthetic construct
  REGION 1..6: note = Synthetic Construct
KKLGYK

SEQ ID NO: 22517 - protein, 6 aa, synthetic construct
  REGION 1..6: note = Synthetic Construct
KKLHAK

SEQ ID NO: 22518 - protein, 6 aa, synthetic construct
  REGION 1..6: note = Synthetic Construct
KKLHDK

SEQ ID NO: 22519 - protein, 6 aa, synthetic construct
  REGION 1..6: note = Synthetic Construct
KKLHEK

SEQ ID NO: 22520 - protein, 6 aa, synthetic construct
  REGION 1..6: note = Synthetic Construct
KKLHFK

SEQ ID NO: 22521 - protein, 6 aa, synthetic construct
  REGION 1..6: note = Synthetic Construct
KKLHGK

SEQ ID NO: 22522 - protein, 6 aa, synthetic construct
  REGION 1..6: note = Synthetic Construct
KKLHHK

SEQ ID NO: 22523 - protein, 6 aa, synthetic construct
  REGION 1..6: note = Synthetic Construct
KKLHIK

SEQ ID NO: 22524 - protein, 6 aa, synthetic construct
  REGION 1..6: note = Synthetic Construct
KKLHLK

SEQ ID NO: 22525 - protein, 6 aa, synthetic construct
  REGION 1..6: note = Synthetic Construct
KKLHNK

SEQ ID NO: 22526 - protein, 6 aa, synthetic construct
  REGION 1..6: note = Synthetic Construct
KKLHQK

SEQ ID NO: 22527 - protein, 6 aa, synthetic construct
  REGION 1..6: note = Synthetic Construct
KKLHRK

SEQ ID NO: 22528 - protein, 6 aa, synthetic construct
  REGION 1..6: note = Synthetic Construct
KKLHSK

SEQ ID NO: 22529 - protein, 6 aa, synthetic construct
  REGION 1..6: note = Synthetic Construct
KKLHTK

SEQ ID NO: 22530 - protein, 6 aa, synthetic construct
  REGION 1..6: note = Synthetic Construct
KKLHYK

SEQ ID NO: 22531 - protein, 6 aa, synthetic construct
  REGION 1..6: note = Synthetic Construct
KKLIAK

SEQ ID NO: 22532 - protein, 6 aa, synthetic construct
  REGION 1..6: note = Synthetic Construct
KKLIDK

SEQ ID NO: 22533 - protein, 6 aa, synthetic construct
  REGION 1..6: note = Synthetic Construct
KKLIEK

SEQ ID NO: 22534 - protein, 6 aa, synthetic construct
  REGION 1..6: note = Synthetic Construct
KKLIFK

SEQ ID NO: 22535 - protein, 6 aa, synthetic construct
  REGION 1..6: note = Synthetic Construct
KKLIGK

SEQ ID NO: 22536 - protein, 6 aa, synthetic construct
  REGION 1..6: note = Synthetic Construct
KKLIHK

SEQ ID NO: 22537 - protein, 6 aa, synthetic construct
  REGION 1..6: note = Synthetic Construct
KKLIIK

SEQ ID NO: 22538 - protein, 6 aa, synthetic construct
  REGION 1..6: note = Synthetic Construct
KKLILK

SEQ ID NO: 22539 - protein, 6 aa, synthetic construct
  REGION 1..6: note = Synthetic Construct
KKLINK

SEQ ID NO: 22540 - protein, 6 aa, synthetic construct
  REGION 1..6: note = Synthetic Construct
KKLIQK

SEQ ID NO: 22541 - protein, 6 aa, synthetic construct
  REGION 1..6: note = Synthetic Construct
KKLIRK

SEQ ID NO: 22542 - protein, 6 aa, synthetic construct
  REGION 1..6: note = Synthetic Construct
KKLISK

SEQ ID NO: 22543 - protein, 6 aa, synthetic construct
  REGION 1..6: note = Synthetic Construct
KKLITK

SEQ ID NO: 22544 - protein, 6 aa, synthetic construct
  REGION 1..6: note = Synthetic Construct
KKLIYK

SEQ ID NO: 22545 - protein, 6 aa, synthetic construct
  REGION 1..6: note = Synthetic Construct
KKLLAK

SEQ ID NO: 22546 - protein, 6 aa, synthetic construct
  REGION 1..6: note = Synthetic Construct
KKLLDK

SEQ ID NO: 22547 - protein, 6 aa, synthetic construct
  REGION 1..6: note = Synthetic Construct
KKLLEK

SEQ ID NO: 22548 - protein, 6 aa, synthetic construct
  REGION 1..6: note = Synthetic Construct
KKLLFK

SEQ ID NO: 22549 - protein, 6 aa, synthetic construct
  REGION 1..6: note = Synthetic Construct
KKLLGK

SEQ ID NO: 22550 - protein, 6 aa, synthetic construct
  REGION 1..6: note = Synthetic Construct
KKLLHK

SEQ ID NO: 22551 - protein, 6 aa, synthetic construct
  REGION 1..6: note = Synthetic Construct
KKLLIK

SEQ ID NO: 22552 - protein, 6 aa, synthetic construct
  REGION 1..6: note = Synthetic Construct
KKLLLK

SEQ ID NO: 22553 - protein, 6 aa, synthetic construct
  REGION 1..6: note = Synthetic Construct
KKLLNK

SEQ ID NO: 22554 - protein, 6 aa, synthetic construct
  REGION 1..6: note = Synthetic Construct
KKLLQK

SEQ ID NO: 22555 - protein, 6 aa, synthetic construct
  REGION 1..6: note = Synthetic Construct
KKLLRK

SEQ ID NO: 22556 - protein, 6 aa, synthetic construct
  REGION 1..6: note = Synthetic Construct
KKLLSK

SEQ ID NO: 22557 - protein, 6 aa, synthetic construct
  REGION 1..6: note = Synthetic Construct
KKLLTK

SEQ ID NO: 22558 - protein, 6 aa, synthetic construct
  REGION 1..6: note = Synthetic Construct
KKLLYK

SEQ ID NO: 22559 - protein, 6 aa, synthetic construct
  REGION 1..6: note = Synthetic Construct
KKLNAK

SEQ ID NO: 22560 - protein, 6 aa, synthetic construct
  REGION 1..6: note = Synthetic Construct
KKLNDK

SEQ ID NO: 22561 - protein, 6 aa, synthetic construct
  REGION 1..6: note = Synthetic Construct
KKLNEK

SEQ ID NO: 22562 - protein, 6 aa, synthetic construct
  REGION 1..6: note = Synthetic Construct
KKLNFK

SEQ ID NO: 22563 - protein, 6 aa, synthetic construct
  REGION 1..6: note = Synthetic Construct
KKLNGK

SEQ ID NO: 22564 - protein, 6 aa, synthetic construct
  REGION 1..6: note = Synthetic Construct
KKLNHK

SEQ ID NO: 22565 - protein, 6 aa, synthetic construct
  REGION 1..6: note = Synthetic Construct
KKLNIK

SEQ ID NO: 22566 - protein, 6 aa, synthetic construct
  REGION 1..6: note = Synthetic Construct
KKLNLK

SEQ ID NO: 22567 - protein, 6 aa, synthetic construct
  REGION 1..6: note = Synthetic Construct
KKLNNK

SEQ ID NO: 22568 - protein, 6 aa, synthetic construct
  REGION 1..6: note = Synthetic Construct
KKLNQK

SEQ ID NO: 22569 - protein, 6 aa, synthetic construct
  REGION 1..6: note = Synthetic Construct
KKLNRK

SEQ ID NO: 22570 - protein, 6 aa, synthetic construct
  REGION 1..6: note = Synthetic Construct
KKLNSK

SEQ ID NO: 22571 - protein, 6 aa, synthetic construct
  REGION 1..6: note = Synthetic Construct
KKLNTK

SEQ ID NO: 22572 - protein, 6 aa, synthetic construct
  REGION 1..6: note = Synthetic Construct
KKLNYK

SEQ ID NO: 22573 - protein, 6 aa, synthetic construct
  REGION 1..6: note = Synthetic Construct
KKLQAK

SEQ ID NO: 22574 - protein, 6 aa, synthetic construct
  REGION 1..6: note = Synthetic Construct
KKLQDK

SEQ ID NO: 22575 - protein, 6 aa, synthetic construct
  REGION 1..6: note = Synthetic Construct
KKLQEK

SEQ ID NO: 22576 - protein, 6 aa, synthetic construct
  REGION 1..6: note = Synthetic Construct
KKLQFK

SEQ ID NO: 22577 - protein, 6 aa, synthetic construct
  REGION 1..6: note = Synthetic Construct
KKLQGK

SEQ ID NO: 22578 - protein, 6 aa, synthetic construct
  REGION 1..6: note = Synthetic Construct
KKLQHK

SEQ ID NO: 22579 - protein, 6 aa, synthetic construct
  REGION 1..6: note = Synthetic Construct
KKLQIK

SEQ ID NO: 22580 - protein, 6 aa, synthetic construct
  REGION 1..6: note = Synthetic Construct
KKLQLK

SEQ ID NO: 22581 - protein, 6 aa, synthetic construct
  REGION 1..6: note = Synthetic Construct
KKLQNK

SEQ ID NO: 22582 - protein, 6 aa, synthetic construct
  REGION 1..6: note = Synthetic Construct
KKLQQK

SEQ ID NO: 22583 - protein, 6 aa, synthetic construct
  REGION 1..6: note = Synthetic Construct
KKLQRK

SEQ ID NO: 22584 - protein, 6 aa, synthetic construct
  REGION 1..6: note = Synthetic Construct
KKLQSK

SEQ ID NO: 22585 - protein, 6 aa, synthetic construct
  REGION 1..6: note = Synthetic Construct
KKLQTK

SEQ ID NO: 22586 - protein, 6 aa, synthetic construct
  REGION 1..6: note = Synthetic Construct
KKLQYK

SEQ ID NO: 22587 - protein, 6 aa, synthetic construct
  REGION 1..6: note = Synthetic Construct
KKLRAK

SEQ ID NO: 22588 - protein, 6 aa, synthetic construct
  REGION 1..6: note = Synthetic Construct
KKLRDK

SEQ ID NO: 22589 - protein, 6 aa, synthetic construct
  REGION 1..6: note = Synthetic Construct
KKLREK

SEQ ID NO: 22590 - protein, 6 aa, synthetic construct
  REGION 1..6: note = Synthetic Construct
KKLRFK

SEQ ID NO: 22591 - protein, 6 aa, synthetic construct
  REGION 1..6: note = Synthetic Construct
KKLRGK

SEQ ID NO: 22592 - protein, 6 aa, synthetic construct
  REGION 1..6: note = Synthetic Construct
KKLRHK

SEQ ID NO: 22593 - protein, 6 aa, synthetic construct
  REGION 1..6: note = Synthetic Construct
KKLRIK

SEQ ID NO: 22594 - protein, 6 aa, synthetic construct
  REGION 1..6: note = Synthetic Construct
KKLRLK

SEQ ID NO: 22595 - protein, 6 aa, synthetic construct
  REGION 1..6: note = Synthetic Construct
KKLRNK

SEQ ID NO: 22596 - protein, 6 aa, synthetic construct
  REGION 1..6: note = Synthetic Construct
KKLRQK

SEQ ID NO: 22597 - protein, 6 aa, synthetic construct
  REGION 1..6: note = Synthetic Construct
KKLRRK

SEQ ID NO: 22598 - protein, 6 aa, synthetic construct
  REGION 1..6: note = Synthetic Construct
KKLRSK

SEQ ID NO: 22599 - protein, 6 aa, synthetic construct
  REGION 1..6: note = Synthetic Construct
KKLRTK

SEQ ID NO: 22600 - protein, 6 aa, synthetic construct
  REGION 1..6: note = Synthetic Construct
KKLRYK

SEQ ID NO: 22601 - protein, 6 aa, synthetic construct
  REGION 1..6: note = Synthetic Construct
KKLSAK

SEQ ID NO: 22602 - protein, 6 aa, synthetic construct
  REGION 1..6: note = Synthetic Construct
KKLSDK

SEQ ID NO: 22603 - protein, 6 aa, synthetic construct
  REGION 1..6: note = Synthetic Construct
KKLSEK

SEQ ID NO: 22604 - protein, 6 aa, synthetic construct
  REGION 1..6: note = Synthetic Construct
KKLSFK

SEQ ID NO: 22605 - protein, 6 aa, synthetic construct
  REGION 1..6: note = Synthetic Construct
KKLSGK

SEQ ID NO: 22606 - protein, 6 aa, synthetic construct
  REGION 1..6: note = Synthetic Construct
KKLSHK

SEQ ID NO: 22607 - protein, 6 aa, synthetic construct
  REGION 1..6: note = Synthetic Construct
KKLSIK

SEQ ID NO: 22608 - protein, 6 aa, synthetic construct
  REGION 1..6: note = Synthetic Construct
KKLSLK

SEQ ID NO: 22609 - protein, 6 aa, synthetic construct
  REGION 1..6: note = Synthetic Construct
KKLSNK

SEQ ID NO: 22610 - protein, 6 aa, synthetic construct
  REGION 1..6: note = Synthetic Construct
KKLSQK

SEQ ID NO: 22611 - protein, 6 aa, synthetic construct
  REGION 1..6: note = Synthetic Construct
KKLSRK

SEQ ID NO: 22612 - protein, 6 aa, synthetic construct
  REGION 1..6: note = Synthetic Construct
KKLSSK

SEQ ID NO: 22613 - protein, 6 aa, synthetic construct
  REGION 1..6: note = Synthetic Construct
KKLSTK

SEQ ID NO: 22614 - protein, 6 aa, synthetic construct
  REGION 1..6: note = Synthetic Construct
KKLSYK

SEQ ID NO: 22615 - protein, 6 aa, synthetic construct
  REGION 1..6: note = Synthetic Construct
KKLTAK

SEQ ID NO: 22616 - protein, 6 aa, synthetic construct
  REGION 1..6: note = Synthetic Construct
KKLTDK

SEQ ID NO: 22617 - protein, 6 aa, synthetic construct
  REGION 1..6: note = Synthetic Construct
KKLTEK

SEQ ID NO: 22618 - protein, 6 aa, synthetic construct
  REGION 1..6: note = Synthetic Construct
KKLTFK

SEQ ID NO: 22619 - protein, 6 aa, synthetic construct
  REGION 1..6: note = Synthetic Construct
KKLTGK

SEQ ID NO: 22620 - protein, 6 aa, synthetic construct
  REGION 1..6: note = Synthetic Construct
KKLTHK

SEQ ID NO: 22621 - protein, 6 aa, synthetic construct
  REGION 1..6: note = Synthetic Construct
KKLTIK

SEQ ID NO: 22622 - protein, 6 aa, synthetic construct
  REGION 1..6: note = Synthetic Construct
KKLTLK

SEQ ID NO: 22623 - protein, 6 aa, synthetic construct
  REGION 1..6: note = Synthetic Construct
KKLTNK

SEQ ID NO: 22624 - protein, 6 aa, synthetic construct
  REGION 1..6: note = Synthetic Construct
KKLTQK

SEQ ID NO: 22625 - protein, 6 aa, synthetic construct
  REGION 1..6: note = Synthetic Construct
KKLTRK

SEQ ID NO: 22626 - protein, 6 aa, synthetic construct
  REGION 1..6: note = Synthetic Construct
KKLTSK

SEQ ID NO: 22627 - protein, 6 aa, synthetic construct
  REGION 1..6: note = Synthetic Construct
KKLTTK

SEQ ID NO: 22628 - protein, 6 aa, synthetic construct
  REGION 1..6: note = Synthetic Construct
KKLTYK

SEQ ID NO: 22629 - protein, 6 aa, synthetic construct
  REGION 1..6: note = Synthetic Construct
KKLYAK

SEQ ID NO: 22630 - protein, 6 aa, synthetic construct
  REGION 1..6: note = Synthetic Construct
KKLYDK

SEQ ID NO: 22631 - protein, 6 aa, synthetic construct
  REGION 1..6: note = Synthetic Construct
KKLYEK

SEQ ID NO: 22632 - protein, 6 aa, synthetic construct
  REGION 1..6: note = Synthetic Construct
KKLYFK

SEQ ID NO: 22633 - protein, 6 aa, synthetic construct
  REGION 1..6: note = Synthetic Construct
KKLYGK

SEQ ID NO: 22634 - protein, 6 aa, synthetic construct
  REGION 1..6: note = Synthetic Construct
KKLYHK

SEQ ID NO: 22635 - protein, 6 aa, synthetic construct
  REGION 1..6: note = Synthetic Construct
KKLYIK

SEQ ID NO: 22636 - protein, 6 aa, synthetic construct
  REGION 1..6: note = Synthetic Construct
KKLYLK

SEQ ID NO: 22637 - protein, 6 aa, synthetic construct
  REGION 1..6: note = Synthetic Construct
KKLYNK

SEQ ID NO: 22638 - protein, 6 aa, synthetic construct
  REGION 1..6: note = Synthetic Construct
KKLYQK

SEQ ID NO: 22639 - protein, 6 aa, synthetic construct
  REGION 1..6: note = Synthetic Construct
KKLYRK

SEQ ID NO: 22640 - protein, 6 aa, synthetic construct
  REGION 1..6: note = Synthetic Construct
KKLYSK

SEQ ID NO: 22641 - protein, 6 aa, synthetic construct
  REGION 1..6: note = Synthetic Construct
KKLYTK

SEQ ID NO: 22642 - protein, 6 aa, synthetic construct
  REGION 1..6: note = Synthetic Construct
KKLYYK

SEQ ID NO: 22643 - protein, 6 aa, synthetic construct
  REGION 1..6: note = Synthetic Construct
KKNAAK

SEQ ID NO: 22644 - protein, 6 aa, synthetic construct
  REGION 1..6: note = Synthetic Construct
KKNADK

SEQ ID NO: 22645 - protein, 6 aa, synthetic construct
  REGION 1..6: note = Synthetic Construct
KKNAEK

SEQ ID NO: 22646 - protein, 6 aa, synthetic construct
  REGION 1..6: note = Synthetic Construct
KKNAFK

SEQ ID NO: 22647 - protein, 6 aa, synthetic construct
  REGION 1..6: note = Synthetic Construct
KKNAGK

SEQ ID NO: 22648 - protein, 6 aa, synthetic construct
  REGION 1..6: note = Synthetic Construct
KKNAHK

SEQ ID NO: 22649 - protein, 6 aa, synthetic construct
  REGION 1..6: note = Synthetic Construct
KKNAIK

SEQ ID NO: 22650 - protein, 6 aa, synthetic construct
  REGION 1..6: note = Synthetic Construct
KKNALK

SEQ ID NO: 22651 - protein, 6 aa, synthetic construct
  REGION 1..6: note = Synthetic Construct
KKNANK

SEQ ID NO: 22652 - protein, 6 aa, synthetic construct
  REGION 1..6: note = Synthetic Construct
KKNAQK

SEQ ID NO: 22653 - protein, 6 aa, synthetic construct
  REGION 1..6: note = Synthetic Construct
KKNARK

SEQ ID NO: 22654 - protein, 6 aa, synthetic construct
  REGION 1..6: note = Synthetic Construct
KKNASK

SEQ ID NO: 22655 - protein, 6 aa, synthetic construct
  REGION 1..6: note = Synthetic Construct
KKNATK

SEQ ID NO: 22656 - protein, 6 aa, synthetic construct
  REGION 1..6: note = Synthetic Construct
KKNAYK

SEQ ID NO: 22657 - protein, 6 aa, synthetic construct
  REGION 1..6: note = Synthetic Construct
KKNDAK

SEQ ID NO: 22658 - protein, 6 aa, synthetic construct
  REGION 1..6: note = Synthetic Construct
KKNDDK

SEQ ID NO: 22659 - protein, 6 aa, synthetic construct
  REGION 1..6: note = Synthetic Construct
KKNDEK

SEQ ID NO: 22660 - protein, 6 aa, synthetic construct
  REGION 1..6: note = Synthetic Construct
KKNDFK

SEQ ID NO: 22661 - protein, 6 aa, synthetic construct
  REGION 1..6: note = Synthetic Construct
KKNDGK

SEQ ID NO: 22662 - protein, 6 aa, synthetic construct
  REGION 1..6: note = Synthetic Construct
KKNDHK

SEQ ID NO: 22663 - protein, 6 aa, synthetic construct
  REGION 1..6: note = Synthetic Construct
KKNDIK

SEQ ID NO: 22664 - protein, 6 aa, synthetic construct
  REGION 1..6: note = Synthetic Construct
KKNDLK

SEQ ID NO: 22665 - protein, 6 aa, synthetic construct
  REGION 1..6: note = Synthetic Construct
KKNDNK

SEQ ID NO: 22666 - protein, 6 aa, synthetic construct
  REGION 1..6: note = Synthetic Construct
KKNDQK

SEQ ID NO: 22667 - protein, 6 aa, synthetic construct
  REGION 1..6: note = Synthetic Construct
KKNDRK

SEQ ID NO: 22668 - protein, 6 aa, synthetic construct
  REGION 1..6: note = Synthetic Construct
KKNDSK

SEQ ID NO: 22669 - protein, 6 aa, synthetic construct
  REGION 1..6: note = Synthetic Construct
KKNDTK

SEQ ID NO: 22670 - protein, 6 aa, synthetic construct
  REGION 1..6: note = Synthetic Construct
KKNDYK

SEQ ID NO: 22671 - protein, 6 aa, synthetic construct
  REGION 1..6: note = Synthetic Construct
KKNEAK

SEQ ID NO: 22672 - protein, 6 aa, synthetic construct
  REGION 1..6: note = Synthetic Construct
KKNEDK

SEQ ID NO: 22673 - protein, 6 aa, synthetic construct
  REGION 1..6: note = Synthetic Construct
KKNEEK

SEQ ID NO: 22674 - protein, 6 aa, synthetic construct
  REGION 1..6: note = Synthetic Construct
KKNEFK

SEQ ID NO: 22675 - protein, 6 aa, synthetic construct
  REGION 1..6: note = Synthetic Construct
KKNEGK

SEQ ID NO: 22676 - protein, 6 aa, synthetic construct
  REGION 1..6: note = Synthetic Construct
KKNEHK

SEQ ID NO: 22677 - protein, 6 aa, synthetic construct
  REGION 1..6: note = Synthetic Construct
KKNEIK

SEQ ID NO: 22678 - protein, 6 aa, synthetic construct
  REGION 1..6: note = Synthetic Construct
KKNELK

SEQ ID NO: 22679 - protein, 6 aa, synthetic construct
  REGION 1..6: note = Synthetic Construct
KKNENK

SEQ ID NO: 22680 - protein, 6 aa, synthetic construct
  REGION 1..6: note = Synthetic Construct
KKNEQK

SEQ ID NO: 22681 - protein, 6 aa, synthetic construct
  REGION 1..6: note = Synthetic Construct
KKNERK

SEQ ID NO: 22682 - protein, 6 aa, synthetic construct
  REGION 1..6: note = Synthetic Construct
KKNESK

SEQ ID NO: 22683 - protein, 6 aa, synthetic construct
  REGION 1..6: note = Synthetic Construct
KKNETK

SEQ ID NO: 22684 - protein, 6 aa, synthetic construct
  REGION 1..6: note = Synthetic Construct
KKNEYK

SEQ ID NO: 22685 - protein, 6 aa, synthetic construct
  REGION 1..6: note = Synthetic Construct
KKNFAK

SEQ ID NO: 22686 - protein, 6 aa, synthetic construct
  REGION 1..6: note = Synthetic Construct
KKNFDK

SEQ ID NO: 22687 - protein, 6 aa, synthetic construct
  REGION 1..6: note = Synthetic Construct
KKNFEK

SEQ ID NO: 22688 - protein, 6 aa, synthetic construct
  REGION 1..6: note = Synthetic Construct
KKNFFK

SEQ ID NO: 22689 - protein, 6 aa, synthetic construct
  REGION 1..6: note = Synthetic Construct
KKNFGK

SEQ ID NO: 22690 - protein, 6 aa, synthetic construct
  REGION 1..6: note = Synthetic Construct
KKNFHK

SEQ ID NO: 22691 - protein, 6 aa, synthetic construct
  REGION 1..6: note = Synthetic Construct
KKNFIK

SEQ ID NO: 22692 - protein, 6 aa, synthetic construct
  REGION 1..6: note = Synthetic Construct
KKNFLK

SEQ ID NO: 22693 - protein, 6 aa, synthetic construct
  REGION 1..6: note = Synthetic Construct
KKNFNK

SEQ ID NO: 22694 - protein, 6 aa, synthetic construct
  REGION 1..6: note = Synthetic Construct
KKNFQK

SEQ ID NO: 22695 - protein, 6 aa, synthetic construct
  REGION 1..6: note = Synthetic Construct
KKNFRK

SEQ ID NO: 22696 - protein, 6 aa, synthetic construct
  REGION 1..6: note = Synthetic Construct
KKNFSK

SEQ ID NO: 22697 - protein, 6 aa, synthetic construct
  REGION 1..6: note = Synthetic Construct
KKNFTK

SEQ ID NO: 22698 - protein, 6 aa, synthetic construct
  REGION 1..6: note = Synthetic Construct
KKNFYK

SEQ ID NO: 22699 - protein, 6 aa, synthetic construct
  REGION 1..6: note = Synthetic Construct
KKNGAK

SEQ ID NO: 22700 - protein, 6 aa, synthetic construct
  REGION 1..6: note = Synthetic Construct
KKNGDK

SEQ ID NO: 22701 - protein, 6 aa, synthetic construct
  REGION 1..6: note = Synthetic Construct
KKNGEK

SEQ ID NO: 22702 - protein, 6 aa, synthetic construct
  REGION 1..6: note = Synthetic Construct
KKNGFK

SEQ ID NO: 22703 - protein, 6 aa, synthetic construct
  REGION 1..6: note = Synthetic Construct
KKNGGK

SEQ ID NO: 22704 - protein, 6 aa, synthetic construct
  REGION 1..6: note = Synthetic Construct
KKNGHK

SEQ ID NO: 22705 - protein, 6 aa, synthetic construct
  REGION 1..6: note = Synthetic Construct
KKNGIK

SEQ ID NO: 22706 - protein, 6 aa, synthetic construct
  REGION 1..6: note = Synthetic Construct
KKNGLK

SEQ ID NO: 22707 - protein, 6 aa, synthetic construct
  REGION 1..6: note = Synthetic Construct
KKNGNK

SEQ ID NO: 22708 - protein, 6 aa, synthetic construct
  REGION 1..6: note = Synthetic Construct
KKNGQK

SEQ ID NO: 22709 - protein, 6 aa, synthetic construct
  REGION 1..6: note = Synthetic Construct
KKNGRK

SEQ ID NO: 22710 - protein, 6 aa, synthetic construct
  REGION 1..6: note = Synthetic Construct
KKNGSK

SEQ ID NO: 22711 - protein, 6 aa, synthetic construct
  REGION 1..6: note = Synthetic Construct
KKNGTK

SEQ ID NO: 22712 - protein, 6 aa, synthetic construct
  REGION 1..6: note = Synthetic Construct
KKNGYK

SEQ ID NO: 22713 - protein, 6 aa, synthetic construct
  REGION 1..6: note = Synthetic Construct
KKNHAK

SEQ ID NO: 22714 - protein, 6 aa, synthetic construct
  REGION 1..6: note = Synthetic Construct
KKNHDK

SEQ ID NO: 22715 - protein, 6 aa, synthetic construct
  REGION 1..6: note = Synthetic Construct
KKNHEK

SEQ ID NO: 22716 - protein, 6 aa, synthetic construct
  REGION 1..6: note = Synthetic Construct
KKNHFK

SEQ ID NO: 22717 - protein, 6 aa, synthetic construct
  REGION 1..6: note = Synthetic Construct
KKNHGK

SEQ ID NO: 22718 - protein, 6 aa, synthetic construct
  REGION 1..6: note = Synthetic Construct
KKNHHK

SEQ ID NO: 22719 - protein, 6 aa, synthetic construct
  REGION 1..6: note = Synthetic Construct
KKNHIK

SEQ ID NO: 22720 - protein, 6 aa, synthetic construct
  REGION 1..6: note = Synthetic Construct
KKNHLK

SEQ ID NO: 22721 - protein, 6 aa, synthetic construct
  REGION 1..6: note = Synthetic Construct
KKNHNK

SEQ ID NO: 22722 - protein, 6 aa, synthetic construct
  REGION 1..6: note = Synthetic Construct
KKNHQK

SEQ ID NO: 22723 - protein, 6 aa, synthetic construct
  REGION 1..6: note = Synthetic Construct
KKNHRK

SEQ ID NO: 22724 - protein, 6 aa, synthetic construct
  REGION 1..6: note = Synthetic Construct
KKNHSK

SEQ ID NO: 22725 - protein, 6 aa, synthetic construct
  REGION 1..6: note = Synthetic Construct
KKNHTK

SEQ ID NO: 22726 - protein, 6 aa, synthetic construct
  REGION 1..6: note = Synthetic Construct
KKNHYK

SEQ ID NO: 22727 - protein, 6 aa, synthetic construct
  REGION 1..6: note = Synthetic Construct
KKNIAK

SEQ ID NO: 22728 - protein, 6 aa, synthetic construct
  REGION 1..6: note = Synthetic Construct
KKNIDK

SEQ ID NO: 22729 - protein, 6 aa, synthetic construct
  REGION 1..6: note = Synthetic Construct
KKNIEK

SEQ ID NO: 22730 - protein, 6 aa, synthetic construct
  REGION 1..6: note = Synthetic Construct
KKNIFK

SEQ ID NO: 22731 - protein, 6 aa, synthetic construct
  REGION 1..6: note = Synthetic Construct
KKNIGK

SEQ ID NO: 22732 - protein, 6 aa, synthetic construct
  REGION 1..6: note = Synthetic Construct
KKNIHK

SEQ ID NO: 22733 - protein, 6 aa, synthetic construct
  REGION 1..6: note = Synthetic Construct
KKNIIK

SEQ ID NO: 22734 - protein, 6 aa, synthetic construct
  REGION 1..6: note = Synthetic Construct
KKNILK

SEQ ID NO: 22735 - protein, 6 aa, synthetic construct
  REGION 1..6: note = Synthetic Construct
KKNINK

SEQ ID NO: 22736 - protein, 6 aa, synthetic construct
  REGION 1..6: note = Synthetic Construct
KKNIQK

SEQ ID NO: 22737 - protein, 6 aa, synthetic construct
  REGION 1..6: note = Synthetic Construct
KKNIRK

SEQ ID NO: 22738 - protein, 6 aa, synthetic construct
  REGION 1..6: note = Synthetic Construct
KKNISK

SEQ ID NO: 22739 - protein, 6 aa, synthetic construct
  REGION 1..6: note = Synthetic Construct
KKNITK

SEQ ID NO: 22740 - protein, 6 aa, synthetic construct
  REGION 1..6: note = Synthetic Construct
KKNIYK

SEQ ID NO: 22741 - protein, 6 aa, synthetic construct
  REGION 1..6: note = Synthetic Construct
KKNLAK

SEQ ID NO: 22742 - protein, 6 aa, synthetic construct
  REGION 1..6: note = Synthetic Construct
KKNLDK

SEQ ID NO: 22743 - protein, 6 aa, synthetic construct
  REGION 1..6: note = Synthetic Construct
KKNLEK

SEQ ID NO: 22744 - protein, 6 aa, synthetic construct
  REGION 1..6: note = Synthetic Construct
KKNLFK

SEQ ID NO: 22745 - protein, 6 aa, synthetic construct
  REGION 1..6: note = Synthetic Construct
KKNLGK

SEQ ID NO: 22746 - protein, 6 aa, synthetic construct
  REGION 1..6: note = Synthetic Construct
KKNLHK

SEQ ID NO: 22747 - protein, 6 aa, synthetic construct
  REGION 1..6: note = Synthetic Construct
KKNLIK

SEQ ID NO: 22748 - protein, 6 aa, synthetic construct
  REGION 1..6: note = Synthetic Construct
KKNLLK

SEQ ID NO: 22749 - protein, 6 aa, synthetic construct
  REGION 1..6: note = Synthetic Construct
KKNLNK

SEQ ID NO: 22750 - protein, 6 aa, synthetic construct
  REGION 1..6: note = Synthetic Construct
KKNLQK

SEQ ID NO: 22751 - protein, 6 aa, synthetic construct
  REGION 1..6: note = Synthetic Construct
KKNLRK

SEQ ID NO: 22752 - protein, 6 aa, synthetic construct
  REGION 1..6: note = Synthetic Construct
KKNLSK

SEQ ID NO: 22753 - protein, 6 aa, synthetic construct
  REGION 1..6: note = Synthetic Construct
KKNLTK

SEQ ID NO: 22754 - protein, 6 aa, synthetic construct
  REGION 1..6: note = Synthetic Construct
KKNLYK

SEQ ID NO: 22755 - protein, 6 aa, synthetic construct
  REGION 1..6: note = Synthetic Construct
KKNNAK

SEQ ID NO: 22756 - protein, 6 aa, synthetic construct
  REGION 1..6: note = Synthetic Construct
KKNNDK

SEQ ID NO: 22757 - protein, 6 aa, synthetic construct
  REGION 1..6: note = Synthetic Construct
KKNNEK

SEQ ID NO: 22758 - protein, 6 aa, synthetic construct
  REGION 1..6: note = Synthetic Construct
KKNNFK

SEQ ID NO: 22759 - protein, 6 aa, synthetic construct
  REGION 1..6: note = Synthetic Construct
KKNNGK

SEQ ID NO: 22760 - protein, 6 aa, synthetic construct
  REGION 1..6: note = Synthetic Construct
KKNNHK

SEQ ID NO: 22761 - protein, 6 aa, synthetic construct
  REGION 1..6: note = Synthetic Construct
KKNNIK

SEQ ID NO: 22762 - protein, 6 aa, synthetic construct
  REGION 1..6: note = Synthetic Construct
KKNNLK

SEQ ID NO: 22763 - protein, 6 aa, synthetic construct
  REGION 1..6: note = Synthetic Construct
KKNNNK

SEQ ID NO: 22764 - protein, 6 aa, synthetic construct
  REGION 1..6: note = Synthetic Construct
KKNNQK

SEQ ID NO: 22765 - protein, 6 aa, synthetic construct
  REGION 1..6: note = Synthetic Construct
KKNNRK

SEQ ID NO: 22766 - protein, 6 aa, synthetic construct
  REGION 1..6: note = Synthetic Construct
KKNNSK

SEQ ID NO: 22767 - protein, 6 aa, synthetic construct
  REGION 1..6: note = Synthetic Construct
KKNNTK

SEQ ID NO: 22768 - protein, 6 aa, synthetic construct
  REGION 1..6: note = Synthetic Construct
KKNNYK

SEQ ID NO: 22769 - protein, 6 aa, synthetic construct
  REGION 1..6: note = Synthetic Construct
KKNQAK

SEQ ID NO: 22770 - protein, 6 aa, synthetic construct
  REGION 1..6: note = Synthetic Construct
KKNQDK

SEQ ID NO: 22771 - protein, 6 aa, synthetic construct
  REGION 1..6: note = Synthetic Construct
KKNQEK

SEQ ID NO: 22772 - protein, 6 aa, synthetic construct
  REGION 1..6: note = Synthetic Construct
KKNQFK

SEQ ID NO: 22773 - protein, 6 aa, synthetic construct
  REGION 1..6: note = Synthetic Construct
KKNQGK

SEQ ID NO: 22774 - protein, 6 aa, synthetic construct
  REGION 1..6: note = Synthetic Construct
KKNQHK

SEQ ID NO: 22775 - protein, 6 aa, synthetic construct
  REGION 1..6: note = Synthetic Construct
KKNQIK

SEQ ID NO: 22776 - protein, 6 aa, synthetic construct
  REGION 1..6: note = Synthetic Construct
KKNQLK

SEQ ID NO: 22777 - protein, 6 aa, synthetic construct
  REGION 1..6: note = Synthetic Construct
KKNQNK

SEQ ID NO: 22778 - protein, 6 aa, synthetic construct
  REGION 1..6: note = Synthetic Construct
KKNQQK

SEQ ID NO: 22779 - protein, 6 aa, synthetic construct
  REGION 1..6: note = Synthetic Construct
KKNQRK

SEQ ID NO: 22780 - protein, 6 aa, synthetic construct
  REGION 1..6: note = Synthetic Construct
KKNQSK

SEQ ID NO: 22781 - protein, 6 aa, synthetic construct
  REGION 1..6: note = Synthetic Construct
KKNQTK

SEQ ID NO: 22782 - protein, 6 aa, synthetic construct
  REGION 1..6: note = Synthetic Construct
KKNQYK

SEQ ID NO: 22783 - protein, 6 aa, synthetic construct
  REGION 1..6: note = Synthetic Construct
KKNRAK

SEQ ID NO: 22784 - protein, 6 aa, synthetic construct
  REGION 1..6: note = Synthetic Construct
KKNRDK

SEQ ID NO: 22785 - protein, 6 aa, synthetic construct
  REGION 1..6: note = Synthetic Construct
KKNREK

SEQ ID NO: 22786 - protein, 6 aa, synthetic construct
  REGION 1..6: note = Synthetic Construct
KKNRFK

SEQ ID NO: 22787 - protein, 6 aa, synthetic construct
  REGION 1..6: note = Synthetic Construct
KKNRGK

SEQ ID NO: 22788 - protein, 6 aa, synthetic construct
  REGION 1..6: note = Synthetic Construct
KKNRHK

SEQ ID NO: 22789 - protein, 6 aa, synthetic construct
  REGION 1..6: note = Synthetic Construct
KKNRIK

SEQ ID NO: 22790 - protein, 6 aa, synthetic construct
  REGION 1..6: note = Synthetic Construct
KKNRLK

SEQ ID NO: 22791 - protein, 6 aa, synthetic construct
  REGION 1..6: note = Synthetic Construct
KKNRNK

SEQ ID NO: 22792 - protein, 6 aa, synthetic construct
  REGION 1..6: note = Synthetic Construct
KKNRQK

SEQ ID NO: 22793 - protein, 6 aa, synthetic construct
  REGION 1..6: note = Synthetic Construct
KKNRRK

SEQ ID NO: 22794 - protein, 6 aa, synthetic construct
  REGION 1..6: note = Synthetic Construct
KKNRSK

SEQ ID NO: 22795 - protein, 6 aa, synthetic construct
  REGION 1..6: note = Synthetic Construct
KKNRTK

SEQ ID NO: 22796 - protein, 6 aa, synthetic construct
  REGION 1..6: note = Synthetic Construct
KKNRYK

SEQ ID NO: 22797 - protein, 6 aa, synthetic construct
  REGION 1..6: note = Synthetic Construct
KKNSAK

SEQ ID NO: 22798 - protein, 6 aa, synthetic construct
  REGION 1..6: note = Synthetic Construct
KKNSDK

SEQ ID NO: 22799 - protein, 6 aa, synthetic construct
  REGION 1..6: note = Synthetic Construct
KKNSEK

SEQ ID NO: 22800 - protein, 6 aa, synthetic construct
  REGION 1..6: note = Synthetic Construct
KKNSFK

SEQ ID NO: 22801 - protein, 6 aa, synthetic construct
  REGION 1..6: note = Synthetic Construct
KKNSGK

SEQ ID NO: 22802 - protein, 6 aa, synthetic construct
  REGION 1..6: note = Synthetic Construct
KKNSHK

SEQ ID NO: 22803 - protein, 6 aa, synthetic construct
  REGION 1..6: note = Synthetic Construct
KKNSIK

SEQ ID NO: 22804 - protein, 6 aa, synthetic construct
  REGION 1..6: note = Synthetic Construct
KKNSLK

SEQ ID NO: 22805 - protein, 6 aa, synthetic construct
  REGION 1..6: note = Synthetic Construct
KKNSNK

SEQ ID NO: 22806 - protein, 6 aa, synthetic construct
  REGION 1..6: note = Synthetic Construct
KKNSQK

SEQ ID NO: 22807 - protein, 6 aa, synthetic construct
  REGION 1..6: note = Synthetic Construct
KKNSRK

SEQ ID NO: 22808 - protein, 6 aa, synthetic construct
  REGION 1..6: note = Synthetic Construct
KKNSSK

SEQ ID NO: 22809 - protein, 6 aa, synthetic construct
  REGION 1..6: note = Synthetic Construct
KKNSTK

SEQ ID NO: 22810 - protein, 6 aa, synthetic construct
  REGION 1..6: note = Synthetic Construct
KKNSYK

SEQ ID NO: 22811 - protein, 6 aa, synthetic construct
  REGION 1..6: note = Synthetic Construct
KKNTAK

SEQ ID NO: 22812 - protein, 6 aa, synthetic construct
  REGION 1..6: note = Synthetic Construct
KKNTDK

SEQ ID NO: 22813 - protein, 6 aa, synthetic construct
  REGION 1..6: note = Synthetic Construct
KKNTEK

SEQ ID NO: 22814 - protein, 6 aa, synthetic construct
  REGION 1..6: note = Synthetic Construct
KKNTFK

SEQ ID NO: 22815 - protein, 6 aa, synthetic construct
  REGION 1..6: note = Synthetic Construct
KKNTGK

SEQ ID NO: 22816 - protein, 6 aa, synthetic construct
  REGION 1..6: note = Synthetic Construct
KKNTHK

SEQ ID NO: 22817 - protein, 6 aa, synthetic construct
  REGION 1..6: note = Synthetic Construct
KKNTIK

SEQ ID NO: 22818 - protein, 6 aa, synthetic construct
  REGION 1..6: note = Synthetic Construct
KKNTLK

SEQ ID NO: 22819 - protein, 6 aa, synthetic construct
  REGION 1..6: note = Synthetic Construct
KKNTNK

SEQ ID NO: 22820 - protein, 6 aa, synthetic construct
  REGION 1..6: note = Synthetic Construct
KKNTQK

SEQ ID NO: 22821 - protein, 6 aa, synthetic construct
  REGION 1..6: note = Synthetic Construct
KKNTRK

SEQ ID NO: 22822 - protein, 6 aa, synthetic construct
  REGION 1..6: note = Synthetic Construct
KKNTSK

SEQ ID NO: 22823 - protein, 6 aa, synthetic construct
  REGION 1..6: note = Synthetic Construct
KKNTTK

SEQ ID NO: 22824 - protein, 6 aa, synthetic construct
  REGION 1..6: note = Synthetic Construct
KKNTYK

SEQ ID NO: 22825 - protein, 6 aa, synthetic construct
  REGION 1..6: note = Synthetic Construct
KKNYAK

SEQ ID NO: 22826 - protein, 6 aa, synthetic construct
  REGION 1..6: note = Synthetic Construct
KKNYDK

SEQ ID NO: 22827 - protein, 6 aa, synthetic construct
  REGION 1..6: note = Synthetic Construct
KKNYEK

SEQ ID NO: 22828 - protein, 6 aa, synthetic construct
  REGION 1..6: note = Synthetic Construct
KKNYFK

SEQ ID NO: 22829 - protein, 6 aa, synthetic construct
  REGION 1..6: note = Synthetic Construct
KKNYGK

SEQ ID NO: 22830 - protein, 6 aa, synthetic construct
  REGION 1..6: note = Synthetic Construct
KKNYHK

SEQ ID NO: 22831 - protein, 6 aa, synthetic construct
  REGION 1..6: note = Synthetic Construct
KKNYIK

SEQ ID NO: 22832 - protein, 6 aa, synthetic construct
  REGION 1..6: note = Synthetic Construct
KKNYLK

SEQ ID NO: 22833 - protein, 6 aa, synthetic construct
  REGION 1..6: note = Synthetic Construct
KKNYNK

SEQ ID NO: 22834 - protein, 6 aa, synthetic construct
  REGION 1..6: note = Synthetic Construct
KKNYQK

SEQ ID NO: 22835 - protein, 6 aa, synthetic construct
  REGION 1..6: note = Synthetic Construct
KKNYRK

SEQ ID NO: 22836 - protein, 6 aa, synthetic construct
  REGION 1..6: note = Synthetic Construct
KKNYSK

SEQ ID NO: 22837 - protein, 6 aa, synthetic construct
  REGION 1..6: note = Synthetic Construct
KKNYTK

SEQ ID NO: 22838 - protein, 6 aa, synthetic construct
  REGION 1..6: note = Synthetic Construct
KKNYYK

SEQ ID NO: 22839 - protein, 6 aa, synthetic construct
  REGION 1..6: note = Synthetic Construct
KKPAAK

SEQ ID NO: 22840 - protein, 6 aa, synthetic construct
  REGION 1..6: note = Synthetic Construct
KKPADK

SEQ ID NO: 22841 - protein, 6 aa, synthetic construct
  REGION 1..6: note = Synthetic Construct
KKPAEK

SEQ ID NO: 22842 - protein, 6 aa, synthetic construct
  REGION 1..6: note = Synthetic Construct
KKPAFK

SEQ ID NO: 22843 - protein, 6 aa, synthetic construct
  REGION 1..6: note = Synthetic Construct
KKPAGK

SEQ ID NO: 22844 - protein, 6 aa, synthetic construct
  REGION 1..6: note = Synthetic Construct
KKPAHK

SEQ ID NO: 22845 - protein, 6 aa, synthetic construct
  REGION 1..6: note = Synthetic Construct
KKPAIK

SEQ ID NO: 22846 - protein, 6 aa, synthetic construct
  REGION 1..6: note = Synthetic Construct
KKPALK

SEQ ID NO: 22847 - protein, 6 aa, synthetic construct
  REGION 1..6: note = Synthetic Construct
KKPANK

SEQ ID NO: 22848 - protein, 6 aa, synthetic construct
  REGION 1..6: note = Synthetic Construct
KKPAQK

SEQ ID NO: 22849 - protein, 6 aa, synthetic construct
  REGION 1..6: note = Synthetic Construct
KKPARK

SEQ ID NO: 22850 - protein, 6 aa, synthetic construct
  REGION 1..6: note = Synthetic Construct
KKPASK

SEQ ID NO: 22851 - protein, 6 aa, synthetic construct
  REGION 1..6: note = Synthetic Construct
KKPATK

SEQ ID NO: 22852 - protein, 6 aa, synthetic construct
  REGION 1..6: note = Synthetic Construct
KKPAYK

SEQ ID NO: 22853 - protein, 6 aa, synthetic construct
  REGION 1..6: note = Synthetic Construct
KKPDAK

SEQ ID NO: 22854 - protein, 6 aa, synthetic construct
  REGION 1..6: note = Synthetic Construct
KKPDDK

SEQ ID NO: 22855 - protein, 6 aa, synthetic construct
  REGION 1..6: note = Synthetic Construct
KKPDEK

SEQ ID NO: 22856 - protein, 6 aa, synthetic construct
  REGION 1..6: note = Synthetic Construct
KKPDFK

SEQ ID NO: 22857 - protein, 6 aa, synthetic construct
  REGION 1..6: note = Synthetic Construct
KKPDGK

SEQ ID NO: 22858 - protein, 6 aa, synthetic construct
  REGION 1..6: note = Synthetic Construct
KKPDHK

SEQ ID NO: 22859 - protein, 6 aa, synthetic construct
  REGION 1..6: note = Synthetic Construct
KKPDIK

SEQ ID NO: 22860 - protein, 6 aa, synthetic construct
  REGION 1..6: note = Synthetic Construct
KKPDLK

SEQ ID NO: 22861 - protein, 6 aa, synthetic construct
  REGION 1..6: note = Synthetic Construct
KKPDNK

SEQ ID NO: 22862 - protein, 6 aa, synthetic construct
  REGION 1..6: note = Synthetic Construct
KKPDQK

SEQ ID NO: 22863 - protein, 6 aa, synthetic construct
  REGION 1..6: note = Synthetic Construct
KKPDRK

SEQ ID NO: 22864 - protein, 6 aa, synthetic construct
  REGION 1..6: note = Synthetic Construct
KKPDSK

SEQ ID NO: 22865 - protein, 6 aa, synthetic construct
  REGION 1..6: note = Synthetic Construct
KKPDTK

SEQ ID NO: 22866 - protein, 6 aa, synthetic construct
  REGION 1..6: note = Synthetic Construct
KKPDYK

SEQ ID NO: 22867 - protein, 6 aa, synthetic construct
  REGION 1..6: note = Synthetic Construct
KKPEAK

SEQ ID NO: 22868 - protein, 6 aa, synthetic construct
  REGION 1..6: note = Synthetic Construct
KKPEDK

SEQ ID NO: 22869 - protein, 6 aa, synthetic construct
  REGION 1..6: note = Synthetic Construct
KKPEEK

SEQ ID NO: 22870 - protein, 6 aa, synthetic construct
  REGION 1..6: note = Synthetic Construct
KKPEFK

SEQ ID NO: 22871 - protein, 6 aa, synthetic construct
  REGION 1..6: note = Synthetic Construct
KKPEGK

SEQ ID NO: 22872 - protein, 6 aa, synthetic construct
  REGION 1..6: note = Synthetic Construct
KKPEHK

SEQ ID NO: 22873 - protein, 6 aa, synthetic construct
  REGION 1..6: note = Synthetic Construct
KKPEIK

SEQ ID NO: 22874 - protein, 6 aa, synthetic construct
  REGION 1..6: note = Synthetic Construct
KKPELK

SEQ ID NO: 22875 - protein, 6 aa, synthetic construct
  REGION 1..6: note = Synthetic Construct
KKPENK

SEQ ID NO: 22876 - protein, 6 aa, synthetic construct
  REGION 1..6: note = Synthetic Construct
KKPEQK

SEQ ID NO: 22877 - protein, 6 aa, synthetic construct
  REGION 1..6: note = Synthetic Construct
KKPERK

SEQ ID NO: 22878 - protein, 6 aa, synthetic construct
  REGION 1..6: note = Synthetic Construct
KKPESK

SEQ ID NO: 22879 - protein, 6 aa, synthetic construct
  REGION 1..6: note = Synthetic Construct
KKPETK

SEQ ID NO: 22880 - protein, 6 aa, synthetic construct
  REGION 1..6: note = Synthetic Construct
KKPEYK

SEQ ID NO: 22881 - protein, 6 aa, synthetic construct
  REGION 1..6: note = Synthetic Construct
KKPFAK

SEQ ID NO: 22882 - protein, 6 aa, synthetic construct
  REGION 1..6: note = Synthetic Construct
KKPFDK

SEQ ID NO: 22883 - protein, 6 aa, synthetic construct
  REGION 1..6: note = Synthetic Construct
KKPFEK

SEQ ID NO: 22884 - protein, 6 aa, synthetic construct
  REGION 1..6: note = Synthetic Construct
KKPFFK

SEQ ID NO: 22885 - protein, 6 aa, synthetic construct
  REGION 1..6: note = Synthetic Construct
KKPFGK

SEQ ID NO: 22886 - protein, 6 aa, synthetic construct
  REGION 1..6: note = Synthetic Construct
KKPFHK

SEQ ID NO: 22887 - protein, 6 aa, synthetic construct
  REGION 1..6: note = Synthetic Construct
KKPFIK

SEQ ID NO: 22888 - protein, 6 aa, synthetic construct
  REGION 1..6: note = Synthetic Construct
KKPFLK

SEQ ID NO: 22889 - protein, 6 aa, synthetic construct
  REGION 1..6: note = Synthetic Construct
KKPFNK

SEQ ID NO: 22890 - protein, 6 aa, synthetic construct
  REGION 1..6: note = Synthetic Construct
KKPFQK

SEQ ID NO: 22891 - protein, 6 aa, synthetic construct
  REGION 1..6: note = Synthetic Construct
KKPFRK

SEQ ID NO: 22892 - protein, 6 aa, synthetic construct
  REGION 1..6: note = Synthetic Construct
KKPFSK

SEQ ID NO: 22893 - protein, 6 aa, synthetic construct
  REGION 1..6: note = Synthetic Construct
KKPFTK

SEQ ID NO: 22894 - protein, 6 aa, synthetic construct
  REGION 1..6: note = Synthetic Construct
KKPFYK

SEQ ID NO: 22895 - protein, 6 aa, synthetic construct
  REGION 1..6: note = Synthetic Construct
KKPGAK

SEQ ID NO: 22896 - protein, 6 aa, synthetic construct
  REGION 1..6: note = Synthetic Construct
KKPGDK

SEQ ID NO: 22897 - protein, 6 aa, synthetic construct
  REGION 1..6: note = Synthetic Construct
KKPGEK

SEQ ID NO: 22898 - protein, 6 aa, synthetic construct
  REGION 1..6: note = Synthetic Construct
KKPGFK

SEQ ID NO: 22899 - protein, 6 aa, synthetic construct
  REGION 1..6: note = Synthetic Construct
KKPGGK

SEQ ID NO: 22900 - protein, 6 aa, synthetic construct
  REGION 1..6: note = Synthetic Construct
KKPGHK

SEQ ID NO: 22901 - protein, 6 aa, synthetic construct
  REGION 1..6: note = Synthetic Construct
KKPGIK

SEQ ID NO: 22902 - protein, 6 aa, synthetic construct
  REGION 1..6: note = Synthetic Construct
KKPGLK

SEQ ID NO: 22903 - protein, 6 aa, synthetic construct
  REGION 1..6: note = Synthetic Construct
KKPGNK

SEQ ID NO: 22904 - protein, 6 aa, synthetic construct
  REGION 1..6: note = Synthetic Construct
KKPGQK

SEQ ID NO: 22905 - protein, 6 aa, synthetic construct
  REGION 1..6: note = Synthetic Construct
KKPGRK

SEQ ID NO: 22906 - protein, 6 aa, synthetic construct
  REGION 1..6: note = Synthetic Construct
KKPGSK

SEQ ID NO: 22907 - protein, 6 aa, synthetic construct
  REGION 1..6: note = Synthetic Construct
KKPGTK

SEQ ID NO: 22908 - protein, 6 aa, synthetic construct
  REGION 1..6: note = Synthetic Construct
KKPGYK

SEQ ID NO: 22909 - protein, 6 aa, synthetic construct
  REGION 1..6: note = Synthetic Construct
KKPHAK

SEQ ID NO: 22910 - protein, 6 aa, synthetic construct
  REGION 1..6: note = Synthetic Construct
KKPHDK

SEQ ID NO: 22911 - protein, 6 aa, synthetic construct
  REGION 1..6: note = Synthetic Construct
KKPHEK

SEQ ID NO: 22912 - protein, 6 aa, synthetic construct
  REGION 1..6: note = Synthetic Construct
KKPHFK

SEQ ID NO: 22913 - protein, 6 aa, synthetic construct
  REGION 1..6: note = Synthetic Construct
KKPHGK

SEQ ID NO: 22914 - protein, 6 aa, synthetic construct
  REGION 1..6: note = Synthetic Construct
KKPHHK

SEQ ID NO: 22915 - protein, 6 aa, synthetic construct
  REGION 1..6: note = Synthetic Construct
KKPHIK

SEQ ID NO: 22916 - protein, 6 aa, synthetic construct
  REGION 1..6: note = Synthetic Construct
KKPHLK

SEQ ID NO: 22917 - protein, 6 aa, synthetic construct
  REGION 1..6: note = Synthetic Construct
KKPHNK

SEQ ID NO: 22918 - protein, 6 aa, synthetic construct
  REGION 1..6: note = Synthetic Construct
KKPHQK

SEQ ID NO: 22919 - protein, 6 aa, synthetic construct
  REGION 1..6: note = Synthetic Construct
KKPHRK

SEQ ID NO: 22920 - protein, 6 aa, synthetic construct
  REGION 1..6: note = Synthetic Construct
KKPHSK

SEQ ID NO: 22921 - protein, 6 aa, synthetic construct
  REGION 1..6: note = Synthetic Construct
KKPHTK

SEQ ID NO: 22922 - protein, 6 aa, synthetic construct
  REGION 1..6: note = Synthetic Construct
KKPHYK

SEQ ID NO: 22923 - protein, 6 aa, synthetic construct
  REGION 1..6: note = Synthetic Construct
KKPIAK

SEQ ID NO: 22924 - protein, 6 aa, synthetic construct
  REGION 1..6: note = Synthetic Construct
KKPIDK

SEQ ID NO: 22925 - protein, 6 aa, synthetic construct
  REGION 1..6: note = Synthetic Construct
KKPIEK

SEQ ID NO: 22926 - protein, 6 aa, synthetic construct
  REGION 1..6: note = Synthetic Construct
KKPIFK

SEQ ID NO: 22927 - protein, 6 aa, synthetic construct
  REGION 1..6: note = Synthetic Construct
KKPIGK

SEQ ID NO: 22928 - protein, 6 aa, synthetic construct
  REGION 1..6: note = Synthetic Construct
KKPIHK

SEQ ID NO: 22929 - protein, 6 aa, synthetic construct
  REGION 1..6: note = Synthetic Construct
KKPIIK

SEQ ID NO: 22930 - protein, 6 aa, synthetic construct
  REGION 1..6: note = Synthetic Construct
KKPILK

SEQ ID NO: 22931 - protein, 6 aa, synthetic construct
  REGION 1..6: note = Synthetic Construct
KKPINK

SEQ ID NO: 22932 - protein, 6 aa, synthetic construct
  REGION 1..6: note = Synthetic Construct
KKPIQK

SEQ ID NO: 22933 - protein, 6 aa, synthetic construct
  REGION 1..6: note = Synthetic Construct
KKPIRK

SEQ ID NO: 22934 - protein, 6 aa, synthetic construct
  REGION 1..6: note = Synthetic Construct
KKPISK

SEQ ID NO: 22935 - protein, 6 aa, synthetic construct
  REGION 1..6: note = Synthetic Construct
KKPITK

SEQ ID NO: 22936 - protein, 6 aa, synthetic construct
  REGION 1..6: note = Synthetic Construct
KKPIYK

SEQ ID NO: 22937 - protein, 6 aa, synthetic construct
  REGION 1..6: note = Synthetic Construct
KKPLAK

SEQ ID NO: 22938 - protein, 6 aa, synthetic construct
  REGION 1..6: note = Synthetic Construct
KKPLDK

SEQ ID NO: 22939 - protein, 6 aa, synthetic construct
  REGION 1..6: note = Synthetic Construct
KKPLEK

SEQ ID NO: 22940 - protein, 6 aa, synthetic construct
  REGION 1..6: note = Synthetic Construct
KKPLFK

SEQ ID NO: 22941 - protein, 6 aa, synthetic construct
  REGION 1..6: note = Synthetic Construct
KKPLGK

SEQ ID NO: 22942 - protein, 6 aa, synthetic construct
  REGION 1..6: note = Synthetic Construct
KKPLHK

SEQ ID NO: 22943 - protein, 6 aa, synthetic construct
  REGION 1..6: note = Synthetic Construct
KKPLIK

SEQ ID NO: 22944 - protein, 6 aa, synthetic construct
  REGION 1..6: note = Synthetic Construct
KKPLLK

SEQ ID NO: 22945 - protein, 6 aa, synthetic construct
  REGION 1..6: note = Synthetic Construct
KKPLNK

SEQ ID NO: 22946 - protein, 6 aa, synthetic construct
  REGION 1..6: note = Synthetic Construct
KKPLQK

SEQ ID NO: 22947 - protein, 6 aa, synthetic construct
  REGION 1..6: note = Synthetic Construct
KKPLRK

SEQ ID NO: 22948 - protein, 6 aa, synthetic construct
  REGION 1..6: note = Synthetic Construct
KKPLSK

SEQ ID NO: 22949 - protein, 6 aa, synthetic construct
  REGION 1..6: note = Synthetic Construct
KKPLTK

SEQ ID NO: 22950 - protein, 6 aa, synthetic construct
  REGION 1..6: note = Synthetic Construct
KKPLYK

SEQ ID NO: 22951 - protein, 6 aa, synthetic construct
  REGION 1..6: note = Synthetic Construct
KKPNAK

SEQ ID NO: 22952 - protein, 6 aa, synthetic construct
  REGION 1..6: note = Synthetic Construct
KKPNDK

SEQ ID NO: 22953 - protein, 6 aa, synthetic construct
  REGION 1..6: note = Synthetic Construct
KKPNEK

SEQ ID NO: 22954 - protein, 6 aa, synthetic construct
  REGION 1..6: note = Synthetic Construct
KKPNFK

SEQ ID NO: 22955 - protein, 6 aa, synthetic construct
  REGION 1..6: note = Synthetic Construct
KKPNGK

SEQ ID NO: 22956 - protein, 6 aa, synthetic construct
  REGION 1..6: note = Synthetic Construct
KKPNHK

SEQ ID NO: 22957 - protein, 6 aa, synthetic construct
  REGION 1..6: note = Synthetic Construct
KKPNIK

SEQ ID NO: 22958 - protein, 6 aa, synthetic construct
  REGION 1..6: note = Synthetic Construct
KKPNLK

SEQ ID NO: 22959 - protein, 6 aa, synthetic construct
  REGION 1..6: note = Synthetic Construct
KKPNNK

SEQ ID NO: 22960 - protein, 6 aa, synthetic construct
  REGION 1..6: note = Synthetic Construct
KKPNQK

SEQ ID NO: 22961 - protein, 6 aa, synthetic construct
  REGION 1..6: note = Synthetic Construct
KKPNRK

SEQ ID NO: 22962 - protein, 6 aa, synthetic construct
  REGION 1..6: note = Synthetic Construct
KKPNSK

SEQ ID NO: 22963 - protein, 6 aa, synthetic construct
  REGION 1..6: note = Synthetic Construct
KKPNTK

SEQ ID NO: 22964 - protein, 6 aa, synthetic construct
  REGION 1..6: note = Synthetic Construct
KKPNYK

SEQ ID NO: 22965 - protein, 6 aa, synthetic construct
  REGION 1..6: note = Synthetic Construct
KKPQAK

SEQ ID NO: 22966 - protein, 6 aa, synthetic construct
  REGION 1..6: note = Synthetic Construct
KKPQDK

SEQ ID NO: 22967 - protein, 6 aa, synthetic construct
  REGION 1..6: note = Synthetic Construct
KKPQEK

SEQ ID NO: 22968 - protein, 6 aa, synthetic construct
  REGION 1..6: note = Synthetic Construct
KKPQFK

SEQ ID NO: 22969 - protein, 6 aa, synthetic construct
  REGION 1..6: note = Synthetic Construct
KKPQGK

SEQ ID NO: 22970 - protein, 6 aa, synthetic construct
  REGION 1..6: note = Synthetic Construct
KKPQHK

SEQ ID NO: 22971 - protein, 6 aa, synthetic construct
  REGION 1..6: note = Synthetic Construct
KKPQIK

SEQ ID NO: 22972 - protein, 6 aa, synthetic construct
  REGION 1..6: note = Synthetic Construct
KKPQLK

SEQ ID NO: 22973 - protein, 6 aa, synthetic construct
  REGION 1..6: note = Synthetic Construct
KKPQNK

SEQ ID NO: 22974 - protein, 6 aa, synthetic construct
  REGION 1..6: note = Synthetic Construct
KKPQQK

SEQ ID NO: 22975 - protein, 6 aa, synthetic construct
  REGION 1..6: note = Synthetic Construct
KKPQRK

SEQ ID NO: 22976 - protein, 6 aa, synthetic construct
  REGION 1..6: note = Synthetic Construct
KKPQSK

SEQ ID NO: 22977 - protein, 6 aa, synthetic construct
  REGION 1..6: note = Synthetic Construct
KKPQTK

SEQ ID NO: 22978 - protein, 6 aa, synthetic construct
  REGION 1..6: note = Synthetic Construct
KKPQYK

SEQ ID NO: 22979 - protein, 6 aa, synthetic construct
  REGION 1..6: note = Synthetic Construct
KKPRAK

SEQ ID NO: 22980 - protein, 6 aa, synthetic construct
  REGION 1..6: note = Synthetic Construct
KKPRDK

SEQ ID NO: 22981 - protein, 6 aa, synthetic construct
  REGION 1..6: note = Synthetic Construct
KKPREK

SEQ ID NO: 22982 - protein, 6 aa, synthetic construct
  REGION 1..6: note = Synthetic Construct
KKPRFK

SEQ ID NO: 22983 - protein, 6 aa, synthetic construct
  REGION 1..6: note = Synthetic Construct
KKPRGK

SEQ ID NO: 22984 - protein, 6 aa, synthetic construct
  REGION 1..6: note = Synthetic Construct
KKPRHK

SEQ ID NO: 22985 - protein, 6 aa, synthetic construct
  REGION 1..6: note = Synthetic Construct
KKPRIK

SEQ ID NO: 22986 - protein, 6 aa, synthetic construct
  REGION 1..6: note = Synthetic Construct
KKPRLK

SEQ ID NO: 22987 - protein, 6 aa, synthetic construct
  REGION 1..6: note = Synthetic Construct
KKPRNK

SEQ ID NO: 22988 - protein, 6 aa, synthetic construct
  REGION 1..6: note = Synthetic Construct
KKPRQK

SEQ ID NO: 22989 - protein, 6 aa, synthetic construct
  REGION 1..6: note = Synthetic Construct
KKPRRK

SEQ ID NO: 22990 - protein, 6 aa, synthetic construct
  REGION 1..6: note = Synthetic Construct
KKPRSK

SEQ ID NO: 22991 - protein, 6 aa, synthetic construct
  REGION 1..6: note = Synthetic Construct
KKPRTK

SEQ ID NO: 22992 - protein, 6 aa, synthetic construct
  REGION 1..6: note = Synthetic Construct
KKPRYK

SEQ ID NO: 22993 - protein, 6 aa, synthetic construct
  REGION 1..6: note = Synthetic Construct
KKPSAK

SEQ ID NO: 22994 - protein, 6 aa, synthetic construct
  REGION 1..6: note = Synthetic Construct
KKPSDK

SEQ ID NO: 22995 - protein, 6 aa, synthetic construct
  REGION 1..6: note = Synthetic Construct
KKPSEK

SEQ ID NO: 22996 - protein, 6 aa, synthetic construct
  REGION 1..6: note = Synthetic Construct
KKPSFK

SEQ ID NO: 22997 - protein, 6 aa, synthetic construct
  REGION 1..6: note = Synthetic Construct
KKPSGK

SEQ ID NO: 22998 - protein, 6 aa, synthetic construct
  REGION 1..6: note = Synthetic Construct
KKPSHK

SEQ ID NO: 22999 - protein, 6 aa, synthetic construct
  REGION 1..6: note = Synthetic Construct
KKPSIK

SEQ ID NO: 23000 - protein, 6 aa, synthetic construct
  REGION 1..6: note = Synthetic Construct
KKPSLK

SEQ ID NO: 23001 - protein, 6 aa, synthetic construct
  REGION 1..6: note = Synthetic Construct
KKPSNK

SEQ ID NO: 23002 - protein, 6 aa, synthetic construct
  REGION 1..6: note = Synthetic Construct
KKPSQK

SEQ ID NO: 23003 - protein, 6 aa, synthetic construct
  REGION 1..6: note = Synthetic Construct
KKPSRK

SEQ ID NO: 23004 - protein, 6 aa, synthetic construct
  REGION 1..6: note = Synthetic Construct
KKPSSK

SEQ ID NO: 23005 - protein, 6 aa, synthetic construct
  REGION 1..6: note = Synthetic Construct
KKPSTK

SEQ ID NO: 23006 - protein, 6 aa, synthetic construct
  REGION 1..6: note = Synthetic Construct
KKPSYK

SEQ ID NO: 23007 - protein, 6 aa, synthetic construct
  REGION 1..6: note = Synthetic Construct
KKPTAK

SEQ ID NO: 23008 - protein, 6 aa, synthetic construct
  REGION 1..6: note = Synthetic Construct
KKPTDK

SEQ ID NO: 23009 - protein, 6 aa, synthetic construct
  REGION 1..6: note = Synthetic Construct
KKPTEK

SEQ ID NO: 23010 - protein, 6 aa, synthetic construct
  REGION 1..6: note = Synthetic Construct
KKPTFK

SEQ ID NO: 23011 - protein, 6 aa, synthetic construct
  REGION 1..6: note = Synthetic Construct
KKPTGK

SEQ ID NO: 23012 - protein, 6 aa, synthetic construct
  REGION 1..6: note = Synthetic Construct
KKPTHK

SEQ ID NO: 23013 - protein, 6 aa, synthetic construct
  REGION 1..6: note = Synthetic Construct
KKPTIK

SEQ ID NO: 23014 - protein, 6 aa, synthetic construct
  REGION 1..6: note = Synthetic Construct
KKPTLK

SEQ ID NO: 23015 - protein, 6 aa, synthetic construct
  REGION 1..6: note = Synthetic Construct
KKPTNK

SEQ ID NO: 23016 - protein, 6 aa, synthetic construct
  REGION 1..6: note = Synthetic Construct
KKPTQK

SEQ ID NO: 23017 - protein, 6 aa, synthetic construct
  REGION 1..6: note = Synthetic Construct
KKPTRK

SEQ ID NO: 23018 - protein, 6 aa, synthetic construct
  REGION 1..6: note = Synthetic Construct
KKPTSK

SEQ ID NO: 23019 - protein, 6 aa, synthetic construct
  REGION 1..6: note = Synthetic Construct
KKPTTK

SEQ ID NO: 23020 - protein, 6 aa, synthetic construct
  REGION 1..6: note = Synthetic Construct
KKPTYK

SEQ ID NO: 23021 - protein, 6 aa, synthetic construct
  REGION 1..6: note = Synthetic Construct
KKPYAK

SEQ ID NO: 23022 - protein, 6 aa, synthetic construct
  REGION 1..6: note = Synthetic Construct
KKPYDK

SEQ ID NO: 23023 - protein, 6 aa, synthetic construct
  REGION 1..6: note = Synthetic Construct
KKPYEK

SEQ ID NO: 23024 - protein, 6 aa, synthetic construct
  REGION 1..6: note = Synthetic Construct
KKPYFK

SEQ ID NO: 23025 - protein, 6 aa, synthetic construct
  REGION 1..6: note = Synthetic Construct
KKPYGK

SEQ ID NO: 23026 - protein, 6 aa, synthetic construct
  REGION 1..6: note = Synthetic Construct
KKPYHK

SEQ ID NO: 23027 - protein, 6 aa, synthetic construct
  REGION 1..6: note = Synthetic Construct
KKPYIK

SEQ ID NO: 23028 - protein, 6 aa, synthetic construct
  REGION 1..6: note = Synthetic Construct
KKPYLK

SEQ ID NO: 23029 - protein, 6 aa, synthetic construct
  REGION 1..6: note = Synthetic Construct
KKPYNK

SEQ ID NO: 23030 - protein, 6 aa, synthetic construct
  REGION 1..6: note = Synthetic Construct
KKPYQK

SEQ ID NO: 23031 - protein, 6 aa, synthetic construct
  REGION 1..6: note = Synthetic Construct
KKPYRK

SEQ ID NO: 23032 - protein, 6 aa, synthetic construct
  REGION 1..6: note = Synthetic Construct
KKPYSK

SEQ ID NO: 23033 - protein, 6 aa, synthetic construct
  REGION 1..6: note = Synthetic Construct
KKPYTK

SEQ ID NO: 23034 - protein, 6 aa, synthetic construct
  REGION 1..6: note = Synthetic Construct
KKPYYK

SEQ ID NO: 23035 - protein, 6 aa, synthetic construct
  REGION 1..6: note = Synthetic Construct
KKQAAK

SEQ ID NO: 23036 - protein, 6 aa, synthetic construct
  REGION 1..6: note = Synthetic Construct
KKQADK

SEQ ID NO: 23037 - protein, 6 aa, synthetic construct
  REGION 1..6: note = Synthetic Construct
KKQAEK

SEQ ID NO: 23038 - protein, 6 aa, synthetic construct
  REGION 1..6: note = Synthetic Construct
KKQAFK

SEQ ID NO: 23039 - protein, 6 aa, synthetic construct
  REGION 1..6: note = Synthetic Construct
KKQAGK

SEQ ID NO: 23040 - protein, 6 aa, synthetic construct
  REGION 1..6: note = Synthetic Construct
KKQAHK

SEQ ID NO: 23041 - protein, 6 aa, synthetic construct
  REGION 1..6: note = Synthetic Construct
KKQAIK

SEQ ID NO: 23042 - protein, 6 aa, synthetic construct
  REGION 1..6: note = Synthetic Construct
KKQALK

SEQ ID NO: 23043 - protein, 6 aa, synthetic construct
  REGION 1..6: note = Synthetic Construct
KKQANK

SEQ ID NO: 23044 - protein, 6 aa, synthetic construct
  REGION 1..6: note = Synthetic Construct
KKQAQK

SEQ ID NO: 23045 - protein, 6 aa, synthetic construct
  REGION 1..6: note = Synthetic Construct
KKQARK

SEQ ID NO: 23046 - protein, 6 aa, synthetic construct
  REGION 1..6: note = Synthetic Construct
KKQASK

SEQ ID NO: 23047 - protein, 6 aa, synthetic construct
  REGION 1..6: note = Synthetic Construct
KKQATK

SEQ ID NO: 23048 - protein, 6 aa, synthetic construct
  REGION 1..6: note = Synthetic Construct
KKQAYK

SEQ ID NO: 23049 - protein, 6 aa, synthetic construct
  REGION 1..6: note = Synthetic Construct
KKQDAK

SEQ ID NO: 23050 - protein, 6 aa, synthetic construct
  REGION 1..6: note = Synthetic Construct
KKQDDK

SEQ ID NO: 23051 - protein, 6 aa, synthetic construct
  REGION 1..6: note = Synthetic Construct
KKQDEK

SEQ ID NO: 23052 - protein, 6 aa, synthetic construct
  REGION 1..6: note = Synthetic Construct
KKQDFK

SEQ ID NO: 23053 - protein, 6 aa, synthetic construct
  REGION 1..6: note = Synthetic Construct
KKQDGK

SEQ ID NO: 23054 - protein, 6 aa, synthetic construct
  REGION 1..6: note = Synthetic Construct
KKQDHK

SEQ ID NO: 23055 - protein, 6 aa, synthetic construct
  REGION 1..6: note = Synthetic Construct
KKQDIK

SEQ ID NO: 23056 - protein, 6 aa, synthetic construct
  REGION 1..6: note = Synthetic Construct
KKQDLK

SEQ ID NO: 23057 - protein, 6 aa, synthetic construct
  REGION 1..6: note = Synthetic Construct
KKQDNK

SEQ ID NO: 23058 - protein, 6 aa, synthetic construct
  REGION 1..6: note = Synthetic Construct
KKQDQK

SEQ ID NO: 23059 - protein, 6 aa, synthetic construct
  REGION 1..6: note = Synthetic Construct
KKQDRK

SEQ ID NO: 23060 - protein, 6 aa, synthetic construct
  REGION 1..6: note = Synthetic Construct
KKQDSK

SEQ ID NO: 23061 - protein, 6 aa, synthetic construct
  REGION 1..6: note = Synthetic Construct
KKQDTK

SEQ ID NO: 23062 - protein, 6 aa, synthetic construct
  REGION 1..6: note = Synthetic Construct
KKQDYK

SEQ ID NO: 23063 - protein, 6 aa, synthetic construct
  REGION 1..6: note = Synthetic Construct
KKQEAK

SEQ ID NO: 23064 - protein, 6 aa, synthetic construct
  REGION 1..6: note = Synthetic Construct
KKQEDK

SEQ ID NO: 23065 - protein, 6 aa, synthetic construct
  REGION 1..6: note = Synthetic Construct
KKQEEK

SEQ ID NO: 23066 - protein, 6 aa, synthetic construct
  REGION 1..6: note = Synthetic Construct
KKQEFK

SEQ ID NO: 23067 - protein, 6 aa, synthetic construct
  REGION 1..6: note = Synthetic Construct
KKQEGK

SEQ ID NO: 23068 - protein, 6 aa, synthetic construct
  REGION 1..6: note = Synthetic Construct
KKQEHK

SEQ ID NO: 23069 - protein, 6 aa, synthetic construct
  REGION 1..6: note = Synthetic Construct
KKQEIK

SEQ ID NO: 23070 - protein, 6 aa, synthetic construct
  REGION 1..6: note = Synthetic Construct
KKQELK

SEQ ID NO: 23071 - protein, 6 aa, synthetic construct
  REGION 1..6: note = Synthetic Construct
KKQENK

SEQ ID NO: 23072 - protein, 6 aa, synthetic construct
  REGION 1..6: note = Synthetic Construct
KKQEQK

SEQ ID NO: 23073 - protein, 6 aa, synthetic construct
  REGION 1..6: note = Synthetic Construct
KKQERK

SEQ ID NO: 23074 - protein, 6 aa, synthetic construct
  REGION 1..6: note = Synthetic Construct
KKQESK

SEQ ID NO: 23075 - protein, 6 aa, synthetic construct
  REGION 1..6: note = Synthetic Construct
KKQETK

SEQ ID NO: 23076 - protein, 6 aa, synthetic construct
  REGION 1..6: note = Synthetic Construct
KKQEYK

SEQ ID NO: 23077 - protein, 6 aa, synthetic construct
  REGION 1..6: note = Synthetic Construct
KKQFAK

SEQ ID NO: 23078 - protein, 6 aa, synthetic construct
  REGION 1..6: note = Synthetic Construct
KKQFDK

SEQ ID NO: 23079 - protein, 6 aa, synthetic construct
  REGION 1..6: note = Synthetic Construct
KKQFEK

SEQ ID NO: 23080 - protein, 6 aa, synthetic construct
  REGION 1..6: note = Synthetic Construct
KKQFFK

SEQ ID NO: 23081 - protein, 6 aa, synthetic construct
  REGION 1..6: note = Synthetic Construct
KKQFGK

SEQ ID NO: 23082 - protein, 6 aa, synthetic construct
  REGION 1..6: note = Synthetic Construct
KKQFHK

SEQ ID NO: 23083 - protein, 6 aa, synthetic construct
  REGION 1..6: note = Synthetic Construct
KKQFIK

SEQ ID NO: 23084 - protein, 6 aa, synthetic construct
  REGION 1..6: note = Synthetic Construct
KKQFLK

SEQ ID NO: 23085 - protein, 6 aa, synthetic construct
  REGION 1..6: note = Synthetic Construct
KKQFNK

SEQ ID NO: 23086 - protein, 6 aa, synthetic construct
  REGION 1..6: note = Synthetic Construct
KKQFQK

SEQ ID NO: 23087 - protein, 6 aa, synthetic construct
  REGION 1..6: note = Synthetic Construct
KKQFRK

SEQ ID NO: 23088 - protein, 6 aa, synthetic construct
  REGION 1..6: note = Synthetic Construct
KKQFSK

SEQ ID NO: 23089 - protein, 6 aa, synthetic construct
  REGION 1..6: note = Synthetic Construct
KKQFTK

SEQ ID NO: 23090 - protein, 6 aa, synthetic construct
  REGION 1..6: note = Synthetic Construct
KKQFYK

SEQ ID NO: 23091 - protein, 6 aa, synthetic construct
  REGION 1..6: note = Synthetic Construct
KKQGAK

SEQ ID NO: 23092 - protein, 6 aa, synthetic construct
  REGION 1..6: note = Synthetic Construct
KKQGDK

SEQ ID NO: 23093 - protein, 6 aa, synthetic construct
  REGION 1..6: note = Synthetic Construct
KKQGEK

SEQ ID NO: 23094 - protein, 6 aa, synthetic construct
  REGION 1..6: note = Synthetic Construct
KKQGFK

SEQ ID NO: 23095 - protein, 6 aa, synthetic construct
  REGION 1..6: note = Synthetic Construct
KKQGGK

SEQ ID NO: 23096 - protein, 6 aa, synthetic construct
  REGION 1..6: note = Synthetic Construct
KKQGHK

SEQ ID NO: 23097 - protein, 6 aa, synthetic construct
  REGION 1..6: note = Synthetic Construct
KKQGIK

SEQ ID NO: 23098 - protein, 6 aa, synthetic construct
  REGION 1..6: note = Synthetic Construct
KKQGLK

SEQ ID NO: 23099 - protein, 6 aa, synthetic construct
  REGION 1..6: note = Synthetic Construct
KKQGNK

SEQ ID NO: 23100 - protein, 6 aa, synthetic construct
  REGION 1..6: note = Synthetic Construct
KKQGQK

SEQ ID NO: 23101 - protein, 6 aa, synthetic construct
  REGION 1..6: note = Synthetic Construct
KKQGRK

SEQ ID NO: 23102 - protein, 6 aa, synthetic construct
  REGION 1..6: note = Synthetic Construct
KKQGSK

SEQ ID NO: 23103 - protein, 6 aa, synthetic construct
  REGION 1..6: note = Synthetic Construct
KKQGTK

SEQ ID NO: 23104 - protein, 6 aa, synthetic construct
  REGION 1..6: note = Synthetic Construct
KKQGYK

SEQ ID NO: 23105 - protein, 6 aa, synthetic construct
  REGION 1..6: note = Synthetic Construct
KKQHAK

SEQ ID NO: 23106 - protein, 6 aa, synthetic construct
  REGION 1..6: note = Synthetic Construct
KKQHDK

SEQ ID NO: 23107 - protein, 6 aa, synthetic construct
  REGION 1..6: note = Synthetic Construct
KKQHEK

SEQ ID NO: 23108 - protein, 6 aa, synthetic construct
  REGION 1..6: note = Synthetic Construct
KKQHFK

SEQ ID NO: 23109 - protein, 6 aa, synthetic construct
  REGION 1..6: note = Synthetic Construct
KKQHGK

SEQ ID NO: 23110 - protein, 6 aa, synthetic construct
  REGION 1..6: note = Synthetic Construct
KKQHHK

SEQ ID NO: 23111 - protein, 6 aa, synthetic construct
  REGION 1..6: note = Synthetic Construct
KKQHIK

SEQ ID NO: 23112 - protein, 6 aa, synthetic construct
  REGION 1..6: note = Synthetic Construct
KKQHLK

SEQ ID NO: 23113 - protein, 6 aa, synthetic construct
  REGION 1..6: note = Synthetic Construct
KKQHNK

SEQ ID NO: 23114 - protein, 6 aa, synthetic construct
  REGION 1..6: note = Synthetic Construct
KKQHQK

SEQ ID NO: 23115 - protein, 6 aa, synthetic construct
  REGION 1..6: note = Synthetic Construct
KKQHRK

SEQ ID NO: 23116 - protein, 6 aa, synthetic construct
  REGION 1..6: note = Synthetic Construct
KKQHSK

SEQ ID NO: 23117 - protein, 6 aa, synthetic construct
  REGION 1..6: note = Synthetic Construct
KKQHTK

SEQ ID NO: 23118 - protein, 6 aa, synthetic construct
  REGION 1..6: note = Synthetic Construct
KKQHYK

SEQ ID NO: 23119 - protein, 6 aa, synthetic construct
  REGION 1..6: note = Synthetic Construct
KKQIAK

SEQ ID NO: 23120 - protein, 6 aa, synthetic construct
  REGION 1..6: note = Synthetic Construct
KKQIDK

SEQ ID NO: 23121 - protein, 6 aa, synthetic construct
  REGION 1..6: note = Synthetic Construct
KKQIEK

SEQ ID NO: 23122 - protein, 6 aa, synthetic construct
  REGION 1..6: note = Synthetic Construct
KKQIFK

SEQ ID NO: 23123 - protein, 6 aa, synthetic construct
  REGION 1..6: note = Synthetic Construct
KKQIGK

SEQ ID NO: 23124 - protein, 6 aa, synthetic construct
  REGION 1..6: note = Synthetic Construct
KKQIHK

SEQ ID NO: 23125 - protein, 6 aa, synthetic construct
  REGION 1..6: note = Synthetic Construct
KKQIIK

SEQ ID NO: 23126 - protein, 6 aa, synthetic construct
  REGION 1..6: note = Synthetic Construct
KKQILK

SEQ ID NO: 23127 - protein, 6 aa, synthetic construct
  REGION 1..6: note = Synthetic Construct
KKQINK

SEQ ID NO: 23128 - protein, 6 aa, synthetic construct
  REGION 1..6: note = Synthetic Construct
KKQIQK

SEQ ID NO: 23129 - protein, 6 aa, synthetic construct
  REGION 1..6: note = Synthetic Construct
KKQIRK

SEQ ID NO: 23130 - protein, 6 aa, synthetic construct
  REGION 1..6: note = Synthetic Construct
KKQISK

SEQ ID NO: 23131 - protein, 6 aa, synthetic construct
  REGION 1..6: note = Synthetic Construct
KKQITK

SEQ ID NO: 23132 - protein, 6 aa, synthetic construct
  REGION 1..6: note = Synthetic Construct
KKQIYK

SEQ ID NO: 23133 - protein, 6 aa, synthetic construct
  REGION 1..6: note = Synthetic Construct
KKQLAK

SEQ ID NO: 23134 - protein, 6 aa, synthetic construct
  REGION 1..6: note = Synthetic Construct
KKQLDK

SEQ ID NO: 23135 - protein, 6 aa, synthetic construct
  REGION 1..6: note = Synthetic Construct
KKQLEK

SEQ ID NO: 23136 - protein, 6 aa, synthetic construct
  REGION 1..6: note = Synthetic Construct
KKQLFK

SEQ ID NO: 23137 - protein, 6 aa, synthetic construct
  REGION 1..6: note = Synthetic Construct
KKQLGK

SEQ ID NO: 23138 - protein, 6 aa, synthetic construct
  REGION 1..6: note = Synthetic Construct
KKQLHK

SEQ ID NO: 23139 - protein, 6 aa, synthetic construct
  REGION 1..6: note = Synthetic Construct
KKQLIK

SEQ ID NO: 23140 - protein, 6 aa, synthetic construct
  REGION 1..6: note = Synthetic Construct
KKQLLK

SEQ ID NO: 23141 - protein, 6 aa, synthetic construct
  REGION 1..6: note = Synthetic Construct
KKQLNK

SEQ ID NO: 23142 - protein, 6 aa, synthetic construct
  REGION 1..6: note = Synthetic Construct
KKQLQK

SEQ ID NO: 23143 - protein, 6 aa, synthetic construct
  REGION 1..6: note = Synthetic Construct
KKQLRK

SEQ ID NO: 23144 - protein, 6 aa, synthetic construct
  REGION 1..6: note = Synthetic Construct
KKQLSK

SEQ ID NO: 23145 - protein, 6 aa, synthetic construct
  REGION 1..6: note = Synthetic Construct
KKQLTK

SEQ ID NO: 23146 - protein, 6 aa, synthetic construct
  REGION 1..6: note = Synthetic Construct
KKQLYK

SEQ ID NO: 23147 - protein, 6 aa, synthetic construct
  REGION 1..6: note = Synthetic Construct
KKQNAK

SEQ ID NO: 23148 - protein, 6 aa, synthetic construct
  REGION 1..6: note = Synthetic Construct
KKQNDK

SEQ ID NO: 23149 - protein, 6 aa, synthetic construct
  REGION 1..6: note = Synthetic Construct
KKQNEK

SEQ ID NO: 23150 - protein, 6 aa, synthetic construct
  REGION 1..6: note = Synthetic Construct
KKQNFK

SEQ ID NO: 23151 - protein, 6 aa, synthetic construct
  REGION 1..6: note = Synthetic Construct
KKQNGK

SEQ ID NO: 23152 - protein, 6 aa, synthetic construct
  REGION 1..6: note = Synthetic Construct
KKQNHK

SEQ ID NO: 23153 - protein, 6 aa, synthetic construct
  REGION 1..6: note = Synthetic Construct
KKQNIK

SEQ ID NO: 23154 - protein, 6 aa, synthetic construct
  REGION 1..6: note = Synthetic Construct
KKQNLK

SEQ ID NO: 23155 - protein, 6 aa, synthetic construct
  REGION 1..6: note = Synthetic Construct
KKQNNK

SEQ ID NO: 23156 - protein, 6 aa, synthetic construct
  REGION 1..6: note = Synthetic Construct
KKQNQK

SEQ ID NO: 23157 - protein, 6 aa, synthetic construct
  REGION 1..6: note = Synthetic Construct
KKQNRK

SEQ ID NO: 23158 - protein, 6 aa, synthetic construct
  REGION 1..6: note = Synthetic Construct
KKQNSK

SEQ ID NO: 23159 - protein, 6 aa, synthetic construct
  REGION 1..6: note = Synthetic Construct
KKQNTK

SEQ ID NO: 23160 - protein, 6 aa, synthetic construct
  REGION 1..6: note = Synthetic Construct
KKQNYK

SEQ ID NO: 23161 - protein, 6 aa, synthetic construct
  REGION 1..6: note = Synthetic Construct
KKQQAK

SEQ ID NO: 23162 - protein, 6 aa, synthetic construct
  REGION 1..6: note = Synthetic Construct
KKQQDK

SEQ ID NO: 23163 - protein, 6 aa, synthetic construct
  REGION 1..6: note = Synthetic Construct
KKQQEK

SEQ ID NO: 23164 - protein, 6 aa, synthetic construct
  REGION 1..6: note = Synthetic Construct
KKQQFK

SEQ ID NO: 23165 - protein, 6 aa, synthetic construct
  REGION 1..6: note = Synthetic Construct
KKQQGK

SEQ ID NO: 23166 - protein, 6 aa, synthetic construct
  REGION 1..6: note = Synthetic Construct
KKQQHK

SEQ ID NO: 23167 - protein, 6 aa, synthetic construct
  REGION 1..6: note = Synthetic Construct
KKQQIK

SEQ ID NO: 23168 - protein, 6 aa, synthetic construct
  REGION 1..6: note = Synthetic Construct
KKQQLK

SEQ ID NO: 23169 - protein, 6 aa, synthetic construct
  REGION 1..6: note = Synthetic Construct
KKQQNK

SEQ ID NO: 23170 - protein, 6 aa, synthetic construct
  REGION 1..6: note = Synthetic Construct
KKQQQK

SEQ ID NO: 23171 - protein, 6 aa, synthetic construct
  REGION 1..6: note = Synthetic Construct
KKQQRK

SEQ ID NO: 23172 - protein, 6 aa, synthetic construct
  REGION 1..6: note = Synthetic Construct
KKQQSK

SEQ ID NO: 23173 - protein, 6 aa, synthetic construct
  REGION 1..6: note = Synthetic Construct
KKQQTK

SEQ ID NO: 23174 - protein, 6 aa, synthetic construct
  REGION 1..6: note = Synthetic Construct
KKQQYK

SEQ ID NO: 23175 - protein, 6 aa, synthetic construct
  REGION 1..6: note = Synthetic Construct
KKQRAK

SEQ ID NO: 23176 - protein, 6 aa, synthetic construct
  REGION 1..6: note = Synthetic Construct
KKQRDK

SEQ ID NO: 23177 - protein, 6 aa, synthetic construct
  REGION 1..6: note = Synthetic Construct
KKQREK

SEQ ID NO: 23178 - protein, 6 aa, synthetic construct
  REGION 1..6: note = Synthetic Construct
KKQRFK

SEQ ID NO: 23179 - protein, 6 aa, synthetic construct
  REGION 1..6: note = Synthetic Construct
KKQRGK

SEQ ID NO: 23180 - protein, 6 aa, synthetic construct
  REGION 1..6: note = Synthetic Construct
KKQRHK

SEQ ID NO: 23181 - protein, 6 aa, synthetic construct
  REGION 1..6: note = Synthetic Construct
KKQRIK

SEQ ID NO: 23182 - protein, 6 aa, synthetic construct
  REGION 1..6: note = Synthetic Construct
KKQRLK

SEQ ID NO: 23183 - protein, 6 aa, synthetic construct
  REGION 1..6: note = Synthetic Construct
KKQRNK

SEQ ID NO: 23184 - protein, 6 aa, synthetic construct
  REGION 1..6: note = Synthetic Construct
KKQRQK

SEQ ID NO: 23185 - protein, 6 aa, synthetic construct
  REGION 1..6: note = Synthetic Construct
KKQRRK

SEQ ID NO: 23186 - protein, 6 aa, synthetic construct
  REGION 1..6: note = Synthetic Construct
KKQRSK

SEQ ID NO: 23187 - protein, 6 aa, synthetic construct
  REGION 1..6: note = Synthetic Construct
KKQRTK

SEQ ID NO: 23188 - protein, 6 aa, synthetic construct
  REGION 1..6: note = Synthetic Construct
KKQRYK

SEQ ID NO: 23189 - protein, 6 aa, synthetic construct
  REGION 1..6: note = Synthetic Construct
KKQSAK

SEQ ID NO: 23190 - protein, 6 aa, synthetic construct
  REGION 1..6: note = Synthetic Construct
KKQSDK

SEQ ID NO: 23191 - protein, 6 aa, synthetic construct
  REGION 1..6: note = Synthetic Construct
KKQSEK

SEQ ID NO: 23192 - protein, 6 aa, synthetic construct
  REGION 1..6: note = Synthetic Construct
KKQSFK

SEQ ID NO: 23193 - protein, 6 aa, synthetic construct
  REGION 1..6: note = Synthetic Construct
KKQSGK

SEQ ID NO: 23194 - protein, 6 aa, synthetic construct
  REGION 1..6: note = Synthetic Construct
KKQSHK

SEQ ID NO: 23195 - protein, 6 aa, synthetic construct
  REGION 1..6: note = Synthetic Construct
KKQSIK

SEQ ID NO: 23196 - protein, 6 aa, synthetic construct
  REGION 1..6: note = Synthetic Construct
KKQSLK

SEQ ID NO: 23197 - protein, 6 aa, synthetic construct
  REGION 1..6: note = Synthetic Construct
KKQSNK

SEQ ID NO: 23198 - protein, 6 aa, synthetic construct
  REGION 1..6: note = Synthetic Construct
KKQSQK

SEQ ID NO: 23199 - protein, 6 aa, synthetic construct
  REGION 1..6: note = Synthetic Construct
KKQSRK

SEQ ID NO: 23200 - protein, 6 aa, synthetic construct
  REGION 1..6: note = Synthetic Construct
KKQSSK

SEQ ID NO: 23201 - protein, 6 aa, synthetic construct
  REGION 1..6: note = Synthetic Construct
KKQSTK

SEQ ID NO: 23202 - protein, 6 aa, synthetic construct
  REGION 1..6: note = Synthetic Construct
KKQSYK

SEQ ID NO: 23203 - protein, 6 aa, synthetic construct
  REGION 1..6: note = Synthetic Construct
KKQTAK

SEQ ID NO: 23204 - protein, 6 aa, synthetic construct
  REGION 1..6: note = Synthetic Construct
KKQTDK

SEQ ID NO: 23205 - protein, 6 aa, synthetic construct
  REGION 1..6: note = Synthetic Construct
KKQTEK

SEQ ID NO: 23206 - protein, 6 aa, synthetic construct
  REGION 1..6: note = Synthetic Construct
KKQTFK

SEQ ID NO: 23207 - protein, 6 aa, synthetic construct
  REGION 1..6: note = Synthetic Construct
KKQTGK

SEQ ID NO: 23208 - protein, 6 aa, synthetic construct
  REGION 1..6: note = Synthetic Construct
KKQTHK

SEQ ID NO: 23209 - protein, 6 aa, synthetic construct
  REGION 1..6: note = Synthetic Construct
KKQTIK

SEQ ID NO: 23210 - protein, 6 aa, synthetic construct
  REGION 1..6: note = Synthetic Construct
KKQTLK

SEQ ID NO: 23211 - protein, 6 aa, synthetic construct
  REGION 1..6: note = Synthetic Construct
KKQTNK

SEQ ID NO: 23212 - protein, 6 aa, synthetic construct
  REGION 1..6: note = Synthetic Construct
KKQTQK

SEQ ID NO: 23213 - protein, 6 aa, synthetic construct
  REGION 1..6: note = Synthetic Construct
KKQTRK

SEQ ID NO: 23214 - protein, 6 aa, synthetic construct
  REGION 1..6: note = Synthetic Construct
KKQTSK

SEQ ID NO: 23215 - protein, 6 aa, synthetic construct
  REGION 1..6: note = Synthetic Construct
KKQTTK

SEQ ID NO: 23216 - protein, 6 aa, synthetic construct
  REGION 1..6: note = Synthetic Construct
KKQTYK

SEQ ID NO: 23217 - protein, 6 aa, synthetic construct
  REGION 1..6: note = Synthetic Construct
KKQYAK

SEQ ID NO: 23218 - protein, 6 aa, synthetic construct
  REGION 1..6: note = Synthetic Construct
KKQYDK

SEQ ID NO: 23219 - protein, 6 aa, synthetic construct
  REGION 1..6: note = Synthetic Construct
KKQYEK

SEQ ID NO: 23220 - protein, 6 aa, synthetic construct
  REGION 1..6: note = Synthetic Construct
KKQYFK

SEQ ID NO: 23221 - protein, 6 aa, synthetic construct
  REGION 1..6: note = Synthetic Construct
KKQYGK

SEQ ID NO: 23222 - protein, 6 aa, synthetic construct
  REGION 1..6: note = Synthetic Construct
KKQYHK

SEQ ID NO: 23223 - protein, 6 aa, synthetic construct
  REGION 1..6: note = Synthetic Construct
KKQYIK

SEQ ID NO: 23224 - protein, 6 aa, synthetic construct
  REGION 1..6: note = Synthetic Construct
KKQYLK

SEQ ID NO: 23225 - protein, 6 aa, synthetic construct
  REGION 1..6: note = Synthetic Construct
KKQYNK

SEQ ID NO: 23226 - protein, 6 aa, synthetic construct
  REGION 1..6: note = Synthetic Construct
KKQYQK

SEQ ID NO: 23227 - protein, 6 aa, synthetic construct
  REGION 1..6: note = Synthetic Construct
KKQYRK

SEQ ID NO: 23228 - protein, 6 aa, synthetic construct
  REGION 1..6: note = Synthetic Construct
KKQYSK

SEQ ID NO: 23229 - protein, 6 aa, synthetic construct
  REGION 1..6: note = Synthetic Construct
KKQYTK

SEQ ID NO: 23230 - protein, 6 aa, synthetic construct
  REGION 1..6: note = Synthetic Construct
KKQYYK

SEQ ID NO: 23231 - protein, 6 aa, synthetic construct
  REGION 1..6: note = Synthetic Construct
KKRAAK

SEQ ID NO: 23232 - protein, 6 aa, synthetic construct
  REGION 1..6: note = Synthetic Construct
KKRADK

SEQ ID NO: 23233 - protein, 6 aa, synthetic construct
  REGION 1..6: note = Synthetic Construct
KKRAEK

SEQ ID NO: 23234 - protein, 6 aa, synthetic construct
  REGION 1..6: note = Synthetic Construct
KKRAFK

SEQ ID NO: 23235 - protein, 6 aa, synthetic construct
  REGION 1..6: note = Synthetic Construct
KKRAGK

SEQ ID NO: 23236 - protein, 6 aa, synthetic construct
  REGION 1..6: note = Synthetic Construct
KKRAHK

SEQ ID NO: 23237 - protein, 6 aa, synthetic construct
  REGION 1..6: note = Synthetic Construct
KKRAIK

SEQ ID NO: 23238 - protein, 6 aa, synthetic construct
  REGION 1..6: note = Synthetic Construct
KKRALK

SEQ ID NO: 23239 - protein, 6 aa, synthetic construct
  REGION 1..6: note = Synthetic Construct
KKRANK

SEQ ID NO: 23240 - protein, 6 aa, synthetic construct
  REGION 1..6: note = Synthetic Construct
KKRAQK

SEQ ID NO: 23241 - protein, 6 aa, synthetic construct
  REGION 1..6: note = Synthetic Construct
KKRARK

SEQ ID NO: 23242 - protein, 6 aa, synthetic construct
  REGION 1..6: note = Synthetic Construct
KKRASK

SEQ ID NO: 23243 - protein, 6 aa, synthetic construct
  REGION 1..6: note = Synthetic Construct
KKRATK

SEQ ID NO: 23244 - protein, 6 aa, synthetic construct
  REGION 1..6: note = Synthetic Construct
KKRAYK

SEQ ID NO: 23245 - protein, 6 aa, synthetic construct
  REGION 1..6: note = Synthetic Construct
KKRDAK

SEQ ID NO: 23246 - protein, 6 aa, synthetic construct
  REGION 1..6: note = Synthetic Construct
KKRDDK

SEQ ID NO: 23247 - protein, 6 aa, synthetic construct
  REGION 1..6: note = Synthetic Construct
KKRDEK

SEQ ID NO: 23248 - protein, 6 aa, synthetic construct
  REGION 1..6: note = Synthetic Construct
KKRDFK

SEQ ID NO: 23249 - protein, 6 aa, synthetic construct
  REGION 1..6: note = Synthetic Construct
KKRDGK

SEQ ID NO: 23250 - protein, 6 aa, synthetic construct
  REGION 1..6: note = Synthetic Construct
KKRDHK

SEQ ID NO: 23251 - protein, 6 aa, synthetic construct
  REGION 1..6: note = Synthetic Construct
KKRDIK

SEQ ID NO: 23252 - protein, 6 aa, synthetic construct
  REGION 1..6: note = Synthetic Construct
KKRDLK

SEQ ID NO: 23253 - protein, 6 aa, synthetic construct
  REGION 1..6: note = Synthetic Construct
KKRDNK

SEQ ID NO: 23254 - protein, 6 aa, synthetic construct
  REGION 1..6: note = Synthetic Construct
KKRDQK

SEQ ID NO: 23255 - protein, 6 aa, synthetic construct
  REGION 1..6: note = Synthetic Construct
KKRDRK

SEQ ID NO: 23256 - protein, 6 aa, synthetic construct
  REGION 1..6: note = Synthetic Construct
KKRDSK

SEQ ID NO: 23257 - protein, 6 aa, synthetic construct
  REGION 1..6: note = Synthetic Construct
KKRDTK

SEQ ID NO: 23258 - protein, 6 aa, synthetic construct
  REGION 1..6: note = Synthetic Construct
KKRDYK

SEQ ID NO: 23259 - protein, 6 aa, synthetic construct
  REGION 1..6: note = Synthetic Construct
KKREAK

SEQ ID NO: 23260 - protein, 6 aa, synthetic construct
  REGION 1..6: note = Synthetic Construct
KKREDK

SEQ ID NO: 23261 - protein, 6 aa, synthetic construct
  REGION 1..6: note = Synthetic Construct
KKREEK

SEQ ID NO: 23262 - protein, 6 aa, synthetic construct
  REGION 1..6: note = Synthetic Construct
KKREFK

SEQ ID NO: 23263 - protein, 6 aa, synthetic construct
  REGION 1..6: note = Synthetic Construct
KKREGK

SEQ ID NO: 23264 - protein, 6 aa, synthetic construct
  REGION 1..6: note = Synthetic Construct
KKREHK

SEQ ID NO: 23265 - protein, 6 aa, synthetic construct
  REGION 1..6: note = Synthetic Construct
KKREIK

SEQ ID NO: 23266 - protein, 6 aa, synthetic construct
  REGION 1..6: note = Synthetic Construct
KKRELK

SEQ ID NO: 23267 - protein, 6 aa, synthetic construct
  REGION 1..6: note = Synthetic Construct
KKRENK

SEQ ID NO: 23268 - protein, 6 aa, synthetic construct
  REGION 1..6: note = Synthetic Construct
KKREQK

SEQ ID NO: 23269 - protein, 6 aa, synthetic construct
  REGION 1..6: note = Synthetic Construct
KKRERK

SEQ ID NO: 23270 - protein, 6 aa, synthetic construct
  REGION 1..6: note = Synthetic Construct
KKRESK

SEQ ID NO: 23271 - protein, 6 aa, synthetic construct
  REGION 1..6: note = Synthetic Construct
KKRETK

SEQ ID NO: 23272 - protein, 6 aa, synthetic construct
  REGION 1..6: note = Synthetic Construct
KKREYK

SEQ ID NO: 23273 - protein, 6 aa, synthetic construct
  REGION 1..6: note = Synthetic Construct
KKRFAK

SEQ ID NO: 23274 - protein, 6 aa, synthetic construct
  REGION 1..6: note = Synthetic Construct
KKRFDK

SEQ ID NO: 23275 - protein, 6 aa, synthetic construct
  REGION 1..6: note = Synthetic Construct
KKRFEK

SEQ ID NO: 23276 - protein, 6 aa, synthetic construct
  REGION 1..6: note = Synthetic Construct
KKRFFK

SEQ ID NO: 23277 - protein, 6 aa, synthetic construct
  REGION 1..6: note = Synthetic Construct
KKRFGK

SEQ ID NO: 23278 - protein, 6 aa, synthetic construct
  REGION 1..6: note = Synthetic Construct
KKRFHK

SEQ ID NO: 23279 - protein, 6 aa, synthetic construct
  REGION 1..6: note = Synthetic Construct
KKRFIK

SEQ ID NO: 23280 - protein, 6 aa, synthetic construct
  REGION 1..6: note = Synthetic Construct
KKRFLK

SEQ ID NO: 23281 - protein, 6 aa, synthetic construct
  REGION 1..6: note = Synthetic Construct
KKRFNK

SEQ ID NO: 23282 - protein, 6 aa, synthetic construct
  REGION 1..6: note = Synthetic Construct
KKRFQK

SEQ ID NO: 23283 - protein, 6 aa, synthetic construct
  REGION 1..6: note = Synthetic Construct
KKRFRK

SEQ ID NO: 23284 - protein, 6 aa, synthetic construct
  REGION 1..6: note = Synthetic Construct
KKRFSK

SEQ ID NO: 23285 - protein, 6 aa, synthetic construct
  REGION 1..6: note = Synthetic Construct
KKRFTK

SEQ ID NO: 23286 - protein, 6 aa, synthetic construct
  REGION 1..6: note = Synthetic Construct
KKRFYK

SEQ ID NO: 23287 - protein, 6 aa, synthetic construct
  REGION 1..6: note = Synthetic Construct
KKRGAK

SEQ ID NO: 23288 - protein, 6 aa, synthetic construct
  REGION 1..6: note = Synthetic Construct
KKRGDK

SEQ ID NO: 23289 - protein, 6 aa, synthetic construct
  REGION 1..6: note = Synthetic Construct
KKRGEK

SEQ ID NO: 23290 - protein, 6 aa, synthetic construct
  REGION 1..6: note = Synthetic Construct
KKRGFK

SEQ ID NO: 23291 - protein, 6 aa, synthetic construct
  REGION 1..6: note = Synthetic Construct
KKRGGK

SEQ ID NO: 23292 - protein, 6 aa, synthetic construct
  REGION 1..6: note = Synthetic Construct
KKRGHK

SEQ ID NO: 23293 - protein, 6 aa, synthetic construct
  REGION 1..6: note = Synthetic Construct
KKRGIK

SEQ ID NO: 23294 - protein, 6 aa, synthetic construct
  REGION 1..6: note = Synthetic Construct
KKRGLK

SEQ ID NO: 23295 - protein, 6 aa, synthetic construct
  REGION 1..6: note = Synthetic Construct
KKRGNK

SEQ ID NO: 23296 - protein, 6 aa, synthetic construct
  REGION 1..6: note = Synthetic Construct
KKRGQK

SEQ ID NO: 23297 - protein, 6 aa, synthetic construct
  REGION 1..6: note = Synthetic Construct
KKRGRK

SEQ ID NO: 23298 - protein, 6 aa, synthetic construct
  REGION 1..6: note = Synthetic Construct
KKRGSK

SEQ ID NO: 23299 - protein, 6 aa, synthetic construct
  REGION 1..6: note = Synthetic Construct
KKRGTK

SEQ ID NO: 23300 - protein, 6 aa, synthetic construct
  REGION 1..6: note = Synthetic Construct
KKRGYK

SEQ ID NO: 23301 - protein, 6 aa, synthetic construct
  REGION 1..6: note = Synthetic Construct
KKRHAK

SEQ ID NO: 23302 - protein, 6 aa, synthetic construct
  REGION 1..6: note = Synthetic Construct
KKRHDK

SEQ ID NO: 23303 - protein, 6 aa, synthetic construct
  REGION 1..6: note = Synthetic Construct
KKRHEK

SEQ ID NO: 23304 - protein, 6 aa, synthetic construct
  REGION 1..6: note = Synthetic Construct
KKRHFK

SEQ ID NO: 23305 - protein, 6 aa, synthetic construct
  REGION 1..6: note = Synthetic Construct
KKRHGK

SEQ ID NO: 23306 - protein, 6 aa, synthetic construct
  REGION 1..6: note = Synthetic Construct
KKRHHK

SEQ ID NO: 23307 - protein, 6 aa, synthetic construct
  REGION 1..6: note = Synthetic Construct
KKRHIK

SEQ ID NO: 23308 - protein, 6 aa, synthetic construct
  REGION 1..6: note = Synthetic Construct
KKRHLK

SEQ ID NO: 23309 - protein, 6 aa, synthetic construct
  REGION 1..6: note = Synthetic Construct
KKRHNK

SEQ ID NO: 23310 - protein, 6 aa, synthetic construct
  REGION 1..6: note = Synthetic Construct
KKRHQK

SEQ ID NO: 23311 - protein, 6 aa, synthetic construct
  REGION 1..6: note = Synthetic Construct
KKRHRK

SEQ ID NO: 23312 - protein, 6 aa, synthetic construct
  REGION 1..6: note = Synthetic Construct
KKRHSK

SEQ ID NO: 23313 - protein, 6 aa, synthetic construct
  REGION 1..6: note = Synthetic Construct
KKRHTK

SEQ ID NO: 23314 - protein, 6 aa, synthetic construct
  REGION 1..6: note = Synthetic Construct
KKRHYK

SEQ ID NO: 23315 - protein, 6 aa, synthetic construct
  REGION 1..6: note = Synthetic Construct
KKRIAK

SEQ ID NO: 23316 - protein, 6 aa, synthetic construct
  REGION 1..6: note = Synthetic Construct
KKRIDK

SEQ ID NO: 23317 - protein, 6 aa, synthetic construct
  REGION 1..6: note = Synthetic Construct
KKRIEK

SEQ ID NO: 23318 - protein, 6 aa, synthetic construct
  REGION 1..6: note = Synthetic Construct
KKRIFK

SEQ ID NO: 23319 - protein, 6 aa, synthetic construct
  REGION 1..6: note = Synthetic Construct
KKRIGK

SEQ ID NO: 23320 - protein, 6 aa, synthetic construct
  REGION 1..6: note = Synthetic Construct
KKRIHK

SEQ ID NO: 23321 - protein, 6 aa, synthetic construct
  REGION 1..6: note = Synthetic Construct
KKRIIK

SEQ ID NO: 23322 - protein, 6 aa, synthetic construct
  REGION 1..6: note = Synthetic Construct
KKRILK

SEQ ID NO: 23323 - protein, 6 aa, synthetic construct
  REGION 1..6: note = Synthetic Construct
KKRINK

SEQ ID NO: 23324 - protein, 6 aa, synthetic construct
  REGION 1..6: note = Synthetic Construct
KKRIQK

SEQ ID NO: 23325 - protein, 6 aa, synthetic construct
  REGION 1..6: note = Synthetic Construct
KKRIRK

SEQ ID NO: 23326 - protein, 6 aa, synthetic construct
  REGION 1..6: note = Synthetic Construct
KKRISK

SEQ ID NO: 23327 - protein, 6 aa, synthetic construct
  REGION 1..6: note = Synthetic Construct
KKRITK

SEQ ID NO: 23328 - protein, 6 aa, synthetic construct
  REGION 1..6: note = Synthetic Construct
KKRIYK

SEQ ID NO: 23329 - protein, 6 aa, synthetic construct
  REGION 1..6: note = Synthetic Construct
KKRLAK

SEQ ID NO: 23330 - protein, 6 aa, synthetic construct
  REGION 1..6: note = Synthetic Construct
KKRLDK

SEQ ID NO: 23331 - protein, 6 aa, synthetic construct
  REGION 1..6: note = Synthetic Construct
KKRLEK

SEQ ID NO: 23332 - protein, 6 aa, synthetic construct
  REGION 1..6: note = Synthetic Construct
KKRLFK

SEQ ID NO: 23333 - protein, 6 aa, synthetic construct
  REGION 1..6: note = Synthetic Construct
KKRLGK

SEQ ID NO: 23334 - protein, 6 aa, synthetic construct
  REGION 1..6: note = Synthetic Construct
KKRLHK

SEQ ID NO: 23335 - protein, 6 aa, synthetic construct
  REGION 1..6: note = Synthetic Construct
KKRLIK

SEQ ID NO: 23336 - protein, 6 aa, synthetic construct
  REGION 1..6: note = Synthetic Construct
KKRLLK

SEQ ID NO: 23337 - protein, 6 aa, synthetic construct
  REGION 1..6: note = Synthetic Construct
KKRLNK

SEQ ID NO: 23338 - protein, 6 aa, synthetic construct
  REGION 1..6: note = Synthetic Construct
KKRLQK

SEQ ID NO: 23339 - protein, 6 aa, synthetic construct
  REGION 1..6: note = Synthetic Construct
KKRLRK

SEQ ID NO: 23340 - protein, 6 aa, synthetic construct
  REGION 1..6: note = Synthetic Construct
KKRLSK

SEQ ID NO: 23341 - protein, 6 aa, synthetic construct
  REGION 1..6: note = Synthetic Construct
KKRLTK

SEQ ID NO: 23342 - protein, 6 aa, synthetic construct
  REGION 1..6: note = Synthetic Construct
KKRLYK

SEQ ID NO: 23343 - protein, 6 aa, synthetic construct
  REGION 1..6: note = Synthetic Construct
KKRNAK

SEQ ID NO: 23344 - protein, 6 aa, synthetic construct
  REGION 1..6: note = Synthetic Construct
KKRNDK

SEQ ID NO: 23345 - protein, 6 aa, synthetic construct
  REGION 1..6: note = Synthetic Construct
KKRNEK

SEQ ID NO: 23346 - protein, 6 aa, synthetic construct
  REGION 1..6: note = Synthetic Construct
KKRNFK

SEQ ID NO: 23347 - protein, 6 aa, synthetic construct
  REGION 1..6: note = Synthetic Construct
KKRNGK

SEQ ID NO: 23348 - protein, 6 aa, synthetic construct
  REGION 1..6: note = Synthetic Construct
KKRNHK

SEQ ID NO: 23349 - protein, 6 aa, synthetic construct
  REGION 1..6: note = Synthetic Construct
KKRNIK

SEQ ID NO: 23350 - protein, 6 aa, synthetic construct
  REGION 1..6: note = Synthetic Construct
KKRNLK

SEQ ID NO: 23351 - protein, 6 aa, synthetic construct
  REGION 1..6: note = Synthetic Construct
KKRNNK

SEQ ID NO: 23352 - protein, 6 aa, synthetic construct
  REGION 1..6: note = Synthetic Construct
KKRNQK

SEQ ID NO: 23353 - protein, 6 aa, synthetic construct
  REGION 1..6: note = Synthetic Construct
KKRNRK

SEQ ID NO: 23354 - protein, 6 aa, synthetic construct
  REGION 1..6: note = Synthetic Construct
KKRNSK

SEQ ID NO: 23355 - protein, 6 aa, synthetic construct
  REGION 1..6: note = Synthetic Construct
KKRNTK

SEQ ID NO: 23356 - protein, 6 aa, synthetic construct
  REGION 1..6: note = Synthetic Construct
KKRNYK

SEQ ID NO: 23357 - protein, 6 aa, synthetic construct
  REGION 1..6: note = Synthetic Construct
KKRQAK

SEQ ID NO: 23358 - protein, 6 aa, synthetic construct
  REGION 1..6: note = Synthetic Construct
KKRQDK

SEQ ID NO: 23359 - protein, 6 aa, synthetic construct
  REGION 1..6: note = Synthetic Construct
KKRQEK

SEQ ID NO: 23360 - protein, 6 aa, synthetic construct
  REGION 1..6: note = Synthetic Construct
KKRQFK

SEQ ID NO: 23361 - protein, 6 aa, synthetic construct
  REGION 1..6: note = Synthetic Construct
KKRQGK

SEQ ID NO: 23362 - protein, 6 aa, synthetic construct
  REGION 1..6: note = Synthetic Construct
KKRQHK

SEQ ID NO: 23363 - protein, 6 aa, synthetic construct
  REGION 1..6: note = Synthetic Construct
KKRQIK

SEQ ID NO: 23364 - protein, 6 aa, synthetic construct
  REGION 1..6: note = Synthetic Construct
KKRQLK

SEQ ID NO: 23365 - protein, 6 aa, synthetic construct
  REGION 1..6: note = Synthetic Construct
KKRQNK

SEQ ID NO: 23366 - protein, 6 aa, synthetic construct
  REGION 1..6: note = Synthetic Construct
KKRQQK

SEQ ID NO: 23367 - protein, 6 aa, synthetic construct
  REGION 1..6: note = Synthetic Construct
KKRQRK

SEQ ID NO: 23368 - protein, 6 aa, synthetic construct
  REGION 1..6: note = Synthetic Construct
KKRQSK

SEQ ID NO: 23369 - protein, 6 aa, synthetic construct
  REGION 1..6: note = Synthetic Construct
KKRQTK

SEQ ID NO: 23370 - protein, 6 aa, synthetic construct
  REGION 1..6: note = Synthetic Construct
KKRQYK

SEQ ID NO: 23371 - protein, 6 aa, synthetic construct
  REGION 1..6: note = Synthetic Construct
KKRRAK

SEQ ID NO: 23372 - protein, 6 aa, synthetic construct
  REGION 1..6: note = Synthetic Construct
KKRRDK

SEQ ID NO: 23373 - protein, 6 aa, synthetic construct
  REGION 1..6: note = Synthetic Construct
KKRREK

SEQ ID NO: 23374 - protein, 6 aa, synthetic construct
  REGION 1..6: note = Synthetic Construct
KKRRFK

SEQ ID NO: 23375 - protein, 6 aa, synthetic construct
  REGION 1..6: note = Synthetic Construct
KKRRGK

SEQ ID NO: 23376 - protein, 6 aa, synthetic construct
  REGION 1..6: note = Synthetic Construct
KKRRHK

SEQ ID NO: 23377 - protein, 6 aa, synthetic construct
  REGION 1..6: note = Synthetic Construct
KKRRIK

SEQ ID NO: 23378 - protein, 6 aa, synthetic construct
  REGION 1..6: note = Synthetic Construct
KKRRLK

SEQ ID NO: 23379 - protein, 6 aa, synthetic construct
  REGION 1..6: note = Synthetic Construct
KKRRNK

SEQ ID NO: 23380 - protein, 6 aa, synthetic construct
  REGION 1..6: note = Synthetic Construct
KKRRQK

SEQ ID NO: 23381 - protein, 6 aa, synthetic construct
  REGION 1..6: note = Synthetic Construct
KKRRRK

SEQ ID NO: 23382 - protein, 6 aa, synthetic construct
  REGION 1..6: note = Synthetic Construct
KKRRSK

SEQ ID NO: 23383 - protein, 6 aa, synthetic construct
  REGION 1..6: note = Synthetic Construct
KKRRTK

SEQ ID NO: 23384 - protein, 6 aa, synthetic construct
  REGION 1..6: note = Synthetic Construct
KKRRYK

SEQ ID NO: 23385 - protein, 6 aa, synthetic construct
  REGION 1..6: note = Synthetic Construct
KKRSAK

SEQ ID NO: 23386 - protein, 6 aa, synthetic construct
  REGION 1..6: note = Synthetic Construct
KKRSDK

SEQ ID NO: 23387 - protein, 6 aa, synthetic construct
  REGION 1..6: note = Synthetic Construct
KKRSEK

SEQ ID NO: 23388 - protein, 6 aa, synthetic construct
  REGION 1..6: note = Synthetic Construct
KKRSFK

SEQ ID NO: 23389 - protein, 6 aa, synthetic construct
  REGION 1..6: note = Synthetic Construct
KKRSGK

SEQ ID NO: 23390 - protein, 6 aa, synthetic construct
  REGION 1..6: note = Synthetic Construct
KKRSHK

SEQ ID NO: 23391 - protein, 6 aa, synthetic construct
  REGION 1..6: note = Synthetic Construct
KKRSIK

SEQ ID NO: 23392 - protein, 6 aa, synthetic construct
  REGION 1..6: note = Synthetic Construct
KKRSLK

SEQ ID NO: 23393 - protein, 6 aa, synthetic construct
  REGION 1..6: note = Synthetic Construct
KKRSNK

SEQ ID NO: 23394 - protein, 6 aa, synthetic construct
  REGION 1..6: note = Synthetic Construct
KKRSQK

SEQ ID NO: 23395 - protein, 6 aa, synthetic construct
  REGION 1..6: note = Synthetic Construct
KKRSRK

SEQ ID NO: 23396 - protein, 6 aa, synthetic construct
  REGION 1..6: note = Synthetic Construct
KKRSSK

SEQ ID NO: 23397 - protein, 6 aa, synthetic construct
  REGION 1..6: note = Synthetic Construct
KKRSTK

SEQ ID NO: 23398 - protein, 6 aa, synthetic construct
  REGION 1..6: note = Synthetic Construct
KKRSYK

SEQ ID NO: 23399 - protein, 6 aa, synthetic construct
  REGION 1..6: note = Synthetic Construct
KKRTAK

SEQ ID NO: 23400 - protein, 6 aa, synthetic construct
  REGION 1..6: note = Synthetic Construct
KKRTDK

SEQ ID NO: 23401 - protein, 6 aa, synthetic construct
  REGION 1..6: note = Synthetic Construct
KKRTEK

SEQ ID NO: 23402 - protein, 6 aa, synthetic construct
  REGION 1..6: note = Synthetic Construct
KKRTFK

SEQ ID NO: 23403 - protein, 6 aa, synthetic construct
  REGION 1..6: note = Synthetic Construct
KKRTGK

SEQ ID NO: 23404 - protein, 6 aa, synthetic construct
  REGION 1..6: note = Synthetic Construct
KKRTHK

SEQ ID NO: 23405 - protein, 6 aa, synthetic construct
  REGION 1..6: note = Synthetic Construct
KKRTIK

SEQ ID NO: 23406 - protein, 6 aa, synthetic construct
  REGION 1..6: note = Synthetic Construct
KKRTLK

SEQ ID NO: 23407 - protein, 6 aa, synthetic construct
  REGION 1..6: note = Synthetic Construct
KKRTNK

SEQ ID NO: 23408 - protein, 6 aa, synthetic construct
  REGION 1..6: note = Synthetic Construct
KKRTQK

SEQ ID NO: 23409 - protein, 6 aa, synthetic construct
  REGION 1..6: note = Synthetic Construct
KKRTRK

SEQ ID NO: 23410 - protein, 6 aa, synthetic construct
  REGION 1..6: note = Synthetic Construct
KKRTSK

SEQ ID NO: 23411 - protein, 6 aa, synthetic construct
  REGION 1..6: note = Synthetic Construct
KKRTTK

SEQ ID NO: 23412 - protein, 6 aa, synthetic construct
  REGION 1..6: note = Synthetic Construct
KKRTYK

SEQ ID NO: 23413 - protein, 6 aa, synthetic construct
  REGION 1..6: note = Synthetic Construct
KKRYAK

SEQ ID NO: 23414 - protein, 6 aa, synthetic construct
  REGION 1..6: note = Synthetic Construct
KKRYDK

SEQ ID NO: 23415 - protein, 6 aa, synthetic construct
  REGION 1..6: note = Synthetic Construct
KKRYEK

SEQ ID NO: 23416 - protein, 6 aa, synthetic construct
  REGION 1..6: note = Synthetic Construct
KKRYFK

SEQ ID NO: 23417 - protein, 6 aa, synthetic construct
  REGION 1..6: note = Synthetic Construct
KKRYGK

SEQ ID NO: 23418 - protein, 6 aa, synthetic construct
  REGION 1..6: note = Synthetic Construct
KKRYHK

SEQ ID NO: 23419 - protein, 6 aa, synthetic construct
  REGION 1..6: note = Synthetic Construct
KKRYIK

SEQ ID NO: 23420 - protein, 6 aa, synthetic construct
  REGION 1..6: note = Synthetic Construct
KKRYLK

SEQ ID NO: 23421 - protein, 6 aa, synthetic construct
  REGION 1..6: note = Synthetic Construct
KKRYNK

SEQ ID NO: 23422 - protein, 6 aa, synthetic construct
  REGION 1..6: note = Synthetic Construct
KKRYQK

SEQ ID NO: 23423 - protein, 6 aa, synthetic construct
  REGION 1..6: note = Synthetic Construct
KKRYRK

SEQ ID NO: 23424 - protein, 6 aa, synthetic construct
  REGION 1..6: note = Synthetic Construct
KKRYSK

SEQ ID NO: 23425 - protein, 6 aa, synthetic construct
  REGION 1..6: note = Synthetic Construct
KKRYTK

SEQ ID NO: 23426 - protein, 6 aa, synthetic construct
  REGION 1..6: note = Synthetic Construct
KKRYYK

SEQ ID NO: 23427 - protein, 6 aa, synthetic construct
  REGION 1..6: note = Synthetic Construct
KKSAAK

SEQ ID NO: 23428 - protein, 6 aa, synthetic construct
  REGION 1..6: note = Synthetic Construct
KKSADK

SEQ ID NO: 23429 - protein, 6 aa, synthetic construct
  REGION 1..6: note = Synthetic Construct
KKSAEK

SEQ ID NO: 23430 - protein, 6 aa, synthetic construct
  REGION 1..6: note = Synthetic Construct
KKSAFK

SEQ ID NO: 23431 - protein, 6 aa, synthetic construct
  REGION 1..6: note = Synthetic Construct
KKSAGK

SEQ ID NO: 23432 - protein, 6 aa, synthetic construct
  REGION 1..6: note = Synthetic Construct
KKSAHK

SEQ ID NO: 23433 - protein, 6 aa, synthetic construct
  REGION 1..6: note = Synthetic Construct
KKSAIK

SEQ ID NO: 23434 - protein, 6 aa, synthetic construct
  REGION 1..6: note = Synthetic Construct
KKSALK

SEQ ID NO: 23435 - protein, 6 aa, synthetic construct
  REGION 1..6: note = Synthetic Construct
KKSANK

SEQ ID NO: 23436 - protein, 6 aa, synthetic construct
  REGION 1..6: note = Synthetic Construct
KKSAQK

SEQ ID NO: 23437 - protein, 6 aa, synthetic construct
  REGION 1..6: note = Synthetic Construct
KKSARK

SEQ ID NO: 23438 - protein, 6 aa, synthetic construct
  REGION 1..6: note = Synthetic Construct
KKSASK

SEQ ID NO: 23439 - protein, 6 aa, synthetic construct
  REGION 1..6: note = Synthetic Construct
KKSATK

SEQ ID NO: 23440 - protein, 6 aa, synthetic construct
  REGION 1..6: note = Synthetic Construct
KKSAYK

SEQ ID NO: 23441 - protein, 6 aa, synthetic construct
  REGION 1..6: note = Synthetic Construct
KKSDAK

SEQ ID NO: 23442 - protein, 6 aa, synthetic construct
  REGION 1..6: note = Synthetic Construct
KKSDDK

SEQ ID NO: 23443 - protein, 6 aa, synthetic construct
  REGION 1..6: note = Synthetic Construct
KKSDEK

SEQ ID NO: 23444 - protein, 6 aa, synthetic construct
  REGION 1..6: note = Synthetic Construct
KKSDFK

SEQ ID NO: 23445 - protein, 6 aa, synthetic construct
  REGION 1..6: note = Synthetic Construct
KKSDGK

SEQ ID NO: 23446 - protein, 6 aa, synthetic construct
  REGION 1..6: note = Synthetic Construct
KKSDHK

SEQ ID NO: 23447 - protein, 6 aa, synthetic construct
  REGION 1..6: note = Synthetic Construct
KKSDIK

SEQ ID NO: 23448 - protein, 6 aa, synthetic construct
  REGION 1..6: note = Synthetic Construct
KKSDLK

SEQ ID NO: 23449 - protein, 6 aa, synthetic construct
  REGION 1..6: note = Synthetic Construct
KKSDNK

SEQ ID NO: 23450 - protein, 6 aa, synthetic construct
  REGION 1..6: note = Synthetic Construct
KKSDQK

SEQ ID NO: 23451 - protein, 6 aa, synthetic construct
  REGION 1..6: note = Synthetic Construct
KKSDRK

SEQ ID NO: 23452 - protein, 6 aa, synthetic construct
  REGION 1..6: note = Synthetic Construct
KKSDSK

SEQ ID NO: 23453 - protein, 6 aa, synthetic construct
  REGION 1..6: note = Synthetic Construct
KKSDTK

SEQ ID NO: 23454 - protein, 6 aa, synthetic construct
  REGION 1..6: note = Synthetic Construct
KKSDYK

SEQ ID NO: 23455 - protein, 6 aa, synthetic construct
  REGION 1..6: note = Synthetic Construct
KKSEAK

SEQ ID NO: 23456 - protein, 6 aa, synthetic construct
  REGION 1..6: note = Synthetic Construct
KKSEDK

SEQ ID NO: 23457 - protein, 6 aa, synthetic construct
  REGION 1..6: note = Synthetic Construct
KKSEEK

SEQ ID NO: 23458 - protein, 6 aa, synthetic construct
  REGION 1..6: note = Synthetic Construct
KKSEFK

SEQ ID NO: 23459 - protein, 6 aa, synthetic construct
  REGION 1..6: note = Synthetic Construct
KKSEGK

SEQ ID NO: 23460 - protein, 6 aa, synthetic construct
  REGION 1..6: note = Synthetic Construct
KKSEHK

SEQ ID NO: 23461 - protein, 6 aa, synthetic construct
  REGION 1..6: note = Synthetic Construct
KKSEIK

SEQ ID NO: 23462 - protein, 6 aa, synthetic construct
  REGION 1..6: note = Synthetic Construct
KKSELK

SEQ ID NO: 23463 - protein, 6 aa, synthetic construct
  REGION 1..6: note = Synthetic Construct
KKSENK

SEQ ID NO: 23464 - protein, 6 aa, synthetic construct
  REGION 1..6: note = Synthetic Construct
KKSEQK

SEQ ID NO: 23465 - protein, 6 aa, synthetic construct
  REGION 1..6: note = Synthetic Construct
KKSERK

SEQ ID NO: 23466 - protein, 6 aa, synthetic construct
  REGION 1..6: note = Synthetic Construct
KKSESK

SEQ ID NO: 23467 - protein, 6 aa, synthetic construct
  REGION 1..6: note = Synthetic Construct
KKSETK

SEQ ID NO: 23468 - protein, 6 aa, synthetic construct
  REGION 1..6: note = Synthetic Construct
KKSEYK

SEQ ID NO: 23469 - protein, 6 aa, synthetic construct
  REGION 1..6: note = Synthetic Construct
KKSFAK

SEQ ID NO: 23470 - protein, 6 aa, synthetic construct
  REGION 1..6: note = Synthetic Construct
KKSFDK

SEQ ID NO: 23471 - protein, 6 aa, synthetic construct
  REGION 1..6: note = Synthetic Construct
KKSFEK

SEQ ID NO: 23472 - protein, 6 aa, synthetic construct
  REGION 1..6: note = Synthetic Construct
KKSFFK

SEQ ID NO: 23473 - protein, 6 aa, synthetic construct
  REGION 1..6: note = Synthetic Construct
KKSFGK

SEQ ID NO: 23474 - protein, 6 aa, synthetic construct
  REGION 1..6: note = Synthetic Construct
KKSFHK

SEQ ID NO: 23475 - protein, 6 aa, synthetic construct
  REGION 1..6: note = Synthetic Construct
KKSFIK

SEQ ID NO: 23476 - protein, 6 aa, synthetic construct
  REGION 1..6: note = Synthetic Construct
KKSFLK

SEQ ID NO: 23477 - protein, 6 aa, synthetic construct
  REGION 1..6: note = Synthetic Construct
KKSFNK

SEQ ID NO: 23478 - protein, 6 aa, synthetic construct
  REGION 1..6: note = Synthetic Construct
KKSFQK

SEQ ID NO: 23479 - protein, 6 aa, synthetic construct
  REGION 1..6: note = Synthetic Construct
KKSFRK

SEQ ID NO: 23480 - protein, 6 aa, synthetic construct
  REGION 1..6: note = Synthetic Construct
KKSFSK

SEQ ID NO: 23481 - protein, 6 aa, synthetic construct
  REGION 1..6: note = Synthetic Construct
KKSFTK

SEQ ID NO: 23482 - protein, 6 aa, synthetic construct
  REGION 1..6: note = Synthetic Construct
KKSFYK

SEQ ID NO: 23483 - protein, 6 aa, synthetic construct
  REGION 1..6: note = Synthetic Construct
KKSGAK

SEQ ID NO: 23484 - protein, 6 aa, synthetic construct
  REGION 1..6: note = Synthetic Construct
KKSGDK

SEQ ID NO: 23485 - protein, 6 aa, synthetic construct
  REGION 1..6: note = Synthetic Construct
KKSGEK

SEQ ID NO: 23486 - protein, 6 aa, synthetic construct
  REGION 1..6: note = Synthetic Construct
KKSGFK

SEQ ID NO: 23487 - protein, 6 aa, synthetic construct
  REGION 1..6: note = Synthetic Construct
KKSGGK

SEQ ID NO: 23488 - protein, 6 aa, synthetic construct
  REGION 1..6: note = Synthetic Construct
KKSGHK

SEQ ID NO: 23489 - protein, 6 aa, synthetic construct
  REGION 1..6: note = Synthetic Construct
KKSGIK

SEQ ID NO: 23490 - protein, 6 aa, synthetic construct
  REGION 1..6: note = Synthetic Construct
KKSGLK

SEQ ID NO: 23491 - protein, 6 aa, synthetic construct
  REGION 1..6: note = Synthetic Construct
KKSGNK

SEQ ID NO: 23492 - protein, 6 aa, synthetic construct
  REGION 1..6: note = Synthetic Construct
KKSGQK

SEQ ID NO: 23493 - protein, 6 aa, synthetic construct
  REGION 1..6: note = Synthetic Construct
KKSGRK

SEQ ID NO: 23494 - protein, 6 aa, synthetic construct
  REGION 1..6: note = Synthetic Construct
KKSGSK

SEQ ID NO: 23495 - protein, 6 aa, synthetic construct
  REGION 1..6: note = Synthetic Construct
KKSGTK

SEQ ID NO: 23496 - protein, 6 aa, synthetic construct
  REGION 1..6: note = Synthetic Construct
KKSGYK

SEQ ID NO: 23497 - protein, 6 aa, synthetic construct
  REGION 1..6: note = Synthetic Construct
KKSHAK

SEQ ID NO: 23498 - protein, 6 aa, synthetic construct
  REGION 1..6: note = Synthetic Construct
KKSHDK

SEQ ID NO: 23499 - protein, 6 aa, synthetic construct
  REGION 1..6: note = Synthetic Construct
KKSHEK

SEQ ID NO: 23500 - protein, 6 aa, synthetic construct
  REGION 1..6: note = Synthetic Construct
KKSHFK

SEQ ID NO: 23501 - protein, 6 aa, synthetic construct
  REGION 1..6: note = Synthetic Construct
KKSHGK

SEQ ID NO: 23502 - protein, 6 aa, synthetic construct
  REGION 1..6: note = Synthetic Construct
KKSHHK

SEQ ID NO: 23503 - protein, 6 aa, synthetic construct
  REGION 1..6: note = Synthetic Construct
KKSHIK

SEQ ID NO: 23504 - protein, 6 aa, synthetic construct
  REGION 1..6: note = Synthetic Construct
KKSHLK

SEQ ID NO: 23505 - protein, 6 aa, synthetic construct
  REGION 1..6: note = Synthetic Construct
KKSHNK

SEQ ID NO: 23506 - protein, 6 aa, synthetic construct
  REGION 1..6: note = Synthetic Construct
KKSHQK

SEQ ID NO: 23507 - protein, 6 aa, synthetic construct
  REGION 1..6: note = Synthetic Construct
KKSHRK

SEQ ID NO: 23508 - protein, 6 aa, synthetic construct
  REGION 1..6: note = Synthetic Construct
KKSHSK

SEQ ID NO: 23509 - protein, 6 aa, synthetic construct
  REGION 1..6: note = Synthetic Construct
KKSHTK

SEQ ID NO: 23510 - protein, 6 aa, synthetic construct
  REGION 1..6: note = Synthetic Construct
KKSHYK

SEQ ID NO: 23511 - protein, 6 aa, synthetic construct
  REGION 1..6: note = Synthetic Construct
KKSIAK

SEQ ID NO: 23512 - protein, 6 aa, synthetic construct
  REGION 1..6: note = Synthetic Construct
KKSIDK

SEQ ID NO: 23513 - protein, 6 aa, synthetic construct
  REGION 1..6: note = Synthetic Construct
KKSIEK

SEQ ID NO: 23514 - protein, 6 aa, synthetic construct
  REGION 1..6: note = Synthetic Construct
KKSIFK

SEQ ID NO: 23515 - protein, 6 aa, synthetic construct
  REGION 1..6: note = Synthetic Construct
KKSIGK

SEQ ID NO: 23516 - protein, 6 aa, synthetic construct
  REGION 1..6: note = Synthetic Construct
KKSIHK

SEQ ID NO: 23517 - protein, 6 aa, synthetic construct
  REGION 1..6: note = Synthetic Construct
KKSIIK

SEQ ID NO: 23518 - protein, 6 aa, synthetic construct
  REGION 1..6: note = Synthetic Construct
KKSILK

SEQ ID NO: 23519 - protein, 6 aa, synthetic construct
  REGION 1..6: note = Synthetic Construct
KKSINK

SEQ ID NO: 23520 - protein, 6 aa, synthetic construct
  REGION 1..6: note = Synthetic Construct
KKSIQK

SEQ ID NO: 23521 - protein, 6 aa, synthetic construct
  REGION 1..6: note = Synthetic Construct
KKSIRK

SEQ ID NO: 23522 - protein, 6 aa, synthetic construct
  REGION 1..6: note = Synthetic Construct
KKSISK

SEQ ID NO: 23523 - protein, 6 aa, synthetic construct
  REGION 1..6: note = Synthetic Construct
KKSITK

SEQ ID NO: 23524 - protein, 6 aa, synthetic construct
  REGION 1..6: note = Synthetic Construct
KKSIYK

SEQ ID NO: 23525 - protein, 6 aa, synthetic construct
  REGION 1..6: note = Synthetic Construct
KKSLAK

SEQ ID NO: 23526 - protein, 6 aa, synthetic construct
  REGION 1..6: note = Synthetic Construct
KKSLDK

SEQ ID NO: 23527 - protein, 6 aa, synthetic construct
  REGION 1..6: note = Synthetic Construct
KKSLEK

SEQ ID NO: 23528 - protein, 6 aa, synthetic construct
  REGION 1..6: note = Synthetic Construct
KKSLFK

SEQ ID NO: 23529 - protein, 6 aa, synthetic construct
  REGION 1..6: note = Synthetic Construct
KKSLGK

SEQ ID NO: 23530 - protein, 6 aa, synthetic construct
  REGION 1..6: note = Synthetic Construct
KKSLHK

SEQ ID NO: 23531 - protein, 6 aa, synthetic construct
  REGION 1..6: note = Synthetic Construct
KKSLIK

SEQ ID NO: 23532 - protein, 6 aa, synthetic construct
  REGION 1..6: note = Synthetic Construct
KKSLLK

SEQ ID NO: 23533 - protein, 6 aa, synthetic construct
  REGION 1..6: note = Synthetic Construct
KKSLNK

SEQ ID NO: 23534 - protein, 6 aa, synthetic construct
  REGION 1..6: note = Synthetic Construct
KKSLQK

SEQ ID NO: 23535 - protein, 6 aa, synthetic construct
  REGION 1..6: note = Synthetic Construct
KKSLRK

SEQ ID NO: 23536 - protein, 6 aa, synthetic construct
  REGION 1..6: note = Synthetic Construct
KKSLSK

SEQ ID NO: 23537 - protein, 6 aa, synthetic construct
  REGION 1..6: note = Synthetic Construct
KKSLTK

SEQ ID NO: 23538 - protein, 6 aa, synthetic construct
  REGION 1..6: note = Synthetic Construct
KKSLYK

SEQ ID NO: 23539 - protein, 6 aa, synthetic construct
  REGION 1..6: note = Synthetic Construct
KKSNAK

SEQ ID NO: 23540 - protein, 6 aa, synthetic construct
  REGION 1..6: note = Synthetic Construct
KKSNDK

SEQ ID NO: 23541 - protein, 6 aa, synthetic construct
  REGION 1..6: note = Synthetic Construct
KKSNEK

SEQ ID NO: 23542 - protein, 6 aa, synthetic construct
  REGION 1..6: note = Synthetic Construct
KKSNFK

SEQ ID NO: 23543 - protein, 6 aa, synthetic construct
  REGION 1..6: note = Synthetic Construct
KKSNGK

SEQ ID NO: 23544 - protein, 6 aa, synthetic construct
  REGION 1..6: note = Synthetic Construct
KKSNHK

SEQ ID NO: 23545 - protein, 6 aa, synthetic construct
  REGION 1..6: note = Synthetic Construct
KKSNIK

SEQ ID NO: 23546 - protein, 6 aa, synthetic construct
  REGION 1..6: note = Synthetic Construct
KKSNLK

SEQ ID NO: 23547 - protein, 6 aa, synthetic construct
  REGION 1..6: note = Synthetic Construct
KKSNNK

SEQ ID NO: 23548 - protein, 6 aa, synthetic construct
  REGION 1..6: note = Synthetic Construct
KKSNQK

SEQ ID NO: 23549 - protein, 6 aa, synthetic construct
  REGION 1..6: note = Synthetic Construct
KKSNRK

SEQ ID NO: 23550 - protein, 6 aa, synthetic construct
  REGION 1..6: note = Synthetic Construct
KKSNSK

SEQ ID NO: 23551 - protein, 6 aa, synthetic construct
  REGION 1..6: note = Synthetic Construct
KKSNTK

SEQ ID NO: 23552 - protein, 6 aa, synthetic construct
  REGION 1..6: note = Synthetic Construct
KKSNYK

SEQ ID NO: 23553 - protein, 6 aa, synthetic construct
  REGION 1..6: note = Synthetic Construct
KKSQAK

SEQ ID NO: 23554 - protein, 6 aa, synthetic construct
  REGION 1..6: note = Synthetic Construct
KKSQDK

SEQ ID NO: 23555 - protein, 6 aa, synthetic construct
  REGION 1..6: note = Synthetic Construct
KKSQEK

SEQ ID NO: 23556 - protein, 6 aa, synthetic construct
  REGION 1..6: note = Synthetic Construct
KKSQFK

SEQ ID NO: 23557 - protein, 6 aa, synthetic construct
  REGION 1..6: note = Synthetic Construct
KKSQGK

SEQ ID NO: 23558 - protein, 6 aa, synthetic construct
  REGION 1..6: note = Synthetic Construct
KKSQHK

SEQ ID NO: 23559 - protein, 6 aa, synthetic construct
  REGION 1..6: note = Synthetic Construct
KKSQIK

SEQ ID NO: 23560 - protein, 6 aa, synthetic construct
  REGION 1..6: note = Synthetic Construct
KKSQLK

SEQ ID NO: 23561 - protein, 6 aa, synthetic construct
  REGION 1..6: note = Synthetic Construct
KKSQNK

SEQ ID NO: 23562 - protein, 6 aa, synthetic construct
  REGION 1..6: note = Synthetic Construct
KKSQQK

SEQ ID NO: 23563 - protein, 6 aa, synthetic construct
  REGION 1..6: note = Synthetic Construct
KKSQRK

SEQ ID NO: 23564 - protein, 6 aa, synthetic construct
  REGION 1..6: note = Synthetic Construct
KKSQSK

SEQ ID NO: 23565 - protein, 6 aa, synthetic construct
  REGION 1..6: note = Synthetic Construct
KKSQTK

SEQ ID NO: 23566 - protein, 6 aa, synthetic construct
  REGION 1..6: note = Synthetic Construct
KKSQYK

SEQ ID NO: 23567 - protein, 6 aa, synthetic construct
  REGION 1..6: note = Synthetic Construct
KKSRAK

SEQ ID NO: 23568 - protein, 6 aa, synthetic construct
  REGION 1..6: note = Synthetic Construct
KKSRDK

SEQ ID NO: 23569 - protein, 6 aa, synthetic construct
  REGION 1..6: note = Synthetic Construct
KKSREK

SEQ ID NO: 23570 - protein, 6 aa, synthetic construct
  REGION 1..6: note = Synthetic Construct
KKSRFK

SEQ ID NO: 23571 - protein, 6 aa, synthetic construct
  REGION 1..6: note = Synthetic Construct
KKSRGK

SEQ ID NO: 23572 - protein, 6 aa, synthetic construct
  REGION 1..6: note = Synthetic Construct
KKSRHK

SEQ ID NO: 23573 - protein, 6 aa, synthetic construct
  REGION 1..6: note = Synthetic Construct
KKSRIK

SEQ ID NO: 23574 - protein, 6 aa, synthetic construct
  REGION 1..6: note = Synthetic Construct
KKSRLK

SEQ ID NO: 23575 - protein, 6 aa, synthetic construct
  REGION 1..6: note = Synthetic Construct
KKSRNK

SEQ ID NO: 23576 - protein, 6 aa, synthetic construct
  REGION 1..6: note = Synthetic Construct
KKSRQK

SEQ ID NO: 23577 - protein, 6 aa, synthetic construct
  REGION 1..6: note = Synthetic Construct
KKSRRK

SEQ ID NO: 23578 - protein, 6 aa, synthetic construct
  REGION 1..6: note = Synthetic Construct
KKSRSK

SEQ ID NO: 23579 - protein, 6 aa, synthetic construct
  REGION 1..6: note = Synthetic Construct
KKSRTK

SEQ ID NO: 23580 - protein, 6 aa, synthetic construct
  REGION 1..6: note = Synthetic Construct
KKSRYK

SEQ ID NO: 23581 - protein, 6 aa, synthetic construct
  REGION 1..6: note = Synthetic Construct
KKSSAK

SEQ ID NO: 23582 - protein, 6 aa, synthetic construct
  REGION 1..6: note = Synthetic Construct
KKSSDK

SEQ ID NO: 23583 - protein, 6 aa, synthetic construct
  REGION 1..6: note = Synthetic Construct
KKSSEK

SEQ ID NO: 23584 - protein, 6 aa, synthetic construct
  REGION 1..6: note = Synthetic Construct
KKSSFK

SEQ ID NO: 23585 - protein, 6 aa, synthetic construct
  REGION 1..6: note = Synthetic Construct
KKSSGK

SEQ ID NO: 23586 - protein, 6 aa, synthetic construct
  REGION 1..6: note = Synthetic Construct
KKSSHK

SEQ ID NO: 23587 - protein, 6 aa, synthetic construct
  REGION 1..6: note = Synthetic Construct
KKSSIK

SEQ ID NO: 23588 - protein, 6 aa, synthetic construct
  REGION 1..6: note = Synthetic Construct
KKSSLK

SEQ ID NO: 23589 - protein, 6 aa, synthetic construct
  REGION 1..6: note = Synthetic Construct
KKSSNK

SEQ ID NO: 23590 - protein, 6 aa, synthetic construct
  REGION 1..6: note = Synthetic Construct
KKSSQK

SEQ ID NO: 23591 - protein, 6 aa, synthetic construct
  REGION 1..6: note = Synthetic Construct
KKSSRK

SEQ ID NO: 23592 - protein, 6 aa, synthetic construct
  REGION 1..6: note = Synthetic Construct
KKSSSK

SEQ ID NO: 23593 - protein, 6 aa, synthetic construct
  REGION 1..6: note = Synthetic Construct
KKSSTK

SEQ ID NO: 23594 - protein, 6 aa, synthetic construct
  REGION 1..6: note = Synthetic Construct
KKSSYK

SEQ ID NO: 23595 - protein, 6 aa, synthetic construct
  REGION 1..6: note = Synthetic Construct
KKSTAK

SEQ ID NO: 23596 - protein, 6 aa, synthetic construct
  REGION 1..6: note = Synthetic Construct
KKSTDK

SEQ ID NO: 23597 - protein, 6 aa, synthetic construct
  REGION 1..6: note = Synthetic Construct
KKSTEK

SEQ ID NO: 23598 - protein, 6 aa, synthetic construct
  REGION 1..6: note = Synthetic Construct
KKSTFK

SEQ ID NO: 23599 - protein, 6 aa, synthetic construct
  REGION 1..6: note = Synthetic Construct
KKSTGK

SEQ ID NO: 23600 - protein, 6 aa, synthetic construct
  REGION 1..6: note = Synthetic Construct
KKSTHK

SEQ ID NO: 23601 - protein, 6 aa, synthetic construct
  REGION 1..6: note = Synthetic Construct
KKSTIK

SEQ ID NO: 23602 - protein, 6 aa, synthetic construct
  REGION 1..6: note = Synthetic Construct
KKSTLK

SEQ ID NO: 23603 - protein, 6 aa, synthetic construct
  REGION 1..6: note = Synthetic Construct
KKSTNK

SEQ ID NO: 23604 - protein, 6 aa, synthetic construct
  REGION 1..6: note = Synthetic Construct
KKSTQK

SEQ ID NO: 23605 - protein, 6 aa, synthetic construct
  REGION 1..6: note = Synthetic Construct
KKSTRK

SEQ ID NO: 23606 - protein, 6 aa, synthetic construct
  REGION 1..6: note = Synthetic Construct
KKSTSK

SEQ ID NO: 23607 - protein, 6 aa, synthetic construct
  REGION 1..6: note = Synthetic Construct
KKSTTK

SEQ ID NO: 23608 - protein, 6 aa, synthetic construct
  REGION 1..6: note = Synthetic Construct
KKSTYK

SEQ ID NO: 23609 - protein, 6 aa, synthetic construct
  REGION 1..6: note = Synthetic Construct
KKSYAK

SEQ ID NO: 23610 - protein, 6 aa, synthetic construct
  REGION 1..6: note = Synthetic Construct
KKSYDK

SEQ ID NO: 23611 - protein, 6 aa, synthetic construct
  REGION 1..6: note = Synthetic Construct
KKSYEK

SEQ ID NO: 23612 - protein, 6 aa, synthetic construct
  REGION 1..6: note = Synthetic Construct
KKSYFK

SEQ ID NO: 23613 - protein, 6 aa, synthetic construct
  REGION 1..6: note = Synthetic Construct
KKSYGK

SEQ ID NO: 23614 - protein, 6 aa, synthetic construct
  REGION 1..6: note = Synthetic Construct
KKSYHK

SEQ ID NO: 23615 - protein, 6 aa, synthetic construct
  REGION 1..6: note = Synthetic Construct
KKSYIK

SEQ ID NO: 23616 - protein, 6 aa, synthetic construct
  REGION 1..6: note = Synthetic Construct
KKSYLK

SEQ ID NO: 23617 - protein, 6 aa, synthetic construct
  REGION 1..6: note = Synthetic Construct
KKSYNK

SEQ ID NO: 23618 - protein, 6 aa, synthetic construct
  REGION 1..6: note = Synthetic Construct
KKSYQK

SEQ ID NO: 23619 - protein, 6 aa, synthetic construct
  REGION 1..6: note = Synthetic Construct
KKSYRK

SEQ ID NO: 23620 - protein, 6 aa, synthetic construct
  REGION 1..6: note = Synthetic Construct
KKSYSK

SEQ ID NO: 23621 - protein, 6 aa, synthetic construct
  REGION 1..6: note = Synthetic Construct
KKSYTK

SEQ ID NO: 23622 - protein, 6 aa, synthetic construct
  REGION 1..6: note = Synthetic Construct
KKSYYK

SEQ ID NO: 23623 - protein, 6 aa, synthetic construct
  REGION 1..6: note = Synthetic Construct
KKTAAK

SEQ ID NO: 23624 - protein, 6 aa, synthetic construct
  REGION 1..6: note = Synthetic Construct
KKTADK

SEQ ID NO: 23625 - protein, 6 aa, synthetic construct
  REGION 1..6: note = Synthetic Construct
KKTAEK

SEQ ID NO: 23626 - protein, 6 aa, synthetic construct
  REGION 1..6: note = Synthetic Construct
KKTAFK

SEQ ID NO: 23627 - protein, 6 aa, synthetic construct
  REGION 1..6: note = Synthetic Construct
KKTAGK

SEQ ID NO: 23628 - protein, 6 aa, synthetic construct
  REGION 1..6: note = Synthetic Construct
KKTAHK

SEQ ID NO: 23629 - protein, 6 aa, synthetic construct
  REGION 1..6: note = Synthetic Construct
KKTAIK

SEQ ID NO: 23630 - protein, 6 aa, synthetic construct
  REGION 1..6: note = Synthetic Construct
KKTALK

SEQ ID NO: 23631 - protein, 6 aa, synthetic construct
  REGION 1..6: note = Synthetic Construct
KKTANK

SEQ ID NO: 23632 - protein, 6 aa, synthetic construct
  REGION 1..6: note = Synthetic Construct
KKTAQK

SEQ ID NO: 23633 - protein, 6 aa, synthetic construct
  REGION 1..6: note = Synthetic Construct
KKTARK

SEQ ID NO: 23634 - protein, 6 aa, synthetic construct
  REGION 1..6: note = Synthetic Construct
KKTASK

SEQ ID NO: 23635 - protein, 6 aa, synthetic construct
  REGION 1..6: note = Synthetic Construct
KKTATK

SEQ ID NO: 23636 - protein, 6 aa, synthetic construct
  REGION 1..6: note = Synthetic Construct
KKTAYK

SEQ ID NO: 23637 - protein, 6 aa, synthetic construct
  REGION 1..6: note = Synthetic Construct
KKTDAK

SEQ ID NO: 23638 - protein, 6 aa, synthetic construct
  REGION 1..6: note = Synthetic Construct
KKTDDK

SEQ ID NO: 23639 - protein, 6 aa, synthetic construct
  REGION 1..6: note = Synthetic Construct
KKTDEK

SEQ ID NO: 23640 - protein, 6 aa, synthetic construct
  REGION 1..6: note = Synthetic Construct
KKTDFK

SEQ ID NO: 23641 - protein, 6 aa, synthetic construct
  REGION 1..6: note = Synthetic Construct
KKTDGK

SEQ ID NO: 23642 - protein, 6 aa, synthetic construct
  REGION 1..6: note = Synthetic Construct
KKTDHK

SEQ ID NO: 23643 - protein, 6 aa, synthetic construct
  REGION 1..6: note = Synthetic Construct
KKTDIK

SEQ ID NO: 23644 - protein, 6 aa, synthetic construct
  REGION 1..6: note = Synthetic Construct
KKTDLK

SEQ ID NO: 23645 - protein, 6 aa, synthetic construct
  REGION 1..6: note = Synthetic Construct
KKTDNK

SEQ ID NO: 23646 - protein, 6 aa, synthetic construct
  REGION 1..6: note = Synthetic Construct
KKTDQK

SEQ ID NO: 23647 - protein, 6 aa, synthetic construct
  REGION 1..6: note = Synthetic Construct
KKTDRK

SEQ ID NO: 23648 - protein, 6 aa, synthetic construct
  REGION 1..6: note = Synthetic Construct
KKTDSK

SEQ ID NO: 23649 - protein, 6 aa, synthetic construct
  REGION 1..6: note = Synthetic Construct
KKTDTK

SEQ ID NO: 23650 - protein, 6 aa, synthetic construct
  REGION 1..6: note = Synthetic Construct
KKTDYK

SEQ ID NO: 23651 - protein, 6 aa, synthetic construct
  REGION 1..6: note = Synthetic Construct
KKTEAK

SEQ ID NO: 23652 - protein, 6 aa, synthetic construct
  REGION 1..6: note = Synthetic Construct
KKTEDK

SEQ ID NO: 23653 - protein, 6 aa, synthetic construct
  REGION 1..6: note = Synthetic Construct
KKTEEK

SEQ ID NO: 23654 - protein, 6 aa, synthetic construct
  REGION 1..6: note = Synthetic Construct
KKTEFK

SEQ ID NO: 23655 - protein, 6 aa, synthetic construct
  REGION 1..6: note = Synthetic Construct
KKTEGK

SEQ ID NO: 23656 - protein, 6 aa, synthetic construct
  REGION 1..6: note = Synthetic Construct
KKTEHK

SEQ ID NO: 23657 - protein, 6 aa, synthetic construct
  REGION 1..6: note = Synthetic Construct
KKTEIK

SEQ ID NO: 23658 - protein, 6 aa, synthetic construct
  REGION 1..6: note = Synthetic Construct
KKTELK

SEQ ID NO: 23659 - protein, 6 aa, synthetic construct
  REGION 1..6: note = Synthetic Construct
KKTENK

SEQ ID NO: 23660 - protein, 6 aa, synthetic construct
  REGION 1..6: note = Synthetic Construct
KKTEQK

SEQ ID NO: 23661 - protein, 6 aa, synthetic construct
  REGION 1..6: note = Synthetic Construct
KKTERK

SEQ ID NO: 23662 - protein, 6 aa, synthetic construct
  REGION 1..6: note = Synthetic Construct
KKTESK

SEQ ID NO: 23663 - protein, 6 aa, synthetic construct
  REGION 1..6: note = Synthetic Construct
KKTETK

SEQ ID NO: 23664 - protein, 6 aa, synthetic construct
  REGION 1..6: note = Synthetic Construct
KKTEYK

SEQ ID NO: 23665 - protein, 6 aa, synthetic construct
  REGION 1..6: note = Synthetic Construct
KKTFAK

SEQ ID NO: 23666 - protein, 6 aa, synthetic construct
  REGION 1..6: note = Synthetic Construct
KKTFDK

SEQ ID NO: 23667 - protein, 6 aa, synthetic construct
  REGION 1..6: note = Synthetic Construct
KKTFEK

SEQ ID NO: 23668 - protein, 6 aa, synthetic construct
  REGION 1..6: note = Synthetic Construct
KKTFFK

SEQ ID NO: 23669 - protein, 6 aa, synthetic construct
  REGION 1..6: note = Synthetic Construct
KKTFGK

SEQ ID NO: 23670 - protein, 6 aa, synthetic construct
  REGION 1..6: note = Synthetic Construct
KKTFHK

SEQ ID NO: 23671 - protein, 6 aa, synthetic construct
  REGION 1..6: note = Synthetic Construct
KKTFIK

SEQ ID NO: 23672 - protein, 6 aa, synthetic construct
  REGION 1..6: note = Synthetic Construct
KKTFLK

SEQ ID NO: 23673 - protein, 6 aa, synthetic construct
  REGION 1..6: note = Synthetic Construct
KKTFNK

SEQ ID NO: 23674 - protein, 6 aa, synthetic construct
  REGION 1..6: note = Synthetic Construct
KKTFQK

SEQ ID NO: 23675 - protein, 6 aa, synthetic construct
  REGION 1..6: note = Synthetic Construct
KKTFRK

SEQ ID NO: 23676 - protein, 6 aa, synthetic construct
  REGION 1..6: note = Synthetic Construct
KKTFSK

SEQ ID NO: 23677 - protein, 6 aa, synthetic construct
  REGION 1..6: note = Synthetic Construct
KKTFTK

SEQ ID NO: 23678 - protein, 6 aa, synthetic construct
  REGION 1..6: note = Synthetic Construct
KKTFYK

SEQ ID NO: 23679 - protein, 6 aa, synthetic construct
  REGION 1..6: note = Synthetic Construct
KKTGAK

SEQ ID NO: 23680 - protein, 6 aa, synthetic construct
  REGION 1..6: note = Synthetic Construct
KKTGDK

SEQ ID NO: 23681 - protein, 6 aa, synthetic construct
  REGION 1..6: note = Synthetic Construct
KKTGEK

SEQ ID NO: 23682 - protein, 6 aa, synthetic construct
  REGION 1..6: note = Synthetic Construct
KKTGFK

SEQ ID NO: 23683 - protein, 6 aa, synthetic construct
  REGION 1..6: note = Synthetic Construct
KKTGGK

SEQ ID NO: 23684 - protein, 6 aa, synthetic construct
  REGION 1..6: note = Synthetic Construct
KKTGHK

SEQ ID NO: 23685 - protein, 6 aa, synthetic construct
  REGION 1..6: note = Synthetic Construct
KKTGIK

SEQ ID NO: 23686 - protein, 6 aa, synthetic construct
  REGION 1..6: note = Synthetic Construct
KKTGLK

SEQ ID NO: 23687 - protein, 6 aa, synthetic construct
  REGION 1..6: note = Synthetic Construct
KKTGNK

SEQ ID NO: 23688 - protein, 6 aa, synthetic construct
  REGION 1..6: note = Synthetic Construct
KKTGQK

SEQ ID NO: 23689 - protein, 6 aa, synthetic construct
  REGION 1..6: note = Synthetic Construct
KKTGRK

SEQ ID NO: 23690 - protein, 6 aa, synthetic construct
  REGION 1..6: note = Synthetic Construct
KKTGSK

SEQ ID NO: 23691 - protein, 6 aa, synthetic construct
  REGION 1..6: note = Synthetic Construct
KKTGTK

SEQ ID NO: 23692 - protein, 6 aa, synthetic construct
  REGION 1..6: note = Synthetic Construct
KKTGYK

SEQ ID NO: 23693 - protein, 6 aa, synthetic construct
  REGION 1..6: note = Synthetic Construct
KKTHAK

SEQ ID NO: 23694 - protein, 6 aa, synthetic construct
  REGION 1..6: note = Synthetic Construct
KKTHDK

SEQ ID NO: 23695 - protein, 6 aa, synthetic construct
  REGION 1..6: note = Synthetic Construct
KKTHEK

SEQ ID NO: 23696 - protein, 6 aa, synthetic construct
  REGION 1..6: note = Synthetic Construct
KKTHFK

SEQ ID NO: 23697 - protein, 6 aa, synthetic construct
  REGION 1..6: note = Synthetic Construct
KKTHGK

SEQ ID NO: 23698 - protein, 6 aa, synthetic construct
  REGION 1..6: note = Synthetic Construct
KKTHHK

SEQ ID NO: 23699 - protein, 6 aa, synthetic construct
  REGION 1..6: note = Synthetic Construct
KKTHIK

SEQ ID NO: 23700 - protein, 6 aa, synthetic construct
  REGION 1..6: note = Synthetic Construct
KKTHLK

(The sequence listing continues in the following parts.)

What is claimed is:

1. A compound selected from:

Example 1A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 2A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH, 3499             3500

Example 3A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 4A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

3501                                                                 3502

Example 5A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 6A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 7A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 8A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH, 3505                                                                           3506

Example 9A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH,

Example 10A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH,

Example 11A

H–G–I–V–E–Q–C–C–T–S–I–C–S–L–Y–Q–L–E–N–Y–C–N–OH

H–G–K–G–S–H–K–F–V–N–Q–H–L–C–G–S–H–L–V–E–A–L–Y–L–V–C–G–K–R–G–F–F–Y–T–P–R–OH,

Example 12A

H–G–I–V–E–Q–C–C–T–S–I–C–S–L–Y–Q–L–E–N–Y–C–N–OH

H–G–K–G–S–H–K–F–V–N–Q–H–L–C–G–S–H–L–V–E–A–L–Y–L–V–C–G–K–R–G–F–F–Y–T–P–R–OH, 3509                                                                3510

Example 13A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 14A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH, 3511 3512

Example 15A

H–G–I–V–E–Q–C–C–T–S–I–C–S–L–Y–Q–L–E–N–Y–C–N–OH

H–G–K–G–S–H–K–F–V–N–Q–H–L–C–G–S–H–L–V–E–A–L–Y–L–V–C–G–K–R–G–F–F–Y–T–P–R–OH,

Example 16A

H–G–I–V–E–Q–C–C–T–S–I–C–S–L–Y–Q–L–E–N–Y–C–N–OH

H–G–K–G–S–H–K–F–V–N–Q–H–L–C–G–S–H–L–V–E–A–L–Y–L–V–C–G–K–R–G–F–F–Y–T–P–R–OH,

Example 17A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 18A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

3515

3516

Example 19A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 20A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 21A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 22A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 23A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH,

Example 24A

H—G—I—V—E—Q—C—C—T—S—I—C—S—L—Y—Q—L—E—N—Y—C—N—OH

H—G—K—G—S—H—K—F—V—N—Q—H—L—C—G—S—H—L—V—E—A—L—Y—L—V—C—G—K—R—G—F—F—Y—T—P—R—OH,

3521 3522

Example 25A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 26A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

3523            3524

Example 27A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 28A

H-G-I-V-E-Q-C-C-T-S-I-C-S-L-Y-Q-L-E-N-Y-C-N-OH

H-G-K-G-S-H-K-F-V-N-Q-H-L-C-G-S-H-L-V-E-A-L-Y-L-V-C-G-K-R-G-F-F-Y-T-P-R-OH,

Example 29A

H‑G‑I‑V‑E‑Q‑C‑C‑T‑S‑I‑C‑S‑L‑Y‑Q‑L‑E‑N‑Y‑C‑N‑OH

H‑G‑K‑G‑S‑H‑K‑F‑V‑N‑Q‑H‑L‑C‑G‑S‑H‑L‑V‑E‑A‑L‑Y‑L‑V‑C‑G‑K‑R‑G‑F‑F‑Y‑T‑P‑R‑OH,

Prophetic

Example 30A

H‑G‑I‑V‑E‑Q‑C‑C‑T‑S‑I‑C‑S‑L‑Y‑Q‑L‑E‑N‑Y‑C‑N‑OH

H‑G‑K‑G‑S‑H‑K‑F‑V‑N‑Q‑H‑L‑C‑G‑S‑H‑L‑V‑E‑A‑L‑Y‑L‑V‑C‑G‑K‑R‑G‑F‑F‑Y‑T‑P‑R‑OH 3527 3528

Example 31A

H-G-I-V-E-Q-C-C-T-S-I—C-S-L-Q-L-E-N-Y-C-N-OH
H-G-K-G-S-H-K-F-V-N-Q—H-L-C-G-S-H-L-V-E-A—L-Y-L-V-C-G-K-R-G-F-F-Y-T-P-R-OH,

Example 32A

H-G-I-V-E-Q-C-C-T-S-I—C-S-L-Q-L-E-N-Y-C-N-OH
H-G-K-G-S-H-K-F-V-N-Q—H-L-C-G-S-H-L-V-E-A—L-Y-L-V-C-G-K-R-G-F-F-Y-T-P-R-OH, 3529                                                                                                    3530

Example 33A

H-G-I-V-E-Q-C-C-T-S-I—C-S-L-Q-L-E-N-Y-C-N-OH
H-G-K-G-S-H-K-F-V-N-Q—H-L-C-G-S-H-L-V-E-A—L-Y-L-V-C-G-K-R-G-F-F-Y-T-P-R-OH,

Example 34A

H-G-I-V-E-Q-C-C-T-S-I—C-S-L-Q-L-E-N-Y-C-N-OH
H-G-K-G-S-H-K-F-V-N-Q—H-L-C-G-S-H-L-V-E-A—L-Y-L-V-C-G-K-R-G-F-F-Y-T-P-R-OH, 3531                                                                                                    3532

Example 35A

H·G·I·V·E·Q·C·C·T·S·I—C·S·L·Q·L·E·N·Y·C·N·OH

H·G·K·G·S·H·K·F·V·N·Q——H·L·C·G·S·H·L·V·E·A——L·Y·L·V·C·G·K·R·G·F·F·Y·T·P·R·OH,

Example 36A

H·G·I·V·E·Q·C·C·T·S·I—C·S·L·Q·L·E·N·Y·C·N·OH

H·G·K·G·S·H·K·F·V·N·Q——H·L·C·G·S·H·L·V·E·A——L·Y·L·V·C·G·K·R·G·F·F·Y·T·P·R·OH, 3533 3534

Example 37A

H·G·I·V·E·Q·C·C·T·S·I—C·S·L·Q·L·E·N·Y·C·N—OH

H·G·K·G·S·H·K·F·V·N·Q—H·L·C·G·S·H·L·V·E·A—L·Y·L·V·C·G·K·R·G·F·F·Y·T·P·R·OH,

Example 38B

H·G·I·V·E·Q·C·C·T·S·I—C·S·L·Q·L·E·N·Y·C·N—OH

H·G·K·G·S·H·K·F·V·N·Q—H·L·C·G·S·H·L·V·E·A—L·Y·L·V·C·G·K·R·G·F·F·Y·T·P·R·OH, 3535                                                                        3536

Example 39A

H-G-I-V-E-Q-C-C-T-S-I—C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 40A

H-G-I-V-E-Q-C-C-T-S-I—C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH, 3537             3538

Example 41A

H‑G‑I‑V‑E‑Q‑C‑C‑T‑S‑I—C‑S‑L‑Q‑L‑E‑N‑Y‑C‑N‑OH

H‑G‑K‑G‑S‑H‑K‑F‑V‑N‑Q—H‑L‑C‑G‑S‑H‑L‑V‑E‑A—L‑Y‑L‑V‑C‑G‑K‑R‑G‑F‑F‑Y‑T‑P‑R‑OH,

Example 42A

H‑G‑I‑V‑E‑Q‑C‑C‑T‑S‑I—C‑S‑L‑Q‑L‑E‑N‑Y‑C‑N‑OH

H‑G‑K‑G‑S‑H‑K‑F‑V‑N‑Q—H‑L‑C‑G‑S‑H‑L‑V‑E‑A—L‑Y‑L‑V‑C‑G‑K‑R‑G‑F‑F‑Y‑T‑P‑R‑OH,

Example 43A

H-G-I-V-E-Q-C-C-T-S-I-C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 44A

H-G-I-V-E-Q-C-C-T-S-I-C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH, 3541                                                                                     3542

Example 45A

H-G-I-V-E-Q-C-C-T-S-I—C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 46A

H-G-I-V-E-Q-C-C-T-S-I—C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH, 3543                                                                 3544

Example 47A

H-G-I-V-E-Q-C-C-T-S-I—C-S-L-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH,

Example 48A

H-G-I-V-E-Q-C-C-T-S-I—C-S-L-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH, 3545                                                                              3546

Example 49A

H-G-I-V-E-Q-C-C-T-S-I-C-S-L-Q-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 50A

H-G-I-V-E-Q-C-C-T-S-I-C-S-L-Q-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH, 3547                                                                 3548

Example 51a

H—G—I—V—E—Q—C—C—T—S—I——C—S—L—Q—L—E—N—Y—C—N—OH

H—G—K—G—S—H—K—F—V—N—Q——H—L—C—G—S—H—L—V—E—A——L—Y—L—V—C—G—K—R—G—F—F—Y—T—P—R—OH,

Example 52A

H—G—I—V—E—Q—C—C—T—S—I——C—S—L—Q—L—E—N—Y—C—N—OH

H—G—K—G—S—H—K—F—V—N—Q——H—L—C—G—S—H—L—V—E—A——L—Y—L—V—C—G—K—R—G—F—F—Y—T—P—R—OH, 3549                                                                              3550

Example 53A

H-G-I-V-E-Q-C-C-T-S-I—C-S-L-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH,

Example 54A

H-G-I-V-E-Q-C-C-T-S-I—C-S-L-Q-L-E-N-Y-C-N-OH

H-G-K-G-S-H-K-F-V-N-Q——H-L-C-G-S-H-L-V-E-A—L-Y-L-V-C-G-K-R-G-F-F-Y-T-P-R-OH,

3551                                                              3552

Example 55A

H-G-I-V-E-Q-C-C-T-S-I——C-S-L-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

Example 56A

H-G-I-V-E-Q-C-C-T-S-I——C-S-L-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

3553　　　　　　　　3554

-continued

Example 57A

H-G—I—V—E—Q—C—C—T—S—I——C—S—L—Q—L—E—N—Y—C—N—OH

H-G—K—G—S—H—K—F—V—N—Q——H—L—C—G—S—H—L—V—E—A——L—Y—L—V—C—G—K—R—G—F—F—Y—T—P—R—OH,

3555 3556

Example 58A

H-G-I-V-E-Q-C-C-T-S-I——C-S-L-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

Example 59A

H-G-I-V-E-Q-C-C-T-S-I——C-S-L-Q-L-E-N-Y-C-N-OH

H-G-K-G-S-H-K-F-V-N-Q——H-L-C-G-S-H-L-V-E-A——L-Y-L-V-C-G-K-R-G-F-F-Y-T-P-R-OH,

3557 3558

-continued

Example 60A

H-G-I-V-E-Q-C-C-T-S-I—C-S-L-Q-L-E-N-Y-C-N-OH

H-G-K-G-S-H-K-F-V-N-Q—H-L-C-G-S-H-L-V-E-A—L-Y-L-V-C-G-K-R-G-F-F-Y-T-P-R-OH,

Example 61A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 62A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

Example 63A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

-continued

Example 64A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

Example 65A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

Example 66A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

-continued

Example 67A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

-continued

Example 68A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

40

Example 69A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

-continued

35

Example 70A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 71A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

-continued

Example 72A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

40

Example 73A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

-continued

Example 74A

H—G-I-V-E-Q-C-C-T-S-I-C-S-L-Y-Q-L-E-N-Y-C—N—OH

H-G-K-G-S-H-K-F-V-N-Q-H-L-C-G-S-H-L-V-E-A-L-Y-L-V-C-G-K-R-G-F-F-Y-T-P-R—OH 3581 3582

Example 75A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

Example 76A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

3583                                                                 3584

Example 77A

H—G-I-V-E-Q-C-C-T-S-I-C-S-L-Y-Q-L-E-N-Y-C—N—OH

H-G-K-G-S-H-K-F-V-N-Q-H-L-C-G-S-H-L-V-E-A-L-Y-L-V-C-G-K-R-G-F-F-Y-T-P-R—OH

-continued

Example 78A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

Example 79A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

Example 80A

H—G-I-V-E-Q-C-C-T-S-I-C-S-L-Y-Q-L-E-N-Y-C—N—OH

-continued

H—G-K-G-S-H-K-F-V-N-Q-H-L-C-G-S-H-L-V-E-A-L-Y-L-V-C-G-K-R-G-F-F-Y-T-P-R—OH

30

Example 81A

H—G-I-V-E-Q-C-C-T-S-I-C-S-L-Y-Q-L-E-N-Y-C—N—OH

3591

3592

-continued

H—G-K-G-S-H-K-F-V-N-Q-H-L-C-G-S-H-L-V-E-A-L-Y-L-V-C-G-K-R-G-F-F-Y-T-P-R—OH

Example 82A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH 3593 3594

-continued

Example 83A

H—G-I-V-E-Q-C-C-T-S-I-C-S-L-Y-Q-L-E-N-Y-C—N—OH

3595  3596

-continued

H—G-K-G-S-H-K-F-V-N-Q-H-L-C-G-S-H-L-V-E-A-L-Y-L-V-C-G-K-R-G-F-F-Y-T-P-R—OH

Example 84A

3597  3598

-continued

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH,

Example 85A

H—G-I-V-E-Q-C-C-T-S-I-C-S-L-Y-Q-L-E-N-Y-C—N—OH

H—G-K-G-S-H-K-F-V-N-Q-H-L-C-G-S-H-L-V-E-A-L-Y-L-V-C-G-K-R-G-F-F-Y-T-P-R—OH

-continued or a pharmaceutically acceptable salt thereof, an isotope thereof, and combinations thereof.

2. The compound according to claim 1, wherein the compound is Example 1A or a pharmaceutically acceptable salt thereof.

3. The compound according to claim 1, wherein the compound is Example 2A or a pharmaceutically acceptable salt thereof.

4. The compound according to claim 1, wherein the compound is Example 7A or a pharmaceutically acceptable salt thereof.

5. The compound according to claim 1, wherein the compound is Example 9A or a pharmaceutically acceptable salt thereof.

6. The compound according to claim 1, wherein the compound is Example 14A or a pharmaceutically acceptable salt thereof.

7. The compound according to claim 1, wherein the compound is Example 15A or a pharmaceutically acceptable salt thereof.

8. The compound according to claim 1, wherein the compound is Example 16A or a pharmaceutically acceptable salt thereof.

9. The compound according to claim 1, wherein the compound is Example 18A or a pharmaceutically acceptable salt thereof.

10. The compound according to claim 1, wherein the compound is Example 19A or a pharmaceutically acceptable salt thereof.

11. The compound according to claim 1, wherein the compound is Example 22A or a pharmaceutically acceptable salt thereof.

12. The compound according to claim 1, wherein the compound is Example 25A or a pharmaceutically acceptable salt thereof.

13. The compound according to claim 1, wherein the compound is Example 26A or a pharmaceutically acceptable salt thereof.

14. The compound according to claim 1, wherein the compound is Example 27A or a pharmaceutically acceptable salt thereof.

15. The compound according to claim 1, wherein the compound is Example 28A or a pharmaceutically acceptable salt thereof.

16. The compound according to claim 1, wherein the compound is Example 30A or a pharmaceutically acceptable salt thereof.

17. The compound according to claim 1, wherein the compound is Example 31A or a pharmaceutically acceptable salt thereof.

18. The compound according to claim 1, wherein the compound is Example 46A or a pharmaceutically acceptable salt thereof.

19. The compound according to claim 1, wherein the compound is Example 47A or a pharmaceutically acceptable salt thereof.

20. The compound according to claim 1, wherein the compound is Example 49A or a pharmaceutically acceptable salt thereof.

21. The compound according to claim 1, wherein the compound is Example 51A or a pharmaceutically acceptable salt thereof.

22. The compound according to claim 1, wherein the compound is Example 63A or a pharmaceutically acceptable salt thereof.

23. The compound according to claim 1, wherein the compound is Example 68A or a pharmaceutically acceptable salt thereof.

24. The compound according to claim 1, wherein the compound is Example 71A or a pharmaceutically acceptable salt thereof.

25. The compound according to claim 1, wherein the compound is Example 73A or a pharmaceutically acceptable salt thereof.

26. The compound according to claim 1, wherein the compound is Example 75A or a pharmaceutically acceptable salt thereof.

27. The compound according to claim 1, wherein the compound is Example 77A or a pharmaceutically acceptable salt thereof.

28. The compound according to claim 1, wherein the compound is Example 78A or a pharmaceutically acceptable salt thereof.

29. A pharmaceutical composition comprising at least one compound or a pharmaceutically acceptable salt thereof according to any one of claims 1-28 and a pharmaceutically acceptable carrier.

* * * * *